United States Patent 9,487,797 (GENOMIC PLANT SEQUENCES AND USES THEREOF) - sequence listing, part 11

SEQ ID NO: 23094 - DNA, 1501 bp, Oryza sativa
gggcgagcgggacggcggcaagctagccggccgagcacacgacagcgccgcggcgacgcgccgggcccaaaggccaccggcggcgagcggcggctgcgcaaggcggcgacgcacgcacggaagtgatggcgcacggcgctaggagggagaggaggagctcaccgaggacacggcgacgaggggcggggaaagacggggaagctcggcgttgacgctcctcgggacgaaggcggaatggcggccgccggcgttccgcgagcgggaaccggcggacggcggccggaaggacctggggaggacaagggaaaggttaggaatgggataggggctcccagcggcgggaatcgccagccggaggtgagaaagagcggcggatgctcaccggcgcgaggggaaccgtgtttcagcaggattctggtcgtgaaaagcggcggccgaggtgctcctcggtgctgcgaagcgagcggcggcgacggcacgacttgaggtggctaggagcggcgggaggcggcggctggagcacgccgatgagtggtggggagagggagcgccgtggggaggtggtttcggcgacacaatggggaagcggaggggatgccggggtatggcacgacgcggcgaagccgctgatggcggtcgcgcggagcggcggcggcaggagcagcggtggcggccggctggaggatcaccggcgagaggtgcacggtggcggcgtggttttcgtgcacaggagggctcgggagagaggggaaaatggagagggaggtgcggggaatgtttttataggggaggggaggtcggaccgagcccgggagaggcggagtcggggcggcaaccgccggcggcgtgggcggcatcgtggggtgtgggtggcggttttggaagggagaggtgggggatgaggaggacgtggggcggcggggtcccacggccggcggactcgtgcgcggggtggagaaggagggcggaaacggcagcgtcgtggggaggctcaggcggccatggcggcggttggagccggaggaaggggccggccccacctgtcagcgaagggagagaggaagggacgcaaaaaagactttttgcgagggaggataggagggaggccgagggaggggaaagggaggccggcctagccgggaaagaggagggagggagttgggccgagcccaaaaagggaggaaagggatttaatttggtttttctttttatttaaatgagtttaatgaactttgtgactttaaaattacttcttgagctccgaaacttcacgggaaaatttcagagaatatttaggacccaaagaatattataaaatattttcggccaatgatttttttaagggaaaattttaattctcccattatttcacttgattaagttactttaacttttattgaatttctagaaaatgcattattaattgatttttaatcccgaccgaaaatcggggcgttacagtgatgtatatgtcaagtctttgcacaaacagctcatgtac

SEQ ID NO: 23095 - DNA, 1501 bp, Oryza sativa
ctccggctggcgattcccgccgctgggagcccctatcccattcctaacctttcccttgtcctccccaggtccttccggccgccgtccgccggttcccgctcgcggaacgccggcggccgccattccgccttcgtcccgaggagcgtcaacgccgagcttccccgtctttccccgcccctcgtcgccgtgtcctcggtgagctcctcctctccctcctagcgccgtgcgccatcacttccgtgcgtgcgtcgccgccttgcgcagccgccgctcgccgccggtggcctttgggcccggcgcgtcgccgcggcgctgtcgtgtgctcggccggctagcttgccgccgtcccgctcgcccgtgccgctcgaccccctggtcgcgccgctccctcgcgtgagccgccgccgccgctcgcgtgcgccgcctttccccacgctgttgctggccgtcgccgccgtgccttggctctgccgggccggctttgtgccgcacccgtgcccctggccgccgctcccctcggccgctcgatcggctcgggccgatttgggccgtccacgtggtggacgcgcacccgaggccatgtgcggacttggtccaccgtgcgccgcccctttgtgccgctgacgtgcggggcccgcgtgtcggcgccggcctccccttgatgacgtcagcgcgtccctattcctctgagaaattaatcattaattgtgttataaattgtatttaattctagaaattcatttaaatggctcaaaacttctaaaattcaaatctaattcatatgaactccgaattgagccgttcaacttgcaaaattcatctaaaattgagctctacatgttttttttactttttatgtactgttcccttagtgtttattagagtttttccttgttttgtgtgccagcgtatagaatccgtcgtttcggaagtctacggtctcgaggaaaagagttcagaagataaaagtgaagaagcaaggcaagtcacacatcccccttgagcatgttgatccaaatttataaatgttttattgtttgcaaataaatatgcatcgttttactaattacatgggtatagggtttacctatctgcttgcttgtaccatgttatttgatatgtgtcctttgtcaaccttgggtgataaatcgactagcttatgttactttgatgacctagctagaactatatgcttagcgatgcttaattaccactagctcagtagatgggataattgcagtattagacatgttagtattatgatgagctacgtgctcgagacatctggccatgtttcatggtcataattatccaactaaaatacgactgaatagcgggttgtgggtgcatggttttgctggtcgcacccatggcaattaaggaccggttcgcgggatgcactagaagacatacaacgcttgccacaagcgggaatgggtaactgcctgccttgaagtgtagcttttctctggttgacgcatccaggcaagggtgggcgtga

SEQ ID NO: 23096 - DNA, 943 bp, Oryza sativa
gatagcgggggaggcggggaggcggacgtcgatggaggggcgctggcgggggagaaggcggcgagggcagtgagggagcggagaaggcgatggcgctggagggggagcagacaccaggacaggcgacggaggcggcgagggagatggacggcgacggaggcagggatggaggggaatggcgacgggaagtggtgaaatggtgatgatgcgagaggaatcggatagggatagggtgagtaagagactgaaaaaatacgataatacccctacgcgatttttttcccttaacaaaaacaccctttcacatttctacttccactaatactggtgggagtagaactagatctcagccctacaattaaatacgatcaatggcccagatttctttctactccgagtagaaagcaccggagtggggctgtttaaaattaggaacttagcccctcaaacaacccaatccgaaattcgcttctatgaagatttgaactcaagttcttgggatgctacttaggtcactgcaaccacgaggtgacatgcacttttgctgatgtaattgctttgttgacaaatgtcacaaaccaaacacaaactacttcacaactcacactctaacatagacgagccaagggttttcgttgattattgatcctagttaacaagacttgttaaattaggttgttgggacaaccttgttgaggtgctttgttcttcttttgctctctttttgtgttttgctttttggttctttgtatttgcgtcttggacacctctcttcttcttctttaatgcaatgatatgcaactctcatacgtattcgagaaaaaaaaaactctcatgctctcttagacacgagcctatcacttcaatttaattctttggggtttggttactcaacctgagcttatcaatgactaatatgatcattccgttattcctattcagc

SEQ ID NO: 23097 - DNA, 1501 bp, Oryza sativa
agtagtgggagagacgctacatcgctggtcgaggaccaggcagtagtcgtaactcgaccacttgaagtgaaaatagtgggagaaacgctacatcgctggtcgaggaccaggcagtagtcgtaactcgaccactagaagcaaatgtacgagagatcactacgatcaactggttgagaaccagtgagaaggtgtctctcgatcatttggagtcgtggcacgaggactgctacgctaccggtcgaagaccagtcgtagctgttcctcaaccatctgaagtcatggtgcgaggaccgctacgccgccgtagtcatacctcgaccatctgaagttaaggcgcgagagattgctatgtaccggttcgagaaccagcgagcgagtagaattatctctcgaacaccaatggaagttgcggtgcgagagattgctacgtcctggtgcgagaaccagcgagcgagtagaattatctctcgagcgccaatggaagttgtagtgtgagagattgctacgtcctggtgcgagaaccagcgagcgagtagaattatctctcaagcaccaatggaagtgctagagttggtttattacatgtgcgtctcatgtggccagcatgactcacacacccaactcgtagcatatccggatgtccattcgcaatcatgtcgggtgatcaagccgacggcgtttacgaggaattatccgttaacaaccttttctcgagtagtccagcgatggccggtgctatgagataggtcgtcggtcttcgttggcaggttgggtgcgataactccgcatttgtcgagaatgttctcgataatggagtgtacttgaccataacctacccgagtacttaattgtttctgaaaaatattttctagaaggcaagatatatagcagataatgtcgagtatatactcaaaaaactgcatggatcttctagtattatcaggacataactgcagatgtaattatcaggcattatgtaaaccgtaaacaagcataatttatacagaagagaacggagcgagcccccagcgttagaccgtagttggcctgacatcggaagcactcgcacaatagatattgtataaaaaacatgctctaggtaaacataataaattattgatctgacaatgctgtatgatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttctggtacgccgcgtatcttaaggcttgggtgatctcgatagaccaagttgtcgatgacaatggtggttccgatctcgtcggaagacatgctccggtcaggttagatctccacagccgaagtcatcgagtagcttgttgtcggagaatccatctcttaaaccaatctcgtcgaaatcctagagcaccaaagtcccctacctggcgcgccact

SEQ ID NO: 23098 - DNA, 408 bp, Oryza sativa
ggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtt

SEQ ID NO: 23099 - DNA, 1501 bp, Oryza sativa
tggacgtgggccttaattcagcctatatgtacatgtttatgggccagaattttcgtactataaacttttatgcaaacaaaggagtaaattgcactcacggtgcatcaacttggtaggtgggtgtaatttggtgcaagaacttgagatataagtgttctagtgcaacaacttggcaggtaggtgcaatttagtataaggcctttataagtgatcatataaatgcaacaacttaaaggtaggtacgattttgatacaaagttatgcggacttaattatttggagctagattcaatttttaagtacttattttgacactatactagcatgtatttgtataagaatatttatatttttatcctaataactaataattgaaagtcaattaaattggatgtagaaattattatatttcggttgatatttgagaaggtgaagaaaacaaaaaattcttaaaaggtaattagatgcaaattgtatgtgcagtataattcttaaagattaaatttactatgtaatggcatattgacatcgtgaaaaaaattcacccactatacaagttgatgcaccaaaatactaaattgcgaagttcttgtagtaaaacacacttacttgtcaagttgttgcattcggacgttcaatttttaagttcttactctatatcgcacccacctgttaagttgttataccatgggtgcaatttactccaaacaaaagtgtcagggttatggataccacatacctaatagtagtcgactaaatctcggcatgacccaccacataccatattctatacggaaacaacctgtggatataggaggagttccggataaggaaagacaaccagagttctacatggaaacgacatggactactcggattgtatccatattggtttccctagttctacttgaacaagggacacctatgggtataaatacaagactccctaggaggagaggagagagaacatagacacacccaccacaatctacggaacaatatatcaagacacaagatcaatgtacaagccaacatacgccaagacaagacgccggatatcgacttcagagataggcacggctagtcccctacggtatctccggatactgataggagagacattgtgctgtctctgatctcgccgggcacgaactcgaggaggaagactaccctgttgttgactacgagtcagatcttcagaccgccatgtcgacaacagttagatagtctaccccaaatattgtacttgtgtgatccagatgaataagagcaataccggctttggccaacaggatgtagggttattacctgacaattcaggggcccgaacctgtataaaaatcctcgtctccatctcttttacctcagtctcgcgtatatcctagtaccaacgatccccatactatgcaaataccggaatcgcgacatcaaacgtcgacagtggcacgccaggtaggggcattttggtgcttcaggatttcgacgagatgggttcaagaga

SEQ ID NO: 23100 - DNA, 1501 bp, Oryza sativa
gtcctgggcaaccatatccctgtaacgccaagataaattcaaggaaaaggatcaaatttcaatgagacaacgagcgtactggtgaaattttacagtcaaatgtaaaacataagtactagatgatttagtattttatatacctttgttgtccctcctgccaagccaagagttgcaagtttgggaatggcatggaagggaaattctgctttctcccagtactgcatatgtaaaaagcccataggggtttatagttatgacatgatacacatcgagcaggcaactgtcactgtaacacaacagctagtcaacccaagggagagttaccatccagcgacgacaagaaaaaaatgtactagtcctagaagatataccatatatatgttttgcaaaaaaaaaaaagaagcaggggattaacaaatgaaaactatgtatagcaacaacatacctctgtcataatgggtgcaatttctctctccataataccacggactttcttcctaagtgtcttctcttcatcagtaagcaaatcatcaaactggtagtaatccgatactgcaaaagcaattttatgaacttacaaccaatatgtagtttattgcataactatatgctgtacatttctccctccttacaagagttgtaaggtgcgttttgatttttcactttattgattattgtaaggtgcacacgcacacacagtaaaggatttttaacttttgtagtttgaattcgcatacatgcatgcgcaagtgctgcttaaatctgtgtggaacatagaagagcatattcaacacagatcaatgatttactagtatgggcaacttggtcttttaccatctttatctctatcccgagataaaaagtggctaacaaatttacatggagtaaggtacagcaatccacgattattaggaatattgaataacagtgactagtataaatgccacggaaattaatttgtccaacctaaataagtcgaagaagattgcgaaagaagaaacgcaagtacttgctgacaacaacgtaagaaaagtacaacaccagtgcaagccgtgcaagcaaaccacctgcctaattattattgcaatcgaaagtactcataaataaagaaagaaacgtgtatggaccagatttagttgttaaaaaccaactacgaagaaaacaatccgatttctaaaaacgcatgtcttaaataatgttgttagcttatattagttaattcacaagattaaatgtaaagctcccatgatagctgaggagcagaactgacaattcctccaaacaaaatatgaacagggctgaaaaggatactccactaaaatccaattttcctcaccgtgagagttaaaatccgaccaaatcccactaacttaaccaaataaaaagcgacgtgatatacagagttgaagagattgccgaaaacgatcccatcccaaacaaaatcttgatttcgtacgcctaacagttcagaacaaaatcttgatttcgtacggctaacagt

SEQ ID NO: 23101 - DNA, 1501 bp, Oryza sativa
ttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacgacaaagcttttcgataacctcgcattggcagtacccgctccgtgaactttacatcctcatgcactctaggcgcacacggtttctagcagtgagaggagttctggcgcacccgggagggaaagacttacacatgcattaagttataattatgtttaaattctcacatgacagtcctaccaatggcgacaccactgtagacacccgcctcgcggttctacctatggctgccccaccgtagagcccctgcctcacacatcaagaaaccactatgcatggatactgcctccgctcagccatctactccgccaggtctatacccatacgagaagcgcggttgtacgggggtcgtttcatgcttaacttcatggctcggtccttaattgaccagggacggcactagccttttccggataccacccaaatcctctgtccgccccagtcgaaaatagttgttttagttttatttctcttttcacaaatcatgtcatcaatatcatggcaatgtggcgctcatgtctccacatgccgcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttatttgtatacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtgtgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatcca

SEQ ID NO: 23102 - DNA, 978 bp, Oryza sativa
cattattggaaataatgagatattatgattgggtgaaactgtcttggccatctaattggagtatttgggagaggtgtgtgcactgtgaagtcagcctgatcgtttgattcgtagttatctccagtcttgggcagcttaatctggctccaagttggcagcaagcagtccctgttctgaactgttagccgtacgaaatcaagattttgttctgaactgttaggcgtacgaaatcaagattttgtttgggatgggatcgttttcggcaatctcttcaactctgtatatcacgtcgctttttatttggttaagttagtgggatttggtcggattttaactctcacggtgaggaaaattggattttagtggagtatccttttcagccctgttcatattttgtttggaggaattgtcagttctgctcctcagctatcatgggagctttacatttaatcttgtgaattaactaatataagctaacaacattatttaagacatgcgtttttagaaatcggattgttttcttcgtagttggtttttaacaactaaatctggtccatacacgtttctttctttatttatgagtactttcgattgcaataataattaggcaggtggtttgcttgcacggcttgcactggtgttgtacttttcttacgttgttgtcagcaagtacttgcgtttcttctttcgcaatcttcttcgacttatttaggttggacaaattaatttccgtggcatttatactagtcactgttattcaatattcctaataatcgtggattgctgtaccttactccatgtaaatttgttagccactttttatctcgggatagagataaagatggtaaaagaccaagttgcccatactagtaaatcattgatctgtgttgaatatgctcttctatgttccacacagatttaagcagcacttgcgcatgcatgtatgcgaattcaaactacaaaagttaaaaatccttt

SEQ ID NO: 23103 - DNA, 1501 bp, Oryza sativa
caggggcaggaggttcgtcttctcccccggcgacggcggccgccggggcgtcgcgtacgacgtcgacttcggccggcggccgggcggctcccccgacgtcaggcaggtcatggcgcggcgggcgaggcggtggatgtaccgccgggtggcgatgtcggcgagcccttccgccgccaccggctgcgtcgtcctgctcctgcacatgccggagcgggagctgtccttcgccaggccgggcgacgagcgctggacgccgctcgtcgacggcggcgtctgggccagccacggcacctccttcctcgacgccgtccacaaccccggcgacggcctattctacgtgctgcaggactccagccccggcggcgacaccgtggtgcactccctcgacctcaccgcgccgccgccgccgccgtcctccccggtggccacgatgctcatgttcgcgacgccgccgcgtccgtgcaaccaccacctcaagaagaccatgtgcaggtacctcgccatcacgccgcagcacccgcagcacgtcgccggcggcctcgaattcctcgtcgtggagcggaggtggcgcaggtcggggagcgacgacgacgcgagcacgacggagatgtacgtcgtcatgctcaggcctctcgacctctacttctacgagcaggtgagcctgcccggcggcgtggggggcgacctcgcgctgttcgtcggccacgccggcgccgcctgcctccgcgtggaggactaccccatgtttcgcggcaactgcgcctacctcaccgacgaaagcgacggcgacggcgaccacgcgaacccgccgtcgtggaagcggctggaccttgctctgtgggagttcggcgggagcaactaccgcgggaggttgacgaagctgcgggacatgtggccactccaccatccatggcaagataattccccgcctcctatttggtttacgccatcgctagattagcgcatctccaattcaaaggtgtgtgataagctatatattgttgttattttttaaaaaaaataatacaattgtaatgcaactaattacattgtactcataacttatattatagagaaaattctctacatacccttgaaaagtttcacaatttcttctatacccctaaattttacttcatcctatacatacctttgagttttcatttggatcttctctcacctatacgaacgctatgattttttcatttcttgctcgtataaatcttgaaacaaatttaacaattcaacaattattaaaagttatatacaagttacaatataattacactacttagattgagaattcgagagaaaccaggtgaggagaattggacaaacaaaataggaatggagctagtacttagattgagaattcgagagaaaccaggtgaggagaattggacaagcaaaataggaatggagctagtacttagattgagaattcgagagaaaccaggtgaggagaattggacaagcaaaataggaatggagctagctgaag

SEQ ID NO: 23104 - DNA, 352 bp, Oryza sativa
ctttaatatcttagtatagagttgtatcgaagtattacccgatacatgttaggtctacctgatcagctatgttattaatgtatataatcctactattaatatatatttcgatctaagtgatttatactgtctcggcaagatgaccgatatatcccaatcacttgatttaagtatatcccgatataaggattatatatcattaatgtctacagttgatcgagtagatttagttctgaattgcttattgatatttgccgatcgatgtacgcatgacatcggcttgaaataaataatatgtcatcggcatctagccgatcggctatcatttataggattaattgcggtttctttg

SEQ ID NO: 23105 - DNA, 1225 bp, Oryza sativa
aagacgtgttgcagcagatcgcgaagaagaagacttgccaggaagttttggaaaagcttcaagacgaggttccttggcgttgagcgtgtgaagaaggcgcgagtgcaaaccttgaagagcgatttcaaggcattgcacatgaaggacaccgagtcaatcgacgagtttgccggcaaaatcagtggcctggcaaacaagttgagcgatcttggtgtaaccatggacgatgatgagcaagtcaagaaactactcgattctgtgccagataagtttctgcatgtcatcgctgcaattgagcagttctctgacttggacagcatgccatttgatgaggcaattggtcgcctcaaggcatacgaggaaaggatacgcaagcgtgatgacaagaatggcgagcatctacttttcacgtccggcgacacaagcggtggccgcagccgcgtcaagaagccggacaggtccaagacaatgtgctactactgtcaagaacttggacactttgcgtatgagtgccctgagaaaaagaagaagaaggagatagcgctccttgccgcagcgtcaagtgatgaggagccaactcttctctgaatgaagcatgccaagattaggggggtaaatgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacaattggtatcagagccaatttatgcccaagatcctgcgcttcaaca

SEQ ID NO: 23106 - DNA, 1501 bp, Oryza sativa
atggcgggaccagcccagccattgcgaaggggaggaagaagatggaccgccccgggtaatctggtaccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaacggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttatcaataccgatgtgcatggattgagaccgttgggtattttgcccaactacggagaccggtcccacctgtcaccaggctttaggagtggcgtcacacctgaccgcttcccttgggaagggaaattgctctggcataacgccgggggctactgtcggtgatatgggaccgggaatatcatgactagaggcttgaggcagacacaatcgcccacggggcctggcaccttcggggacgtcgggcccgagggtgaggtgtccgccctcctcctgattccccccgagggggggtcgggttgcgcttgccccggccccgagggccggggcaccccgacccccttaaggaagtctgcgccacatatatgggataagtgagcacagctgtgctcacctaacagcatttaatgcagtctggtcaggcgtgtcacgctgcatgcagcgcagtacggcgcgttcctttatccggtctgtgaccagtcacagaccggtcagatcacgggttaggtggcgacaggcggtcagacgcacgcttcgccccatcctgtcaagacgagagcttctaggcactcgtccccggctggagctagcgtgttacatcccagagatgacacgctagccccgatcgatatatgccaggcttcatcctaaccattacaagcaagatgttgtgtgaagaagggcaaacatgcacgttgccaagattacacgcggtggacaagaatgaccgatttgtgaccggtctgacactgatcatatcgtcagcgcacagccatgttcccacgacgcgctcacccccggcggaagtggaggtaggtgtgggctgtcccatcggagcgtc

SEQ ID NO: 23107 - DNA, 381 bp, Oryza sativa
gccacgtggccagacgggaaggcggcttccctctactgtgcgtacccccgggcccatatcaccgacaagtggttataggtttgattagtgaaattttatcttttatttatgctcatgaaacctaatatgcaatgccaaccaaaaatccaaatgcacaagaaagactcaaatcaaaacatgtcttatgcaagtatgcatgcttacacttgtgtttgcatctatgttataggttaaagatgaaaaggttttaattttttcttaaattttacttcagtaaaagttgggttgaccacacctaagttaaaaatggaaatttctggctctcaaaaaatggaaaagttagcttcctactatttttgacaagaattccttaaccctaga

SEQ ID NO: 23108 - DNA, 1501 bp, Oryza sativa
atatgacggccatcaccatccacagttatttgtacccttccaacataaacaagatttgacaaagtatttatgttgtatacagttatggaaaatgaatttctagccaacacaaggtttttgagccttgcagattttttgttctttagaacattagacatggctaacatattttcatcgccacatgttaaatcatcaagctgcatttaagaaggaaaaaaaatcaacggcttagttcatcatcatataaaccattgtgccaattaacaaacttgactagtaacacatgacatcgaccgattttgacggattatatgtcgtagtgatgatgttgtttcggtggctgttgaattctgcgacttaataataagttttactaatacgaaacaacatactataatctagcttattcctaaaagaaaaaataaaataaaaacttaaaatactccaaaattttgttacaaaagtcaaacgtggacaaatggcaaattagtttcacaacaaacattttgtgtggactaatggttaagaaaattgtggtcaaagtttaggttattcatgcaagtttttgagtcagttgatacttaagagaaaaaacagaagacagcaaaaaatacagtaacaaattaagcactaggttaaataagaaataacataatatgtcgatatacttgagcaaattgccagtgcaacaaatggtaatgatagtctctcaacaatgtacggcgctctcatcgctaatgaattagaaaagaaaattatccccaaatcgtaaacaattaagtgacagccagatgactaggaccaaaagtcgatcgcatatgtaatcagggtttacagatctgttttaatttggtgattgattgcttgaaaacaatgtaaacaggatccgagctaaataaaggccagggaaagtgcgttggacccaaccaatgaatctaagatacagtacacgcaatgcaaagagagtagatctattcatagggaaaagaaaaaggataacatctaggcagcataagatgtgcagtaaccgaagtactcatagaccattgctggcaactagtaatcgaagattaataagtctattatacgtctcagaactcacaagtgtatacatgaacatgcactcacctctgcttcgggatatacctgaacggcggaatctgcttcgggatataccgaggaaccagacatattgcaatcacggaggaagatgaggttgacgaagtaagagatgcacacggaggaagatgagattggggagaaaggagattatgaagaatgtaaatgagatcggtacctgtccatccttttatctgtaaacaaaaaacggaaaaatggaaaaatagcggaacgatatactctactgtcattttgaaccgtgcaagaatatatctataaaaaacggaaaaacggaaatattggagcgatatactcgaagcacgtaccaatgaagattttctatgcacttttgaagaggtatatattatggggttttaatacg

SEQ ID NO: 23109 - DNA, 1501 bp, Oryza sativa
tatagcggaggcattggatgtatgcattcatgacctgaatttgaggttagttgagttacataacaaatataattataaaagaatagtaggcttgttaaataggcgaacttacatcatcatttaagaattctggttgtgttagtacattcattcttatccgtttaacctccacttcttcaatatgcaccatcactttgttatcctccgtattattaatgtaggtaatgaaagggtcttttttttagtcaactctacgaaggtaggacaaattagtaatagatctgtagaaatgttaaatggttaggcattaccttctgaattttttaatggtgtctggccattcatttttttcttcttttgacctcgtaaggcgttctttggtgggcctttgtctatgattttttggtaagatcttccttctcgatgtacactagaaaagggtaagtcaaatcagtaacacacaaacatagaatataagtaaaaaattatggatgatgtagagagttcatacattcagatatttcattcggtgtttggttgttttgtttcctcttcttttcaccccgtaattcgtctgtgtctggcatgttagcttctttatccgtttgcgcttgaaaaggaggaaagttagtaccattgacatgagcatatgtaactattaaatagcataatacctattgttttctttgtctgtgcttgggttctgattatgtccttctttttaccccttgtttcgtagatgaagtcagtccgattagtcagtttgtatgttcttcctgtaggacctgtaagcctcttcctgctttgattgctctggttactgttgtcctgttaggtaacaaagtgcacgttagtattatgataagttgtagaaacgttagcgagagaattaaaattcagtttaccttcgtttcacaagtcatgtttacattttggtttatataggactcttcgttatgatttgatacatgctacctgggatcaatttgttcttgttcaacatcctacaatagcgtcaacctttttttagcggtgttacgtaagtaataatgattaatagtctagcttatcatctttacctcaaacacatgcgtagtatcttttcgttctaggcattttgaatcattttccatgcaatctagtatcaatgatcgcatacgtggccaaaaatcctttgtgaaatcgttgaaattatcttgtaaagtttggatactttcttgtaaagtgatatcggctgattgttcagtggatgttgtagagtgtacttgaatagcacaagtgagaaaaggatgtcaaacatattttgttaaatagagttcgtattaaaaccccataatatatacctcttcaaaagtgcatagaaaatcttcattggtacgtgcttcgagtatatcgctccaatatttccgtttttccgttttttatagatatattcttgcacggttcaaaatgacagtagagtatatcgttccgctatttttccatttttccgttttttgtt

SEQ ID NO: 23110 - DNA, 1501 bp, Oryza sativa
tgtcaaagttagatatactgtccctcatgaagtgcctgaaaaaattgtgatggggcacactgcagagcttggaggtgtaggggaatcctggactttctacccgtatgtgtttacaggcaattttgttgatatgctgcctggagatgaagatgccccagccatttgggaagttatccaagaccaacaagaccagatacaacagttacaactggacctacaactccaacaagccaaccctgaaggtgatggtgaaaatggtggaattgatgacatggatcaggataatcagaatcaactggatgaagttgaaccacagctgtccctctctttcaatgattactcaatgattgaatcttcatcctctgttcagatcatcaagcagccatctggtcagatagtcccatacagcttgccaatccctgaactgccttttttcaggttccctgaaaagttctgttatgcagttgcatttggagtattcagactccttctgttggctgtgaaccccactatgttccaatgcatcacccaaacgattccatggaacaccgtcaagatcaactgggttgtcattccctatgtgctcccttggtgcattcaaagtcctgctaagcgtcaaagaatctctattgctggaaaaaaatgtcgcaagagctcttccctacagctctgcctcgacagaaataatttccctgcctgtgagagtgaggaagcagaagaaacaggcccagctctctgttgagggtctgagaagaagcccaaggtttgcaaacaagggggagaaacttgatctaacttgtgatgtccctaaaaagaagtccaaggtgaagccgatggtgccagctttcaagcccagcaaggaggacaggtccaaccatcttccaccagccatcccagtggcccagctgcaaaaaataggcgtggagaaatgtggcatgcttcctgaggaagtggctgaagacaagctcctccagcgcaagaatgattagtttaaattctgttttggctatgcttagccttcttgccctggtccttatcagggttgttatcctcaactttatgggtcttttgtgttttattgggccaagactatttctttgtcacagggtagattctctttatggttctgagtgatgactggcagctccatgaaaaacatcatatctttatggttagtttcttatgaagtacatgtgttacttccctgcttcctaaataaatttgtttgcccaaatgaatacaacctcacgaaatagaaattgcaatatcctgtgttggaatgttcgggggataaactcagatcagaaatggctggctattcatcaaaagattgaagaaagtggttgtgcaattatctgtttacaagaaaaaaaagggagcattttgatcactcgtatataaggaagtttgcccctaaaaggtttgataaattttgctaccatccttctctaggagcttcgggagggctcattgtaatttggaacagtcacctatttactgg

SEQ ID NO: 23111 - DNA, 1501 bp, Oryza sativa
aattgaactacctcctgtgtcctaacttgactgcttgctgcttggtttctgaaatttggtcctggatgatgaaattaggatcctattccagttgttttacttgaacacgtttatatattttctggataaaaattatatatattgtataccctataggaaatacatcaccacatacttcgctagggactctgttggagccaatttttgaacggaaatcttcatatttcaggttcgggaatgaatgcaaccctgctggactgaaagaagaatcgcactgaaccaaaggtgcaatatttgtgcactgaaccaaaggcatctcacacgtgaataaccaaatagagttccatttaataaatatccaaatagagtatcatttaataaatatttatcaactagcttattccaaatgaacatccgagcaaactaacttagaatattaaaaataaaacatctcattgacaaatgaacatctcgtaactttttgaaaaaatatcctcccaatgtgaagctcacatcttagatttcttcggagacggcttatgcaggattgcagtgattgcagggaacaaatccgggtatctgctcccgctgtctctttcctgatcatttagtctcggcttgtaaaaatcaaataagatgttgggcctgttacaactatgggcaccttagtcggttttgttgggccaaaaaagtaaagcggaaagcccattggcgagagaagcttcgtgatttgcgtctgggagagggctctgacaaggaaactaatcttgctttgctcggaaaggacccctcgtctcccccgtcttttcgcccttccatcatgcttcctcccagtaatcctcctcccccaaaacccaccaccccattgttggtctctcccattgcctgggcggagaacatggcgaaccatactgatgctgagcttcggccggagctctttcttcctcctggcgccaatgtggaagccccatggattgccagaataccaaggtcagatttcactgttcagtccatccctcagaaccttggagaagagtttgctgttgttctgattgagccccaacctcctgagcacttagtgaaccagactatcaatgagatcattcactttgtcactcatttctgtcacattcggtcattagggcgcaacgctaccccctggccctttgtatagttcaatttcagtctgtctttcacagagatgctatggttgatgagggtccgatcatgcaacaaaacctcgcgcaagccaattttatcccacatgatcaacttgctaacagaagaaacagaccatacaatagagaaggatgggtcatcattttgggtattcctttgaggctaagaacctattccattattgagcaaattgtgaataagtttggaaagcttatgcgctggcattccacggacaggatcttgggtagggttcttgtcaaagttagatatactgtccctcatgaagtgcctgaaaaaattgtgatggggcacactgcagagc

SEQ ID NO: 23112 - DNA, 1501 bp, Oryza sativa
gacatatttctcttcagaagggtgtgaagctgtgagttcagtgactcactatgttggttgctgcgcatacccaacaagtatttcacatctgtataggtagcagcccacttctccctaagtcggtacatcagagcgatccattgtccatttcccgtgcctccattctccttaaaatcagcccaacgtctctcgaactcctcctcatccatactctcataaattaattttcttagctcatcgagttttggcttacgaaggtgacgactcatattctcctctatatgccaagtacacaatctatggtaagcacccggcattaccttactgatagcctttgccattgctaggtcgccatcggtaattaatgattttggatgcacttgacgtattgcctccaaaaaagtctcaaggagctaacagtaagagttgacagactcattggatagaattccgcacccaaaaattgttgtacttatatggtggttaactcctatgaaaggaatggaaggaagattgtacttgtttacccggtaagtgctatcgaaaataacaacaccaccaaaagcagcatagtctaaacgagattcaacatctgcccaaaacacattcctaagacgcccttcctcatctgtggtgtatttgaagaaaaattctggatcttcttcttgcttccttgttagatatttcaacacatcttcagcatcacgacccttgatattcttcatctcgtaccgagtaaagaaattataaaggtccttcatcacaaaactaacctcttccgactcatcgtggttattctccataacctccatgattgaaagggcgtaaggccactcatgcgaagctcgatcgcttgggctttcttagaatcagtcatcacacgatgaactcctaaaaaagcatcatggtcaggatttgcaagttcgagcgtatgttggttatcaaactccttaacaaaccacatccccttctgctcgttccgctcaatctcaagcttagctaagcaaccacagcgggtcagtgcccgtggctcccttttccactctgtcctctcaaagtgcttcaactccctgtactctttacatgagcatacgaattgcctccatataatctcaccgtccttccgcttcaagttgtttttcctcacactgaaacccttaccctttgcatagtctaaatagaatttgtaactttcctcctcgctttaaaaaaccacagtacccatcattttatactcttcctgatcctctaggctcacatagctcgaagtcattatgtcagacctcacctacggaaaagtaaaaaaaacaaacagaacaagcacccaaatataaccttacgtcctttatacctcataagaataaaaaaaaagaacaaccgtcgcctgcataaatacattgccaatccaaagaaaacacgggaaattcacattaggcaattcagttactgtaggactgcatataatatctgaggttcataacagggcagagtaaggatgctg

SEQ ID NO: 23113 - DNA, 553 bp, Oryza sativa
aatagtgtagtatataactattgtataaatgagctgttagattggctataaatgaattagagctagtagttagctatactattaaacttgctcttagtggtgaaatatcgcgtgggcccatgttttaatgacggatgaaaaattagcttattttttaattaaaaaagtaggtataggtataggtgtaggtatagattaagataagataagattaaaataagattttacattagctgattagcagggcttttgccttgatatttgtactgcccaatgacgacttgacgagcggggcaacggggaacatgggccagcgagtcggagtacgactcctgttcgcaaccccgaggggggcaccgacttctgggcttctggcgttcacgcggaatgctggaagtggaaaccgactcgggctcgtaccggtcatccttctctataaatctggggttcgtgccgcctcgtcgacaatcgcccatccaaatccagcgcaacgcaacgatcagacgagacgagaagagaagatagaccggcccttcatcagtcaaaagagtta

SEQ ID NO: 23114 - DNA, 309 bp, Oryza sativa
ggttcatgtcatcttcatttgacaggatttgtttcttattgattaaaactaaacaaatttcaatgttgcttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtga

SEQ ID NO: 23115 - DNA, 1501 bp, Oryza sativa
cagttcggccgggggcttagggtgaaatctcaagctctctctctctctgtatgtggaaagatcgtccgtcagcaagaaacacgagacaccggcgatctatacaggttcgggccgctgagaagcgtaataccctactcctgtgttttggtggatctgtgtatgaatgagctacaagtgtgagctgacttctcccccgttctaagctctcaatctggaaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagaccggtcacaaatcggtcattcttgtccaccgcgtgtaatcttggcaacgtgcatgtttgcccttcttcacacaacatcttgcttgtaatggttaggatgaagcctggcatatatcgatcggggctagcgtgtcatctctgggatgtaacacgctagctccagccggggacgagtgcctagaagctctcgtcttgacaggatggggcgaagcgtgcgtctgaccgcctgtcgccacctaacccgtgatctgaccggtctgtgactggtcacagaccggataaaggaacgcgccgtactgcgctgcatgcagcgtgacacgcctgaccagactgcattaaatgctgttaggtgagcacagctgtgctcacttatcccatatatgtggcgcagacttccttaagggggtcggggtgccccggccctcggggccggggcaagcgcaacccgaccccccctcggggggaatcaggaggagggcggacacctcaccctcgggcccgacgtccccgaaggtgccaggccccgtgggcgattgtgtctgcctcaagcctctagtcatgatattcccggtcccatatcaccgacagtagcccccggcgttatgccagagcaatttcccttcccaagggaagcggtcaggtgtgacgccactcctaaagcctggtgacaggtgggaccggtctccgtagttgggcaaaatacccaacggtctcaatccatgcacatcggtattgataactttggttgtccataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaa

SEQ ID NO: 23116 - DNA, 359 bp, Oryza sativa
tttcgtaaagttattgcaaaatttaaaattatatcattttaatatatttgaataatatattgagaaaacatatatattattattatatgagagaaaatataatgatactagccgcgcaagctgcgcaggccaccatactagttttttttaaatagtggacccacatgtaagtccatgtctcatattcttcatcacgtctccctctctctctttcctcttccttctcttcactcttcctcccatcacacttccaacaaacagtagagacagagagcccgagaggggtggaggtggcgatgaaccggagccaggagggcaccggtgactattcccctcttcctttcgtcctctctcctagg

SEQ ID NO: 23117 - DNA, 523 bp, Oryza sativa
ccagtttgcttcttttttgggccttagttttgctcggtttagtgttgtgatatgattggtgtgcgtcacgcgcatgcaggaaaaggggttcctggctcggaacggaattctgtgtagtagcggtggagccaaaaattttctaagcctagcgctcgagtagggctcaattaataggatattggttttctagaaaaatatgtaatggtttaaaaggatttaagcatatttatggaggtaagccgggctcaagtctaagctgccttagtcttgcctctgccctgctatgctgttgtgcagtaatatatatgtattaggtgcaagcgtttacaatcccaacaaaaatcagtctagtttacgcgaaaattggattttctggactaccacgatagcacaaagcactcgttttttctttagtcaagttaaaaaaaatcaaactaaaatttgattttttgacaaaaaaaaaacttcttcgatttccattggtttttattgatttaccaatatatttttttataacctaaga

SEQ ID NO: 23118 - DNA, 1501 bp, Oryza sativa
cagtcttgtcgacaacgacgtattcgatgtgagcaaaataatgggtgccgaatccctagaaacagtcttgacgacagggacatacccggaataaaagagaaaaatatgagcaaaaaggctcaagcaaagaaaaaaattgaaaaaaaaattctcttagttattttgtgctaaaggttatttgagaaagagtaataaatgcaataggtatgtgtgtttagtgtttattcttcaacctatgtgcttgttaagatgttgcattataaattgtatgaaatcatgaattttgattgttgattcaagattaattgtaaaatctttggttcatggttatactttaatgcatgcttgttatattatagatgggtttatcttctttttattgcaacacatgacttgatatactatatgtatgttaagctcttgaacattaatgaacataattcctatgcttgatgaaatcattgtcaaaagggggagaagtatgtgaaaatttttggatttttgggagaagcaaggtgaattttggtgagttgttgagaagagtatgtttttggttcaattgggaatttctttcttttcaaaagggggagaagttttcttttggatttttgagcacgatgtgtacgtttgtacgaagtgtgctttttaccacttttgtttttatttttccaaacaccaaaacatttttgataggtttgccaatgtgttcatcaagggggagattgtaaaatcaaaggtgtttttggttattattatgtgatgaacaattgggcatcggagattattggttttgttatttggaatttattcacgaagtggttttggagatgattggatttcacaggtgatcacaggattcattatttcatgtgaccggtcagaccgggctgtgtatgccggtcagaccggccgacactgtgtcagtttcggtttcgggttgtttgtttggatatccgtgattatttcatgattatgacttctagatgaatactatacgtatgtaatactgttgtttgctactaatgagtcaagttggagatagcttggtctcggaatatggtttctttgtttatttcgtgtgtaggtgaatcgatgcctcgggagagtatttgcggtgacggaccgggagtcggcttggggataagacgacgtccgtggtagtcagagatcatgcgggatacttaggctagagttgatgcacgtggttgatggagattccatatggcatacgatggagttattgtgtgcgtatgggatgcggagtcgaatttggaaggagtccaaatttggtacgattggttatgtaaagtttctttcttatactagagggtttcctaaggtgtttaggactcttagtatgagtttggttcgtggctttaggctacctacctcgggtataaatagagggggagcgtgaggcttcccggtattacttttaagagcaattgagttgagcttttgagttagagtttcgagtttagtcgaaatttttgtaaggagt

SEQ ID NO: 23119 - DNA, 1501 bp, Oryza sativa
gtacgccaggctgctccggctcgccgggtcgctgcggggcgtggagcgcggggacggcgggggtccgcggcacgcggagacggggtccgtcgtggcggacgcgcggcgcgtcgccgaccgggtggcggagttcgacgcgctggcggcgcggtacctcgccgcggggcagcgcgcgccgcccctgaaggcgacgtcgctgagctcgctgacgcgggtgtgcgacgtgctaggcgtgtcggcgcagctgaggaagagcgtgcgcctcgccatctgcccgcagctgacgcagcaccacatctggcgcggcgcgctggaggaggtgctccgcgacctgcgcgccgacatggccgcgctgggccacccatccccggcgacccagatggccgaccagatcgccgccgcctgcgtccacttcctctccgacaccgccgacgaggcgacctcgtcgtccccatcctggatgcgcccgacccctttcaacaaacctgcaaattcgccgccgccgccgccggcgaagacatggcaagaggtgctcgacatgttcaccgacctagccaagagcctggacgccgacgcgcggctcgccggccacgccgacaaggtcgccgcgatgaaggaggggctctaccagatacgcaacgtcttcgtcgagagggacatcgccttcaaggaggctcgccggcaagactgcctggtgcagaagaagctctccaagagcctaggccattcgtccaaatgcctctacaccttgctcctcttctacctctacggcaatgtccgggacgtcgaggtgcacgccggcaagcgcctctctggcaagggggggaagagggtcaccgtccacgccgccaagttcctgatcgacggcgatgaaccggcgatcaggaacgccgtcaagcagctgagccgcgccatcggcgtgttccggttcgtctgggaggcggctcatgctgacaatggcgatcatgccaatggcaatggcaagggcggtgccatggccaagaaaggccatggagatgatgcaaagggtttactgaagctgcaagggcatatctggggtttgggtgttgaagagaaggaagtgacttacagaggggatgtgttccatgttcatcagatacagcttccatgaattttcagttttgcaaacatctttgtaaaatcatatataacttctgaatattagtgagaattcttttttctataatagaattcaatccagcctctacagcaaatatgtatccagccagccaaagtgggaattcagaccaaaattgatcatattggagacaaaatctttgaaaaatcatcaagttctgaagatggatgggaattcgattttttatgatagaattcaatccagcctctacagcaaagatgtatccagccaaagtggtaattcagaccaaaatacatcatatcaaagatgcatctggacagtgggaattcatatcgggaccaaaattgatcatatgggaaaagacacaacaagaacaggtga

SEQ ID NO: 23120 - DNA, 1067 bp, Oryza sativa
cgggactaaagattgatttttagtcccggttatttgaatcgggactaaagatagcgatctttagtcccggattcgtagtcccggttgaaaaaccgggactacagggtggttacgaaccgggactaaaaagcatttctccaccagtgagagaatcatgctgggactgcaactgttggagccggagaagagaatcatggtgggattgcagctagagaggagaataatggtggtattgcagttggcgaagataatccagaagaaactttggctagaatttctctaggcatgtttggagggcatattaatgcatctggcagtgcaggtggaaaatactctcctcctttggaagagcttggcccattttgattttagaatgtttggaagaattgcactgaagtgtgaaccttgatgcactcatgcaagtgttgaatgcagcttctttgttcttggatagttttgtttcatattagctagctgcaagccctctattttggaacctgatggaggctatgacttcttatgtattgaatttctatgaaactatgactctattttccatgaatttggttacgtggcatgtgacttatcaaagtaatggttattcatggaaaatttgtgtgagcttgggttgatttggtttctcagattagtgatctacattacccatttaattatttcaaatttgagtggattgcctatttaatttaatattcagatattgcatataaacgaatatccctattaaactattataacattttgaagggaaataattgtgatatggcacaaataagaaatttatattaaacaaatagatccctacagttttagaaacctaggggaagttactttacatactggatacaatgccatgtcagccaagttccctaccatttcaaatcctagggatcctttttgttccctgcgcttttacaattgaaatcgtagggcacatctagttcccggcgaataatttcccatggaagttttccctacgaaaaggcctagggaacttgtttccctactagtttcagctcattccctactagaaaaaacaataggggaca

SEQ ID NO: 23121 - DNA, 294 bp, Oryza sativa
atcactccaacctctgcatccgtcctcacataaccttccggctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagca

SEQ ID NO: 23122 - DNA, 1283 bp, Oryza sativa
aggggaggggaggggcaaaagctagcgcgtcgctcatcatccgctacgcgcagcggggtccttttcgtgggcatcttggggtgatatttcggtgtgatagctgcagacatattcggctgagtcctgtagtgtggcattcgcccagcaaagtgcgatatgcggcgatttgtcgattttacgtgttgtttggatggatactaactttatcataactctatttatcataactatgataagccacacaaaatgtagtgaataaattattggttataactatagcaaactttggctagaaaataagagtatgacgtgtggaccaatgtgctagtaaagtgtggcttaactcaactaaacactaccctaagaaattatggtgtgcctaaggtttggtgttgtaaaccgctgtcactatccaaacagcccctaagacaaacgttgggtgctcgattagtatagacaaagacgattagtattgttaagtaggtaaatggcgaaataatataatagtaccacgtgcacgtatacagttgattattggtaagtaatgtcatgatcagtactgtatctttgacttacttagtcttctatactatacaaatcatggtcatagaaagctgctacccctttcgattagctatcttacagtacataggtagtgtacagttctatcgaaaggttcctatcttttgtttgtatgaaatttcatagccctagctaccttttctaccaaccgtcagaaaaaagaattcttaaatttaaatttaaaggaaattcaactttttctcatcgtcttttaaataccaccctatgaaggacttaattaggattttttttgccaatgagtcatacatgagctctcccatgacattttaggacgccacatcgtagggctgacgtgtcacctgaccgtgttgccttgccacctttgttcttttctccattggtggcgccattgccactgccatcctcttctccatgagtggtggcagaggagagggaggtggggagggagctacagcggcggctgacgacaagaacgaggttggcactagtatcagtggcttggacttgagcgacggccaagacaccattgtccatgctcgatctaggcatcgccgccagctttcaggcactagcttgagaaggcaacacccaggcaagctcacatccacatgcaaaggagctcgagcaagtaaagggtgaggtcgcgtgggcgatggatctgaagcaagtggcgacgacactacctcatgcaaccaacatcagaggaggagctcatggta

SEQ ID NO: 23123 - DNA, 1501 bp, Oryza sativa
ttgaaagttcaaggtgaatcatgtctggttttcgggttcggggggggggggggaattcggccgaccgcgatagttcgaggggggggtaattcgtactttttccactgcgttttgattggtaaatgaaatgctaaaaagtgagaaatacctttttgtctttcaaccccaccccactgtagcaagttgttctgtcaaagcgcgaatacatttcccaattgcacgatgacacaaccagccatgcgtcaccacggatcggggtaccttgtatgcctcgatgcaaaaccacttgctagcttaatttcagcgagaaacttgtgcagttcgtatatgcatagactttatgtaacatagaatggaaaatacgtcacgattgtgacgagcacaatacctctcaggtcattcacaatggagtataataccacataagctaagcacatggtttaaatgggctcttctcacactacaaagtggtttaaccgcctaagggtggcatcaatttttcatgccacccaaaacactttctattttagttctcatatctttcaattaggatatctttcaattaggatagaagccttacattaaacacaagctctctcttgcccttcactctcctctcctcggacctcacttgtccactcttcccttcccatgggccaactctccctccccggtgatgaggtccgccgcctcctctctactcttaggccattatgacgagctcgtggcgggtgtggatcaaaagcagcggttactgaacttgtcccatttcaaaatgatgtcatcgtctaaccctcttgaacggcttgggcctatgagctcctccatcgtctagatttgctcgtgcaccaccgccgagcccctccaacaatgcaaatcaacattgtgtagtcatggtgggcgtcaatcttcttttatcgatgttggatccaagccagccatgcccttctagatctggcgtagaagaagctcggcagggtggcatgtggatcaggggtgtgtctggccagcgatctcacccgccagtgatggcgacaataggggtcttcctggtatgttccttctagacctgtctctctggtcttcagatctacctcccattgtctagatgcctcaccaacaaataacgtgaagggggaggggagggctgcacgcgttgcacgagagacatgtctctcacggctggtgaccatggctccaccatcaagtgacctcaggcttgtcggggcacctgtaccctctacaacgtgtgaggagcccagtgagatcacaacctcagttgaggtggagttgcgaatccaatgtggtgagccggagctagtcctacgattaccatgagctcctcctctgatgttggttgcatgaggtagtgtcgtcgccacttgcttcagatccatcgcccacgcgacctcaccctttacttgctcgagctcctttgcatgtggatgtgagcttgcctgggtgttgccttctcaagctagtgcctgaaagctggcggcga

SEQ ID NO: 23124 - DNA, 303 bp, Oryza sativa
ctgaaaatgactctgtacaccacacttgcaattgctacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcat

SEQ ID NO: 23125 - DNA, 1501 bp, Oryza sativa
aatttgtatagtcgattgctcattagtctcgtatttgcagaaaaagaaaactgctgtgaagaagaaatcggcaccagcaccatatagacaagttccatcggtaaggttccttctataaaagtcttttaactttgatcatagccaatgttaattaacacttgtccttttcaggctcctcctccttctcctcctggtcagccgatatcaagtgatcgtactccatcggctgcaggtagccataatgttgaggaagaagaacaaccagccgctcctgctatcccagtaatcctttcattgtcataattcttagatcggttatatagctttaaatttaactgtcttcaattttctctcttgcaggtcttagccgatctgttttcctttgacatcaaggattactttgatgaagaggcagaagaagaaacaacaagtaagaccctagctcctccggatgaagatgtcaaaagaactcttgaagatatctctcatcggctagagtcatcattggacaacttggtagctgactgtggttcaattcgggcaagatttgcagagattcaagccttagtcccggatgacctggcgaatatcatctctccagctgtgtatctcgagcaacatcaattcaagctggaaaaggccaagcaaaggatagccgatcgacgggagcgaaaggatattgaagccaccattcaggccaatcggcaacttgtgcataaagagaaagctaagcttgatcagctctctattgggccaattcagtctaacatagatcagtttgaagcccgcaaaattgatctcatagcacaatttgaagaatgcaacgccgaactggatctggagaaacaaaaattagctaatctccccaacgctgttgaagaacagacgtccagactaagatcggccatcaagaaagtagccgacatgaccaaatccctcaaggtcattcctggaaccgatgctcaagacatccagcccattgaagaagtagagcaaattaggcaacaagctgtgtcggctatccaacgttacttgtctgggtgattatctttataataggacttataaaacttttgtaatcggctaagaaactttgatactccttttgattgtcctactgatcctttgtgccgattaacataacttttcaatttgctcgaaaattctcaaatttactcaaaaattctcaatttttttatacatgtgcctccctaattttgcaatgatgaaagcattgataaaattataatttgagactaacggtgatatattaactatcggccatcatacatcggcaagatacaaccgattatgataagattacataaatgactaagggcgatataaccatatcggccatcatatatcggcaaaactcagccgaatatgataaacaaaaactgctaagggcgatataactatatcggccatctgaaggcgatgttaaccacattggatgtacatgcattagcaaagcgcaaccgatcgtgaattaatccac

SEQ ID NO: 23126 - DNA, 1501 bp, Oryza sativa
actccaaagctgagtgcttcaatcatcttcgccatggtctccgaagtacttttaccaaatatgaagactgtggagggctgaaaaataaagtcaggtgcatcgactagatgcacctaataggtgtagcccccgactatgtgattagctgaacaaactaaacatatagtcaaggaataaattatccaattaaccgagtggtttttgataattatagtcaaccaagtgacttgataccaatatatagcatatgcggtgtgaatccccgaataatatgatccaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatacacacttacgtggcaaaaagcaatgatattgtatccaatcaattgcttgataaacccaaacagcaccttgactatataaaaaagccagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgggtgatatagaccatgtgatctgagtgattatctcttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattgaaggtataacacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcagcagtcagatcagccagcaatgaatatgaaggcgctcagcgataaagttgtgtagctatggcagcaaaataatcagtcggtgacagacgaggcagatcaaaggcgatgacgaaatccaccaatca

SEQ ID NO: 23127 - DNA, 1501 bp, Oryza sativa
tttatacttgggcggcaagtggtgtgcatatggtgttagttgcataccgatagggggagtgtttgcccaagtccataaggaccgaacttgtgtcacccatttaaagttattcgtacatccacatgtgctagtatgggatggcctaagctgagtaatctatttaggactagccttgcattctggtaggccggtgtgtatgagttcgtataattcagaggagcttcctatttaccccgacgtggtagtttaggtgactaagtgtgtccaatacaacggtattgtgccacgtggtgggttcctgtcgtgtccgccatcacggcgttaagtttaaggcgtgggcccgtcacttaacggttctaggtatattccaaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagttgtacaaactctgcagagttctttaaactaatcgattagccgtgctcacggtcatgagcgctttggtgatgtgtcatgtgtatagactatgttttaaaaatgtgatcatgtgacattggtttgaaatggataaatgtgttgagttgtgtgtgtggtgatacattatgacttattgttaagtatggcaataagagattgattatgatggaattatgaagaagttaataatgaaacttaaaacttgttttgttaattgaagcatcaacttctttacaaaagaattgcgaaacaaaacttgctttatgctgaacatgaactacatattgccttcctttgaatatatgccttacatgtagtatggtaggattgacttgtgcttgccagtacattaacttgtttaatgtactgactcttgctgttgatataaccttttgtttgcaggtttagacttagtctttgaatgatgcgggtcctgattgcttcttctaggatgagaacttaatggggtaaacccctagtcggtgtgcttgtgattgggtagtcaagcttccattgttctctaataagcctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacgcatctggtcgctgccttcgagtggtttgacgggcacatctcaggctgaagttgactggcaggctaagggcccagcaatgtctccaatattcctctctcgaggcgtcggatgtttcattatgcttgttggatgacttgaattattcacttcatctctcaaatataatggaagatccggagagcctac

SEQ ID NO: 23128 - DNA, 1501 bp, Oryza sativa
ccgagaaggattttgcccaaaggaaattctttctttgattctaaggcttcggctacgaattgccattggttgtagagcaacaactggatccacagaagaggaatttttccagccaaataagcaagaaagctacatgctctcgaggggtaacagacccttggcccatatatgccgccacatagccagaccagccacctatgcttttggtcttgaagttgaattggttcttggtgttcatgctcatagggttagccgatgaagttacatctaatccagtaatcatggtgatgtcaattaaagttggagtcatcggcccttggttgaataagaaagcattaatggtgttggactagaagtaggtggcggcagccatcagaggttcatccttagtagaattggctatggtgagagcgagtgcttggccgattccaatttcatcccagtgaactttcttactagccgatacgcgttggtactaggtggtccagctcttatcaggagtaggtttttcgagagatggccaagacttgaaggtattcttccagtgactcaggttagggttggctagtctaaaggggatccggttagtttcaccgatgatgaaatcagtggggtcgagattgccgattgggccaagaaaatagtggtttttgtgtgaaaggctgggaatcgcgactaggttggaaaggtgctgcaaatccaaaggaattgggaagtagaaaacaagaggagaaaaggagaaattgagttcatgcgaggaaaagggaactagctggtgaggacttacctcagcgtactcagccgatggcgcagtagaagggctggtggaagacgacatcgccgcgggcggagatttggttgggaacaaaatcgcccggggatcgtcttgtgcgtcggggagatcaccggagagagagagagagggcaaagttggtttcagtggcaaaaacggaggaggacggtgtgagatttctcgagggtaacggttagtatttaaagcacggcagtaacggtcggaaaacggcaaagtgtgaaacttgctcggagtcgatttacagcaaatctgaaactctatcgaatattccggacttcgggggcatgtgttaacaaccaaatttggtaatatcggcatcgggaaagaagattagatcgaagcaaagttggaggcagagatcgagttcggaaacagagcaggaatcggctggagtccagatcggctacgattaggatcggctgggtctgagtcgggctaggtaagccgatgcagtcgattccgacaatgcaacatgatgtatgacatcgggttgaattgaggtgcttcaaggtgattgccgcacatggatagagtcatgagaaggcaattgtatctattaattaggatgttttatgtaatttcattagagatatgcttgggcaaaagtctgccgcaaagacttatggtatcttagagtttgttagagatagtagtcgtgtccgttatggacatatcttgtaattctcg

SEQ ID NO: 23129 - DNA, 1501 bp, Oryza sativa
ttgcctaaccgatacaaagtcccagatttttcaaaattttcatggcaagacaatgttttgacttatgaacatattagtcgattcttggctcagtgtggtgaggcatcggctgttgacgctttgagggttagattgttcccattgtccttgtacggatcggtgttcacttggttttcttctttgccttacaactctgtcaatagttgggccgatttggagaaacaattacacagctatttttacagtggagttcatgagatgaagctatctgatttaacagcagtcaggcagaggcatgatgaaactgtacaagactatattcagaggttcagagagatgaggaatacgtgctacagtctggctttgactgattctcagttagccgatttagcttttcaaggtttgatagctcgaatcaaggagaaattttcatcccaagactttgagagcctatttcatctcgcacagaaggtgactatgcatgagcaaaggtttgcggaggctaagaagaatttcaagaagatcaatcatgtatatccttacatttatgactccgatgtggaggatgattccgaagtagcagcagccgggtgggttaggagcaaaaaggttgtgacatgcccattggtgaggagttctggaaaggaggaaagatttgactttgatatcaccaaggctgacaagatttttgatttgttgcttcgggagaaacagattcaacttcctgctagccatataatcccatcggccgaagaattaggcaaaaggaggtattgcaagtggcataattctggtttttattatactaatgattgcaaagtttttagacagcagatccaggtagccattgaaggggacaaaaatcaaatttgatgattcaaagaagccaatgaaggttgatggtaaccctttccctatcaatatggtgcatacttctgggaggacagccgatggaggaaggagccagaattctcaattgaattcggttaggattatcaacaagtatcagaagaagcatgataaacagcaggaaaggtttgatgaagaagttgatgatggttttgattctcattgggattgtgaattcttcagattttattggaatcaaggcatgaggttaccatcgattgaagattgccctgggtgcagtgatattgcaggagttcaagccgatcgtataacagaagctatcggccgagtcagaaaaggttgcctgttcatcagaggttgggcctgatcaatcaagaccgtcaccaggatgaagatgaggatggaaagacacagtggtgtccttctggtattttcacaaagaatcagaagagaagagttcaacggatgaggaacagggagcgtttttaggaggtacaacaagaaattaaccatcggctgaagaagacaaagaccaagcaagagtggcgtgttaagagcacggtcacaacagccgatgaagttgaagccgacaagaccaaaagattgctcaagggtaaggctactgcatctg

SEQ ID NO: 23130 - DNA, 1501 bp, Oryza sativa
taaaaaaaaacactcaactatcctataaaaatacaaacaccaacatttcacacgacgcaaataatataactataaaaccacaaaaccagttccttgcaaaactctatcatcatcgtcgtcgtcattatcatcgtcaccgtggatgagccgaagctgataggaggagtgaggatacacaagcaactgatgccacaccattggccacccccaaggcatggagcacaacactcccttttgacttctatttaaattaaattaatcaattaattacataaaacctcacccctacacaaaaaaaacattaacccaaaagaacccccaaaaaaattaaacctaaaaacacccaaacgaaaacgaaaaaaaaaaaaaacaccaacaccaccccctctctaatcaaccccgttccctaccccaacctccacccaaaccccaacccgcccccctcacacccacgtgggccccaccaacccctggccccacccgtcagcgagcggcagcgtacgccacccgcgtggccgtgcctttcccctaatcaaatccagcggatatttttgacgtccgcgtctcgccattttctcctccctctctctctctctctctcctccgtttttgtttttgttttctttttcttctttctctctcctcctcctcctcctctcttcctctccgcagaggagaaaaccaaatcccatcgcgaaggcgagagagagagagagagagaagaaaaaaagcgagaggagtaataaactcgcgaggttttattttattttattttattgtgtaaatttggcccacggcggcggcggcggagttggcggcggcggcggggctaaaccctagccgaagtggcggtgccggtggtgggcggcggcagcggcgatttggcgggtggacgagctccggatcgccggattcgtggcggggaggtgagtgcgtggagtttgtggcggtgtgcttgtgttgttgttgttggtggtggtggtggtgaggtgtgaggtgaggtggggtggcttgctgctgttgctgttgctgctgctgctgctgcttctggtgctaaattttgcgcgggtttgcggggttgggaggcgagggatgcgatctggggggtgttcggggagctcggcgttgcttaattccgctgatggtttctgcgcgtgtttcttcgttttcggggtggattcggtggtggttttgttgcgctcggtgttgttgttgcgggagggggaggttgggtttggtgctcgctggtgctggttttcggttggctttttgggcgatggagtttgacacagtagatttgttctggtaatggtggtgtagatcccgtggttgtgttctgaggttgcaatctgtggtttgttttcagggggatgaccgcttgttcttgctcaattccggtggatcttacggtggaaggatggcgagctgagtgaaggcgcgcgtgatcttgcagcggtttgtgcgggggaggtttggagcactttgtcattgccggcaagga

SEQ ID NO: 23131 - DNA, 972 bp, Oryza sativa
catggctccaactcagatcggctgtctcccaatctgcttggcaccccggcatgatttggatatgacctgcggccaactgctccatgtccattaaatccttccttcctttctacttcttctccctagtagaggtggtgcaaatcggtgcgtctaaaatatatgaaattcaaaggaaacaatcatctttcatgtaaaagaatataattgggatataatttttttcaccgtgagtttgtgatgatttgctcgagaacgatatcatttctacatcaacgattcttggtccgtgatatattttttttcatatttaccaagtcaactaatgatttatttagtgacaactataatatggtagtgatagattctttttttttaattttttttaatctttggctaaaataaaaaatattaccacttctacataaatgatgctcggtcaagaaattttgccaccgttctcatccctatttgattggcttgcactcactagaacccatgaaaaatttgtggtggctgtgtccagccagggtcaatgctaagtcaatttggaaatctggaatggaatggaatgcatgagcaagagcatgaggcttttccgccttgagtaaattttgccaaagcccacattttattaatgatgtttaactttggatcaccttttaatcattgttttcattttggatcgtataaacttatttttgctttactttaaaccacccaactctcttatcaaactataaacgatctcgagtacctctgtgttcttactcgtcaatgaactctagcagctatatgtaagactatttctttgacatatgacaagttgaatgtatatagataaaatagttgaggaccggtggtttaaagtgccataaaggtataaatatccagtccaaaataaaaacattggttaatccaaagtaaaaaaaatcagtaataaaatatgatccaaagtgaaatttactctctagc

SEQ ID NO: 23132 - DNA, 1192 bp, Oryza sativa
tgaatttttcccaaaaatgtaagctgattcatcattcatccaccatatccatggtgtgcaagaatgcaaagcgcagggatgtcccaatctgtgacatgtgcaggcactagcacatcaaacgcaagcttatccaacttaaaaaaaatggacactaactcataatatttttattgagttcttaaaaaaactcataatatcgcaacgaaacccggacgctttacatgtgcatcacgttggaccgccgtgatcttagaaacagggccaaagttcttctgtacagtactaccggtctactccacggtgtcactgtcaccccagaaacctagtaaaagggaagaactgccttgttttagtttagtgctattctaactttgtcatttttgtattaaaaaaattgtcatttttagtagctatagaaagaatttggttattgccagaacttttggcaaaaaaaaaaaaaagattagcccttcgtttcgttactaccaaagctatacgttatagaatcaaataagtcaaataattagcaatgccaatgtcttagctaaccaagcagacggctaatatttggaaattatctatgaatttacctagtttcatcgtccaaaaataacttcgtagcaatacaaagataaaataataagaatgttttctactttgttcataggggtgagggtacgttcgttgtgagtgtctacgttgtactgtgtaattaatacaaagataaaataataagaatgttttctactttgtttataggggtgagggtacgttcgtgtgagtgtctacgttgtactgtgtaattttttttaaaaatatactatattaaaattacaattgatcccactgtatcgagtttaatttatccttcatttttactaacttttttttcttgtcatgtaacaaattttacctgcagtatgtcggaagtcaatcgtcgattcgtcgacacggcccagaaaaagggcccagcccacacggggtagcccgaccggcacgtgtcggcggcaggtgcgtcgaccacctcccagccggtttcccgtccaggttcttccccccgtcgtccgtgctccatgctccaagccgcatccgcgtctctcgtcacgcccacaccaccacccaccaaccctccccttccgtcttcatcaatagtagtacgcctcccctaaaaacaaaacaaagagaagtccac

SEQ ID NO: 23133 - DNA, 1501 bp, Oryza sativa
gaagttttgacttccttgattatcaaatttttagggcacaagcacagacaggaatggcaattgtgagtcaggttgagttctgaatactaatgttactatctgccaattttgcagcttattgatgcaagaacatcaaccttcaagtcagcacttcaactttcaactaccctagactatcttttcagcggggtaagtttctttcctccaaatggcgcggtctttttaatcactgcagtaactcaaaacttttccaggtttctgacggtgaaactgatgaggaggacgctgttccaccgataatatacgaggacaaggacacagacgatgaagaatctgaagttgatgctatggaaactgacgaggagagccaagagctgggagacgttactgatgcctctgagcattcagatgggagtgatatcatgaccgactgatttacttgcgctcttctttaatttagttcatgatcagcctgacaaggtaggagctcgcgaagttggacaaatcatggttgctcctgttgtagtgctgtgcctggaattagttgttgctcttcacttggtagaagctccgattcgctcccaatatgattgccttagtgttaggatcagatcttgatgtaagtcaagccagcttgtatcaatagcataacatataactttaacctcctcgtcaaattttgtatctggcgagtgcataactgcatattactgcaagctgtttcagctttgtttttctatgaggagttaacgtctcagttgagaaaaatggcgagtgcagtttatggaagaaatgataggcttgtctaataattgttggttgttagaacttagaaggctatgtttggtacttcctcgtttcacaatgtaagtcattctaacatttctcacatatatattgatattatgtctagattcattaacattaatatgaatgtgggaaatgctaaaataaatacattgtgaaacgaagggagtatttatttagttcgtttcttgctaatttacacatgaactacaattgtttgcctgtaagcaccttaagccttccgcccttccgtatcctccgagcgcttcgtgtagctgactttcagtaaatttcaattgtcatatactcgtctcaatcttagaacagttttgagtgtgactagtttttaaaccatgacacctttattaaccaaaccagacggacggaaaaacagattgattaaatcagaaataatagtattaagattaatcaaatcagaaatgatagtattaacgaggcgcacagagaaaaagagagatgaaatcaaagagagaaaaatcaaattgacacgagcaagaaaaccgcacaagttagtagtaccatttcgctaacaaccttttggagtagatcccaatcccatccacatcccctttgctcgactacaaagtcacaccgctttgcattttcctctctctctccgcccttcgcctcctccaccgagtcagatctcgagcgccgcagaggagagcagcaa

SEQ ID NO: 23134 - DNA, 195 bp, Oryza sativa
tgccatcagttgaggttgtccctgcttcccgcagctcccctccatcaaatccctaaactttccacccaaaaatcactctcgatctgtacccctaaatcctctcttcaccatccccatatcccctcccatccactaagcgtataggcaaaatccaaatcaacaactagtagcaggtttcttgtgcaatcccttagg

SEQ ID NO: 23135 - DNA, 766 bp, Oryza sativa
  unsure (1)..(766): unsure at all n locations
gtggcnnttttgtanccttgcttggtaccccaagcaataaatcctttttaaattaaaatttaaatgatgaaattcgcaaatattcacttaaagagcatataaacttcaaatgttcataacttggccatttgaactcggaattggaccgttcaagtctctaatttttccttaagaagtcaagaacccatttttgtgttttgttcctgcttgttatatggagttttttagagtaaaagcctttttcctttccgctggtcgtgtagacgctggagcttcggaagatccgctctacgtggaggttgaagctgacgtttgggaaagcgagcaaggcaagtcacatcatccttgaacatattgaatcccagtttataaaattattttgatttaaattattgcattaccgctttacttaaattcccgcgttatcattgttttatttagccatgcctatttacctttgttatgaccttattattattggtattggtattattaccttgttcaccctagaataaacaaaaccccaactagtgggtactctagtgtgaacttaggtagatgcttcgctggttaattaggcaacattaggtggttttacaactctagactttgggaatattcatatcacctggacactatggaatgattggattattgtggaattggattcacacctccccctctattcaaaaccctcaaaatggttttatgctgggctcggggtgcatggttttgatagtagcacctcggccatataaggaccggt

SEQ ID NO: 23136 - DNA, 456 bp, Oryza sativa
gtgattgctacaacttggaatcactacaaagcagacaaggactcaaatgggagaagcaaagctgatgtggttgaagaaggtttttgggtattattatatttcttctctatttgttactcctactatcttctcattactgttttaaacatatgcagacaatttcgttttaaaataatatgtagacagcagacttgtcataaaaaaaatgtcctgcaggatagtatatcgtttatggctgtataggttcctctttcaaagtttctgcatttttgtatgcatgcaagatttagctaaaacatgttctaaggtttggtgcttctatatttgtcttgtttcagctaaggttcaaacatcaaccaagccaagatcaggcgcgtgctgcaaaagtgcatgttcgtaagtgttgcggtgtgttgttgggatggcttaagtattatgctcgaattcaagccataa

SEQ ID NO: 23137 - DNA, 578 bp, Oryza sativa
ttagggtttgcagtaaacagcattaaaaggcacttagttgctcaagctattttgtaaatacgatcctagagctatacaatattattatcaaaggccgtgaacccacacgaacctgtcttaacccaaggcctacgatgattcagaccgaactggcaacccgaccctgggtcccagctcgtcccaagccaacccaggccaaccattccacattttagttgttaagcaagttttaagaatttaaaacactaacttgggtacattgctcggcttgcccataactgagggcgcggctattcgaatagattatactctgatcagaggtgtacatctttacccacaagacatgtcttcctcacgtgtaaccacgtgccacataccaccacggcatacggacggaagacatgacatagtttccaacccatcctagccatagacaagagtaccgacccaaccccacctacggccggaacctccgggacaggtaggcaggactgagcccctagcagcaggacaccagccctgtgccatgacatatcgactaccgggccgcagctcgtgtagccttcattttccctaga

SEQ ID NO: 23138 - DNA, 273 bp, Oryza sativa
ggtggagcatataagtcatactcataggtctttagtaagcttcctagaagattcacccaaaatctccatagactgcgaccaacagtcaagcctacaatggtgagttctttcaagaatgctctgcaggacagcatcttcgttaattaaagccaacagaactcattaaggcatagccaacctgccttgcagctcacgacagtacatgcatcttcacttagagagggtataaattggtactctcctctagtttactaatggtttgttcttcccaga

SEQ ID NO: 23139 - DNA, 572 bp, Oryza sativa
tgttgagttgaaggctgtggacctcttctgagatctttgcataagtaaggcaaggggttaatcgagacccggctctttggagcacctcaacggagagtaggatctgtgtgatccgaacttcgggaaaaaatcttctttgtctctcttgtgcatgttctttgtttgaatctgctgatattctgtgatcttcatcttgtgcatctgtgcgcctgatctttctacctaggacccgtttttcttctcagatttcaatttatccctgctgtccggaagttactggctcaagaactccggaagttctaggctactcatcctgcccggaagttccggtgttcatcaccaggaggttccgggccctgtcaatttaaccgctgcgattgttgagaaaatttcaggaaagcctattcacccccccctctaggctacatctctgcacgttcaattggtatcagagcctagtgctcttgattcaagcttcaccgctttgaagatgaagacttagggggaaagaacggggaaaatagaaatgaagatgaagcaagcagcaagggaactccaccacacaagggagc

SEQ ID NO: 23140 - DNA, 1501 bp, Oryza sativa
ggaaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaaacgtagtataaatgctaagcgctcatgatacgtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactggtagttgtgctttttatattatctaatatttgaagtgttttcgttatttcgatttctttaaacaatatcccgtacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctata

SEQ ID NO: 23141 - DNA, 1501 bp, Oryza sativa
ccatcccatgacccaaacttttgtgggtcatcgcaaaccttgtattcaccatatccacatcttgcagttccagatacaccatacggtcctcctccaccacaacaagctgtcaaaggatctttgattcctgaaccgaggttagggaaatgttaaacaagctatactcagaagaaaaaaatgatctttttcttgataatatgcgctttcctccatattaaggcttctagacagtttttctagtgtaaccgactagttagttcagtcttaaactcggtacaagtgatgtcatgttaatttgtaatacacataatgtatctataccatggtaagaatgcaataatttgtaatacacataatatatctataccatgataagaatgcagatatctgaacagaggtctggcgtgggggtgcattacgtgacatgatgaaaataaacttctgaaccttacaaacatatgaaggatacagacagatttgcttcgtttgagaagcactaaggtaatcaaatttaagagaacacatatagagtatttttcttgtaacctaaaaactaaaattagtagtgttaagctttcgaaaagaaatcatagtagaaacagtaatgaattaactgaactcaccaaattgttcaggggaaaggaaaacttccatggcagctccatagtaatcagcatagatgatggccacatcaggatgaagcttgcgtaacttttccaattcatctataagaagtttgttgtggtattgcgagaactcgttcatccacctgaggcaacctgtctctggctcataatcttccttcttaccactcttgaatatcatgaggtaatttggaacacatccaatggggaggttaccaggaacaaccagcgtcttggctccaagcccaatcaattcctgcaaactcaacgctgttgcattacaagccatgtaattttgtattgcttcttgatacagggtctcaaggtacacagaaaagatgtaacataggcacgttactcacggtgattgtagaagaaattttggcaatgacactcggagtgaagctgcgaatctttgtaatggacaccccgctgagaagaggtaggttgtaatcattgcccccaatttctccgaccaggaaaagagattgattcatcatgcctgtgcaacctgtgcaataactagtgtttagaatcagtatgtaaatatgatattatagctgaaaatggaattttaagcatatcacaattgcttatttattatatcatagttaaacatttaaaggatcacaggaagcttactacttgtcatttctactaaaaaccagatttgtagcagcatgatcttccccttggcgtattaattgatttctgatttatgttgtatgccatcaattcaagggcaaagttcatatgtagcagtgacatggtgtccatttataaaatattttttataatttttaatttcaactaatgatgatgtattctttggaaaacaatgtgttatggattcgcgg

SEQ ID NO: 23142 - DNA, 1501 bp, Oryza sativa
caactgcaacagacaaagaaagttgtgaaaagaaaatgtaccttggaggcaaagaatggcagctctgttacagttgattgcacaaaagagcattcaacaacgtccggcactccattcagaccctttaagcaagcatttgcgaaaacagcaccagcatacctgtcccccaatagaatcaaatgagtaaggataaaagcactaccattagccataaaagcactaattcctcactctgcacagctgttatgtttattttaacttacgccatggacaaggttgcagagccctttccagcctttgcttcaacaacttcagtcccaccatcctgtgttctcttggtaagagccttgatgtcttcatcagacaacgcattagttgcaggagttgcctacccaaataaagagttccttcagttggattgttaagttatgagctcataaaagcatcatctgcttcatatttttgaacagccaaaataacacagttatatcttatatattggtcatgtttgtgttcttatttgtaatccaaaaaatgattgtacacttcatattagactatgttagcgatgattctataaagataaaagattcctatacagaaactatgtcaaccttgagcgagaaaatataacaaacttggttattaacttttttatcataataaacatgtgcagtttactacaagaataagagaacacatgaacagtaattcttaagttagcatgttttaaccatagcatgcatgatatgattatggtgccataacaaaaaatatatatattgtaggcatactccctccgtcccaaaataaaccaacctcgtactaggatgtgacatgtcctacgaggtttggttatttcgggacggagggagtaccaatctgataatcttatttttatgatatgtaaatatggatcctactggtatgacattctgagttatgttaatcaaaagtcaaaatccatacctgtgagaacagtggcaggatggtgatacccgcatgaccaccaacaactgggacattcacatctgccaaaaagggagaaacaaatccaacagaagataagagagaaaaaacaccaaaaccctactatatcaattctcagtactcaagtgactctcaggtcattaccagtaactggtacattggcctttccagcatagaaagtcttagcacgaacaacatcaagagtagtcacaccaaacaacttcttctcatcgtaagtcccagccttcttgaaaacctcggcagcaattgggaccgttgaattcactgggttgctgatcatgttgacaagagcctaatatacatgaacgaatttaatgaacgtgttggtaattaagcatgtaataccaatgaacatgcatgagtttcaaagatacgaagactgaaaacaaaattgatagaacttatcaaagataagcagataacaagaagcaataagtcagggtaaacaatgatattcttctgatttgtccaggttaataaatgacccgtg

SEQ ID NO: 23143 - DNA, 209 bp, Oryza sativa
ttgtgtggggcacggttatgccggtgtgtggtgtaactgtgtcggagcctgtctttattttattcgcctaagcaacttgaactttaatgaacccatttaatagcagtaataaattcaagaattatggtagtcgtgggtggttagctttaattgtcagctctctctgtttgctggttctgtgtggggttttcagatggtgatgaccagga

SEQ ID NO: 23144 - DNA, 504 bp, Oryza sativa
caggtgcagctcgttaataatcaggggccgttaatcgcctctctaagctactatagccccccttagcttgccgatcacacgctggcacaggtgatacgtacgcgaaggcggcacaagcaggagtgatatgactgcttctactgtgtgctgccaacgccgatgacttgagttgtatcatcagcgcctagccatacatatacagcagagtcaatcgccagtcgtcaacgatttcttgttaagttaaacccaggccaatcatgtttcgattatgatctaacataatccggcggcgtcgtccacagttttctcgttggtctgaagctaggagtagactgcacatgtactgacaaccgttactctccttggctactgtaccaggactcaaacatgccgtgtcctgctgccatctgctttctcggctttcgtgtgtacgcaggtatctctgtcgtgtgtttaacgtatagcgggttggtttctctcttttttttttcttttttttctagg

SEQ ID NO: 23145 - DNA, 1501 bp, Oryza sativa
gccgtcctcgtcgtcaaggccatccttgctgaggcgttgcgttgctttaacttcttccccaagacgctgaccaaagacactgcagagggtacaactccaacgctgggatgccaatgacgatgtcctttgctgaaattttgtgatttagacaaacctattttgaatttgtgatggtggaattgcatagtgaattatgttaattagaggatatttggatctacattcttttatgccagaaattgcttttgcatttgggccacttaactgttccgcctgtgaaaaatcatatttttcacatacggggcttttagggtggtagcttgcaaaattcaattttcacagacgggtgaaggttctccttgtccgctttgcaggtgttgaaagacattaagtgccgatttccaattaccttaacaaataaaaggagaactaacttttcttatacgtattttaattacaaataatttagttccacttgttttggagaaatactatggatgtagggattatacaataaaagtgaaagagaaataaatcggcatgcaaaggaacacacctccagcgaatcatgtgagagcacacggattaaagggcacacaagtcagacatctgcaatgcaccaccttaggggcccacatggcaacctctagagaaaggcggtggagagaggtggagcccaggggtgactgaaccctggtttggttgaaccgccatcgctgcctctcatctccaccttccatgtggacatcactaattacctcctaatgacagttgtgggagttatcgacctaatcaactgtcataagtaggctataaaaaggagatcacctcttcagttcacaacacacacttaagaagcaacctgtctattctacatttgtattactctctagtttagtggagtttaggcttagaatagttcttcggtttcctagacttctcgaagatttgggtatgtctttagtattatactcctattcctattgtaagactatgaactcaataatagaattatcttttttatttaattgtgttcgtatttcatatactgctttatcatatatatggtcagtagtttatacctctttcataaactatgcacgtttaggctagttgatatatgctatggcgtcggtccaatgatcttagtggattgcactagttctaacttttgtccattcaaaaagtgagagtcccagaggaattagtgacattatttagcaatgtaagcatggtgcgtagattgattaaatgccatgcaccacagaaagtaaggtaggcgagaggtggtggtgacaaccatgttaatttgtcctttgtattccacacatttgggtatgacataagagttcataaagtggtataaccacgctggccgaccaatatggagtggtctcttggtagtgcctagatacatagaaccatagctatctcctttgtctctcttcactagatagtagatttattgagatgattcttctgtgtatcacactacccaatt

SEQ ID NO: 23146 - DNA, 307 bp, Oryza sativa
ggctcgggttttctggtggaagtcctgtgtctaagcgcgtgatggtaaatgggaaagaatgcttgatgtttgtgagagaaggtaaagcaccacaagaaagtgaggtgactagtcttgtgaactgccagggacccggaacatccggacagaccgggagaaacctccgggtgggaatctctgtctctcaaaaattcccactaggaagttccggccgttttgccaggaagttccgggccaatggccatgcacaagacatgaccggaagttccgggcacaaagccaggaggttccggccagagggtcttta

SEQ ID NO: 23147 - DNA, 168 bp, Oryza sativa
gactcggcgttccgatcgatcgatccgtcgatcggctaagcgagtagtaccagcaccagtgagtcccgtgcgttgttcaaagttgcaggtgcatgcgtgcgtgcgtgtgtgcgcgaaaaaaaattaaaaccgggtggcgtttgtggtgtgtggcttggcaaggcggaa

SEQ ID NO: 23148 - DNA, 1501 bp, Oryza sativa
tgggcgtggtcggcctcgccgagaactaccacgcgtgcgtcggagggggcggctccgtgcttgaggtgtcgtaccacggcatggccgtcgccatgggccgcgtgccgcggttctgcgtccacgggaagcgggcgggcggcgagcgggccgacggcgtggccagcgcggaggcgacgtcggtgcgcgaggagctgcgcggcctgatccggagcgagcggcagatcgtgggggcggccgagttcagcgtggaaggggagatcaagggcttcggctatctccgctgcaaggcgctctggttccgggatgacaagcggaggagcccgatccctctgtgccaagtcgaagcctaaagtgtgtggcacgggctttttgtttttttgttttccttcgtatagcacgaatcttgaggctattggatggtccaaaaatcgacgaatcttgaggctactggatgatccaagaatcgacatgtttttccctaataacatgtcatcacttttttagcagcttccttttgtttttttttcttcgtgtagcacgaatcttaaggctattggatggtccaaaaatcgacatgtttttttcctagtgatatgtcgccacttttttctagcaacttcctttttctttttattaagtggtgataatcggggcacatgtgaatgatttagtgtttgggtacatcgaaacaaataaaactgattgtgggttagattttttttcccaactcagttttcaccgttgttatatcgtaaaatatcaggttgtaaagacatagagtcaaacaatcttactagatctgaatctaatttgagaaatatccataaacgacttaaaaaaactgtaaaacctcaaaatcttaaaaaaaaacttccaaatatatattttagataacttccaaccttgatagaaaaatgcttaagaaactgcttgatgacgtagtagcatccgatcccactatcaccgatgaattgagcggtgaagcagagcatgctgccgtatccacgtgactagattgcaggaagggaaggatacgttatatccacaaggggaaaggagatagacgacctatgttgagtttggaggtggttcttatatcgaagtatatctcatcatcattaaatacaattctactatctccgtttcaggttataagactttctaacatcgtccatattgattcgtctcacaaattaacctatatccgtgtaattaggtttataattagtttatatttaatactccaaattagtgtaattagatttataattttaaaacgggagtttggaggtgcttcttatatcgaagtatatcttatcatcattaaattcaattctattaaatattttaaaacgagatttagaaaatactagaattttaggtaacttttggtgtatagtttcacacttttcacagctgggccctggcaccgttcgccacgagaaattggacattttgccactgtcaaaagagggtttcgctatagtgccattccgccaat

SEQ ID NO: 23149 - DNA, 1501 bp, Oryza sativa
cctcggcccaccacgcagccgaagttgtcggtcatggcctggatctcgccgtgcgagtactcccggagcagcccgtcgatgcgaaacgcggcgcgcagccgctccgcctgcacaaggggacgccccgcatcttctttcttctccggtggtagtggttccgccgcagtagccgccgccgccgccttgcggcggaggcgacgctcgatgcaggagagaagtgcttgataaggcttccagatgcagtacaccacgagagccacgatcgtgccgatcaaaatggcgacgccatggtcatttccagtggttgcttccacactcacgaccactacagtaactacagcaaggaatgttccggaaaccgtcttctccttccagcttgagaaggagcagaagtataagcaagcagtggcgacgtaggccactgattcaacagctaactttgccccgacgctatgacgagcaaagccaaaacggaccgcgaggaacaggataaccacagttgccgtgcgcagaaggaacttccctgtgttgcctcgcagacaggcacagcagcagcagcttcgtgcttgaggaggatcaacaactgagccggcctctacgtctggcataatgtctacgcaccacaggcaaaagcaaatgcagcaaagcttaagctattggaaacgaacgaaaaacagtagagtctgaaaaagaggacaggagcacgagaggtacttattggccttctagatatcgccatctccaaacagaatgatgtgatctagcaagagggacaagttgtggcctatagatgccgattttgaagtcaaatgagcagttgttggaaaagtagatgatttaacatacaaagaagcaggtgtcgttgtagactgagcgcgctggcatgaagtgagttatataggaccagttcgaatgagcatgcaatgatgcaaatatcaactagagttgacatctttccgcatcgcggcgatcagatcggtactagactacggccgtgtttagttcaccctcaactaccaccaaattttaacttttcatcacatcacatcgtatcacatccaaaactttcctacacacataaattttcaactttttttcaaacttctaatttttttcaggaactagtaccttccttcagttgtgtgggatagcggcatcggtgcgtgatggtggtgttatttttttcttttcctaactttaatctatcaggttatagtcttataattttttctactatattcaatgaaactttgcattaactaattaagtgtcggtttcttagaatatctttctcgttttcctttagcacacttttcaaacaattaaacggggtgttttgtgccaaaaaaatctcttagaaaatcaatatatatatatagttcaagtttataataattaatatttgactaatcatatattattttttgagggaacaagtaaggagctcctacaattcacggtttataaggaaaatcggatcaaaaaccttacgtcggcacgg

SEQ ID NO: 23150 - DNA, 1501 bp, Oryza sativa
tcgaatggcgaacagcggccgccgctcgccgcgccctccgtcttgacgacgcggagccggtggtagcagtaccagaggccttggtggcggaggaccgcccaccagcatctaggcgctgccgcgccgtcatgaccaaaatggccacgtcgtccagccaacgttgggctggagactccgggtcagggacgacgggcgggtgacgcaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctcacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcacaggcccccctttgccggttcgaccggggaccctgggtgagattctaagctcctagtctgtggaaggttcgcgagaatggaagaagcacaagacacgggcgatgtatacaggttcgggccgctgagaagcgtaataccctactcctgtgttctggtggatctgtgtatgaagaagctacaaagagctggagagtcagagagcttttactctagaaaccctctcctctggttctcaatccagcctccatcgttctggatcccttctctaagtgggcaaggtcctccttttatacctcaaggggataccacatgcaccatctctctcttttgtgtggggacttatcctatcttccccccaacttgacttgccttctcttcataaatggacggagatttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcacgttcgcccttcttcatgcgatatcttgcttgtaatggttaggatgaagcctggcatatatctgaccgggaccaacgtgccatctccaggaggtaacacgccggctccggctagggacgagtgcttagagactctcatcctgacgggatggggcgaggcgtgtgtcagaccgcctgtcgccacctaacccacgatctgatcggtctgtgactggtcacagaccggataaacgagcgcgctgcactgcgttacatgcggcgtgacgcgctcgtccaaaccgcaataaatgcggttaggtgagccctgctgcgctcacctaacccatacacgcggcgcaaaatct

SEQ ID NO: 23151 - DNA, 624 bp, Oryza sativa
cccctcccgcggcccgcgcccctctcctcccccttcctcagtcggcctcccctctcttctcttaagccgtcggcccatttcaccttcccctcgcgtaaagtctaaataaccccctgactcccctccccctttcgccgacaggtgggcccgaagaccccacttgtcagctcttccttctaccttcggcctccagagccgaagccgccatgccgcgcatatgccgccccacgtcgcccacgattccagcctctcccgcctgcgccctggcgcccaaaccacataaaatcgcccaaaccattcaacttgcaaaattcatctaaaattgagatttacatgtttgtttactttttatgtactgtttccttggtgtttattagagtttttcctcgttttgcgtgccaacatgtagtttccgtcgtttcggaagttcgcggtcgcgaggaaaagtgttcagaagatccaagtgaagaagcaacgcaggtcacacattccccttgagcgttttgatcctactttacaaatgttttaccgtttgcaaataaatatgcatgttttgctaattacatgggatgtgggtattacctatctgctcgcttgtgccatgtttacttgatatctgtcctt

SEQ ID NO: 23152 - DNA, 1501 bp, Oryza sativa
tcgactacgacgtggctgatcgactgatgagataataagagaatccccctccgcgcgcgcgttacgcgagtgtgcgctcctacaccgaggaggcaacgagacgcggatgtggtatgggtggtgggtcggtctatcgacgactcggtgtatacgatcgttgatagaaggtttgacaaatgcggggcagaggatgaatgaaagccagggggcgagcacgcaacgaacgcaacgcaacgcagcggtgcgtgtgggccgcagcacaactaccacccagatgctaacatgatgcatccgttgcttggatcgggccttcgcttcgggttggctgccttttgataacgacccggttgaatcgagcgaatccactaaaattatcgcaaatggagatggtggctccattattggacgaaatcaattttagacaagcgtccaaacacatatgtggtgtttaatacaaaccaaatcgtacatgaacaaaagaggaccgagtggagtgaaaaaaaaaatatggaatacgcaacgcaggacgtacgttgccagcggaaagtagacagtaatgcgtttgtctgaaaacggatcacattttacgtgcacacaacgaatgatggtggtatatatgtagattaatctagcaaattaaatttaatacagcatcacaaatagaaagttacacaagaattataaacaccgtaaaaagttcgaaatgtgccactaaatcctttgggcggttcacagttctaacggccagagacggggacttgagccggcgtagctcatgtgccccctgttgttggccatgccctgcgtacgtatgcgtgtacctcaccattgtgattaaagaaattatgtggtggttaacgaaaggcctctgaaattcaacgccatatatttatgtacaaggctcctttgcaacatgtagcaagttgacagtgtatagtattaattactcccgttaatcatcttgcagtacgactgtaccctgaggtgtacgtacagtacacttgtggctgacaatcataccaacggctattcgggcaactagaatgccaaaactggataggtgtgtgagcttgactgccatgttataagttgacatttcccgttagtgaaggtgacctgcataaaaaaaaagtgaaaaagatataggtaaaaaatgccgctatgtttcctcaggcctcatcagctaccatgcgcaggacacgcctgcatgggtcggacaactatagtcaacgacagatcaggattaatctagacatgagtagcactcattggacgtgtttcattttttttatcctctagttatccaattttgattggagtcaactgagtaattaaccaattagttttaggccaatcatacaaaaaaaagtaaccggaaatcaaggtcagtgtcatatattttagctcctcttataggattactccctccgtactcgcgaaggaagtcgcttagaacaatatttaagtcaaatcttgagaatataaatcataaataactctt

SEQ ID NO: 23153 - DNA, 262 bp, Oryza sativa
attggccgtgcgccttatggtagaatctggagatgtaaaccatttccattttcttaaaaaaaatgatctactatctattgtataacaatctgtgcataaattgtgagttaccagtccttaagtgagaagtgtgagatgtagtatgactagtatgagctaccataagcattagctgcaatattttgaggaggttggttttgccatcaggctattggtggcaaactggggatcttgatccttgcctggttgtttgccccctagg

SEQ ID NO: 23154 - DNA, 1501 bp, Oryza sativa
caaagtttggattttggttaaaattgaaaatgatgtgactgaaaagttgtgtttatatgacaggttgatgtgatgaaaggattgaagtttagatctaaactttggatctaaacacaaagcaaagttcggaggccgaatgcatgcatgttgcatgacatggtagcctggtcgagtattttggaggcgtgctactctagcggtggccatgagtgagttcaattctgctttttcatcttttacaaaaaagcaagtactgtagcagatcggtcggtgcttaagagcaatattgtcagagccatgtggtaccaagtgtgtacttggccctctctaaccgatgaaattatcgaggagagaaagctatactaggagcaggtcatgaaggattgacgtctccgatgtgacggcctttgcagaattgcagctagtaggaggaatctagccaccctatatcaaatggcgcctctcggtgacagatccaagcaaacaaaaactgttcgagcagctggggacgcgacgagcttctgtagtgtagagcaccgcacaaactgcgtgctcaatcgatcgatcgtcgcggcctgtcacgttacgggttccaaacctgcaacgacgagtattcggtggagaatcaccctacgatgtactactaacctgtctgggaacttaaaatcccaagaaagagctgattatctagcttctgaaaatatgaaaaaactaggttttctagaatctattttttaatttagtttctaaattctacaattacaacgtctcagaatttaaaataaaactagactatttaagagagtttttaatttttgaagaaactgcagcagttagaaactttttgaactgtccccgagtctactactatcgatacgcacgagctcgccgtcgtggcccaacacaacacgaagcggcttcatgccatccgggattccaggccgccaatagtgtgtctgctccattgctacggaggagtactacgatcgagcagaacaccatgatttttttttactactggaggggtactagctggcaatggcattgcactgcacaacgattgaccgatctctcggtgcttgcatgcagcaggggagcatcggacggacggcggccgtacgcgatcgacgacgatcagacggtgcgtgcgtgcgcgcacggccaccgcgcgcagtgccaggccccggtcccgcacgaatcgcgaggccgagaccgacgggcgacggcccccgccaccaccgcgcagactgccagtagccctatggtagaaacgccccaagtagaatagccacgacgacgagaacgagaaaagccagccatccaccgcctcgccaaccgcacgccaccctctgcgacacggtggcgacacacacgctctctcactgcgtcgtctcctctttctttcaccccgcaggcacccatgactcgtgcgaagctgaagctgagctgatccgcgcacgcacgcgtgctgctgctgcttgttgcttctccacttctcttc

SEQ ID NO: 23155 - DNA, 1501 bp, Oryza sativa
ggtgggtcgatcgagttgtaggggccgccggccgcagcatcacatgctcgcctgctgctttgctttcatctgctgcgcagaggtaaaggggttattagtgaacggacaagatctacaagttttcagtcatgccggcacggactttccatcgggcctggtccagtaaaaaaccaaaaaaccgcgggcctaaccgcctaagtcatgtatgcaatcgttgtgtgggctagaaccaaactcctgcgctttcgaagcccaataccaaccgaatagcagcgacgacgtaacgcggcccgtacgcatgcggtccgctctcacagtcacagcgtacgcgagcggagcacctcgcggcgcggcccaaaccaaccaagtgcacgttctgcctgcgtcgcgtctcctacacgttgccccagctgtagattggcggcccacacgcaaccggcggccgattcggtgtcacccgccagttcgccaccgaggaggcgtcacgagttgcaatgaacgatgcaatggatgttgacgttgcaggctcagaagatgcaacgagttttgaagttttccggtcgcgttgcagctgctccggctttgctgacgcttttcttttgctactcgcctgatgatagaaccttataggttgacaacaacgagagcgaaacaaggtgcattgttgtcggttgtccgcttccggttgtctacgacgaacaggcgctgaaccgtggtggattcatcaacacgactacagtaccatctcacttcccttacgcactgcacagtggactctgccggcgctctctcgcaaagctggactttgcaacagtcgcaaactcgagtacaaatctggacttcagctggtgcaccgctgccgctagatctgtgaatgcaagtctgcaaccacaacactttaaggccctagctatcggtctgaaacagagagacgctcattcaactataccctgttactattactatatgtctcaactctcaaacttgcgtaaacttatcaaggatgtgcccacaggtgaacaggccacagtctacagattcttgtctttgtccggttaacaggccccgtatcacaaacgggtcccggtggggacaccgccgcagccgtcgatgggagcggatgaacggctaaaatgcatcgtgatccggatctcggccgggaccgctgctgctgctgcgagagttgtagtaaaatccagcggtcaggagctcaagaagcgaaatacccgggcagcattcaattccgctgtacgcccgcttggcagcgccgctgctgcaccaccccgcatccatccgctgcggccacgagactcggtggcattgcttgctggctcgcgcgcagatctggtccggtacgacgcgtgcacggtggtgggggcgacgcgtctgcacggtcgcgcgggctcccccaccacgacgcgcgcccgcgcccctgcccgatcgagcgccgggacggggacggagacgcgattggctcgtacgcgcgcggggggcatgcgtg

SEQ ID NO: 23156 - DNA, 1501 bp, Oryza sativa
atgcatgcttcaaagaaaggctattgtttttttttgcgattgattttatttaaactcttttccgaaacaactaagggagtgcttctcaaatgacacggatgagacagtgcgtctcgtccggtcggagtatgtgcaatgtttcagtcttttgaattgatcaagattggcacccggccaacagctttcaaatggccacccgggcctggctgatcccatcagccgccgattttccaaacatcaagcccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacattccccggtccgcggttttagaaattcatttagttcgcaagcaccgacccaggtgtcgggttttccaagtcttttgtaaaacccaagttttacccaagatgtttctcagattttaagtttgaaggtgatcgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgccttgctcgagatcttgagcttgatcctcgaaatcctcgcactgcgggtcttcgggctccgaaactacacgcgaaatgggacaactcaacaaacggcgaaaataaagccctattaatgacctctaagcgtgccattagatagatctcgagatttgaggaattttggaagttgaacggagtcaaacagacttacggttgggaagatattgaatttctaagattattggatttttggtctaaaggaaaaaggatttatttaaatcctttttgaaaaagaaaagaaaagaaaagaaggagggaggaaaattagacttccacgggcggctagggcgcggcccgagagaatggggcggctcggccgagcttaatgggccggccggcccaagaaggcggcccaaggcg

SEQ ID NO: 23157 - DNA, 301 bp, Oryza sativa
gcaaactgaaaataaaaaaaataaatttctgcaaactgtccttctccccgatttatataactaacctgtatagatgatcaattatataagtacatgcatgtccgtccatatatactcccatttaccaacaagctccgagatgagatgacgacgacgtctcctgtacgcatatgtgctgtttgttgatgtgaaccggttggagggttttagatccgtcctccgatcaacgcgagaggcccgtggacacgtttacacgcgaccacccagtagtacgtacacatgtcgtgattaatttcgcaga

SEQ ID NO: 23158 - DNA, 1501 bp, Oryza sativa
tatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttattccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttcccttcgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgttaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtgttaggataaatgcgaagtaacatatatatatatatatatatatatatatatatatatatata

SEQ ID NO: 23159 - DNA, 1501 bp, Oryza sativa
ctcgtttgcaccggttttaatagttgaagaaccggttgtatctggttttgaagtttgaggacgaaaatcagatttggtgtaaaattaagggacctcggatgaacttattccaaggattaaataggcttaaggtccaatcgtcaaaatcctaatgtgggtaacaggataactagataatgcccatttgcctaaacataaccagaaaagaaatgtccattttgattcccttaagggtcaaatctagtttgtatccctcaactgtaatcttgatccaaactattaaaacaagcgtaaatgtctccctctatgtttttaggggtggtttttgctcacgtagctcgttgacctaatccaaccgacacagtcaacatgagtattttctttctttctttttttctcatcctctcggctcttgttctctccaaccaaaaaaaattattcaaaaggaagcaggcagggcagcacattgtgagggaatcaggcggcggcgcacagttctctcccttggcaccctcctttccctcatatgcaatggactcaaaagggcggctgcagcgtatgccggtggattaggtttcgagggtggatccagtgagagcaaaggtggtggggtgacccaaggacgctgcttcgctcaagtccacatgtgcttcgcctcaaggccaggatgccgccgccctactcgagactaggtagctgacttgagactaggccgttgtcgcgcgtcggggccgcccagccgctgctccaccttgggtcacgctgtcactctatctcaaggctgggccatcgccactatgcttgaagccgcactaccgtcccacctcaaggccggcaccctgtcactccacctcgaggctacctagacgttattttgttccgctgctacgccttagagacaccccactgccgctctaccttgggctatgccgtcgctctttctccaaggcgcgctgctacaactccgccctgagtctccatgtgcctgtgtggagaaaggagagggaagaaagaaagaaaggagaaagaagtgggaggaatcactaacatgtgagctctgtatattgatttggtcagttggattaggtcaacgagccatccaagagaaaacaacccttaaaatcattgagaaaatcatttttaactgttttaatagttaagagatgaagatatatttttttttatagaaagagatgaagatatccgatatccaatatgataggaatcagaaaacgtatatttttgagggagtcaatgcggacttattcccaccagaaactgcagcatattggacgcagtggttccttccgcggtagctgcgcccgcgcccacgggaatgcgattcccagcccattccacccccttcccattccggtgggccattccgaatccaaccaaccaaccaaccatcgaacccgcacccgcatcgtatccactcctctccagtctccccgccgctccgcatcccgcagccgctcgtcagcgacggacatggccgccg

SEQ ID NO: 23160 - DNA, 295 bp, Oryza sativa
actagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatca

SEQ ID NO: 23161 - DNA, 1501 bp, Oryza sativa
tttgtaataattaaaactcaattaatcacacattattaccatctcgttttacataaaacacttaatttttatcttcatctccatcttcagaagattccaacaccacctatatatcactagtttacaccaaagttcatcgttgatgtagttactagtgtactacagtaggcgttcgactaatccatccataagttaattgattgggggaatttttttttccaattgcaatcagcttattgttgaatagtcctacattggttgtggaagggcaaaggacctaagatataactgggggagcccctcacctcaatggctagcttttggggtgggaaaggccctttacgatcctacaattggtatcagagccttgttttcctctttggatttttatcgatctagagtttttgccatggctactcccgctaggttttcaactaagcctcatgttttcgatggaacagatttttctcattggtgtagtaggatgcaatcttatattatggctgaagattatgatatttggagaaaagtttctcatccttatgtgattcctgaagctattaatactgctgctgaaaaaactgcttttgaaaaaaattgcaaagctcccaatattcttttgagtggtatttcttgttcggattatgatcgtgttgctcatcttcgaactgctcatgagatttgaactgctttgagtaatttcatcaaggaacaaataattttaaagaaattcgtcgtgatcttttcaaaaaggagtatattaaatttgagatgaaacctggagaagttttggatgactatctttctcggtttaataaaattttgagtgatcttagatctgttgattcttcttatgatgctaattattcacaatatgagatttctcgccactttttgaatggtcttgacatgtctatttgggagatgaaagttatatctattcaggagtctgttaacatgtctactttgactttggattcactttatataaaattgaaaacacatgagatgaatgttctttttcgaaaagttgattctaagtcgagtgctttggtttcttcttcttcctctttggatgttgatgcttcttcatctaagtcttcttttcttgctgtttttaatgccacctccgatgatcaactcgaacaaatcgaggaggaggatttggctttggttgctaacagaatttctcgagttatgaataatgccaggaacaggaaaagaggtggtccaaatcgttgctttgaatgtggttcaattgatcattttcgtttgcattgtcctaagcttgggagaggcaaaagagaagacaaagatggtgagaagaccaacaacaacaagcccaacaacaacaagtcaaagggttcatcccaagggaggaagctggacaatctcagaaaggcttttcaacaagtttgcgccgtcttcgagccactaagtgatgtagatggtgaaagtggagatgatgataagggaaagaacatctccgatgtttgcttca

SEQ ID NO: 23162 - DNA, 1501 bp, Oryza sativa
gagtggatttgtcaaaagtgatttatctttttggttgatcctattggttctttgtttaaaggttttcacagatgaagttggatcatggtctttcagtgcaaattgtgtctaaaaaatgatgatgcatcggtggaaccgtggatccatgactagggcaggattatatcactttatggagccttgagtccactaaacatggcaccgattggttcacttcgtagcaaaagagaaatgtggcataaaaaaacgaccatgttgcaaacatgttattatggtcataaacttggcaataatcagcttgtacagattagtaattgcttgggaccaagatacaattcatcatggggaccaacatgaacattaattggcttgaacctgtttatatttgtgaacccatgatgcatattaggccattaaaacactttcacactaatcgatataatatgtgttatcaagcataaatttttgttggaaacacacatgctcgcaacgcgcgcactttctcttataaacgtccacacataccctacctctatgaacacctctgaaagactagatcaatatattttgagattgacgaagccaccacggatgtctcgctatcgatgaatacgacgcttaccactgcaagaataattagccataaatataagcactcatatcaagtccagaacttaaaatctagatggattggttccaccacaagtaacttaaccagttgagttatgctttctttgccatcaaaattataaagcaaggttagctacatgtattcttgtggtttaccatgatccatgaaatatgaatttaaaaacgaataaattttgatggagtactaatggaaaccacaacttaaattaataatgcattaacttttgaacacacatttgacgattcgttttatttaaaagttttacattattagtttttttgagttattttgtcctgaaagtactttaaggatattctttttatcttatgcatttgcataatttttttaaacaagatgatcaaacatatatctaaaagtcaacagtgttatttattttaaaaacgaagggagtatacaaacagaataaatgcataagttggaaaatcagtgccaataaaatttgcttttcatgtgcgtagtatcgtaggcgtctatgcgggcgtgtcttccatatgattaaacgaatttgttaccttatatatgttctgaagaaagatgagtaaaagcaaagccattgcctattacgtattaggcttcttattggcactactacagaaatatttttttttctgtacgaggcccatatttgattccaggcggaccgtaagtgacgccgcctgaaaaaactggtccaccggagccgggtcatcgctcgcatgggataatctacgcgtgatgatgcatgtaatatattgccccagcccgagcttgctccattcaagcccggcgtttacatttaaacctattaaaaattttcttacactagcacaaaacaagataaagctggaa

SEQ ID NO: 23163 - DNA, 1501 bp, Oryza sativa
tctcacctttctgccaataattaactagtggcttcaatgatccaccatggactggcccgccatatatatggagagattcccagaccacatttgggtgcagttctcgatcttactgacatactgatcgatcgatcgatcaggtgattttcagatagcttgtcaggtttctgatggaatgcttgagagttcagaaacattcctgcttgtttgtcaccatgcacacattagctagtagtctagtaacaaatgtgaggctactattttaccatacattcctgtctaccagagtacagacagtgagaacgtactatgcccatctggccatctagtcatcttggtggcttagctggaatttgtctgtggtttccggtgtccatggagttttgctgtccaagaatgtgtcaccctcttcctcctcttcttcaccaatctatgtggcttgggctagctggagagtgttctttcgcgccttttttggctgtggccgagaatgcagcgacggtgcgtggccatggctgcgtggcgcgagcgaatggtcgagtggacgtcggtggcagccgtctggtcctaccggcgtccggagcttgaggaggaggggggagcaaccgggccctttctgacagcaaccggttcaaaaaccaaatgcgaagaaacggttgctgtttatctgctactgcttctttctgacagaaatggagcagattccgggcttgaaatggccatcttttttacctgcatctctaccaacagtttctgagatgagataaagagccatcggtttcagaatccaggaagaggatcgatgtcgttggggtgcagcaacaattgcaatgtaatgtcactgtgtgtcagttcagataacttttgctcaaacagatgttgctctctctctctctcactcattctctgcatctcacattactagctagctagcttggttcttgaaatgaccagtgaactgttgtttgttttgtataaacgggtttgcattgcacgcaatcgttttcggcgtagagacgtggagggaaggatatgatggccgtcgtgatctgattcagttggtggagaaaagaaagaagccaaatctctgcatgagactatgagagtgtgggtatacttctgatgaacagggagttgttgctgtttgtcgacgcaatctacaggagtcgccattgaaaatctcacccttttcttgctcaattatgcagccaacaaataatttgtgtccggatcttgttccacaactgcatgatatatatgatgggctatagagctgacctcctaataaactgaagaacctatatatttaggcttcagtggagaatgtttttcttttctttttctggatgagacattcggtggagaatgtcgtgtgcagtagaaacagtttcaatggcctgaaacccaggcagtacaataatacgagccgaaaaggagttttgattcaccaggaaccacaattctgtgtgatggtaggtataatacagtttcagtgttgata

SEQ ID NO: 23164 - DNA, 769 bp, Oryza sativa
aaactgtgttgtccaaaacgacaagtaaaaaggaacaaaggtggtactaattacttcctctagccattctaaaatataaggattgtttctagttgtttagcagtagtttaatcacttcaattgtcaatttttgaattttgaattgtttagattacctttccaagtatccgactgggctttggaattcatgatgatgggaaccatatgagttattagtgtagtactccttccgcctcataatataagggattttagagggatacgatatttttctagtactacgaatctggacaggcctattcagactcgaagtgcttgaaaaatatcacatccctctaaaatctcttatattatgggatggagggagtaatgtttatattgtgttatgaatttgaatcaaagaaaccttatattttgaaacgaatggaatataaagctatgtcatttaactggctagtcaacaagtggattggtaactctagtccacaagcgttttgccttttacagaatccatgagtgacctgaggcttctaaatggtccaaatggaacgaggggagcattacaggtttaaaccacggtatctatggattccaattttttacgtattcagaaaagtaaatttcggttatttgtttggaccagaaccttttatgtggtgcaataatgggcaagtccaaaacagacgtggcttgggctaacgataacaggtgtgtgcccactcgtcacgtgtatgccatgcctgacacctccagcttatctacagggcga

SEQ ID NO: 23165 - DNA, 458 bp, Oryza sativa
tctcaagcggcaatatagttttatcagtgtaactaccccaagctttcaacaagcctatacccgatccgtcgtaaaaagccagcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccagg

SEQ ID NO: 23166 - DNA, 224 bp, Oryza sativa
tatgtatatatatatatgtatatatgtatatgtatatgtatatatgtatatgtatatgtatatatgtatatatgtatatacatatgtatatatatatatatatgtatgtatatgtgtatatatatatatatatatatatgatacctatatgggactctatggtgcccgggctccaaggtataaaacacacaaattctcttaaatttttaaaaattttcaaatta

SEQ ID NO: 23167 - DNA, 334 bp, Oryza sativa
actactataggcgaattcgagctcggtaccctttttaaatttttttaataactatttaaacattatgcacaaaacgagggaatgtctcctctagggacaaaaatccacttccggtatatcaccaccacccatcactctctacacctgtcgctagctcgatagtgctcacggtaacggccggaaactgcccctcgaatctcgatcagcttagcttagctataaattcagcaccatgcatgccattgcaacctgcgcctgagaacacagctagctcactctcaagctaagctaagctaggagattagacgaagaagaagacctctagctttttcca

SEQ ID NO: 23168 - DNA, 1501 bp, Oryza sativa
cgctcctctggggtagccggggtaggcgcatgttgtaccgagcgatgctggagccctggcccgcgccgtatctccagtggagccgtgtggagcggggctggccgagttggccggccatggcaagaaggaagagcagtggatcgatcgccgagacacgagcagcggacggccgcgatcgcgtcgcgtgcagcgtgctctgctttgccgcgatcggcatcggcttgcgtggccccccgtcccgtgctgccgcgtgaggcggcgaccgtgcgggccggcggggcactacgctgttgctgccgcgctgcggttgccggccggccggggtccgtgtagtggtggcagcatcggatgaccataggcacagtaggcgataggaccgcctccttttgccgcacaaaggcgggaaatcctctatcttcttctgataagttcggtaaaaaaaaaaacttctggccagtttactaccacttcgctagctctggaatctcgctggagaagagggaggaggagtttcaccgaagaggaaatagtagtgggcacgtgggaaaatctcgatagacaacggtggaaatgccactaggattagatttggaacttgggaattaaaacagagggaatgttgtgcattaatatgatatgaaatcatttacttcccgtgtatttttgtcaataatggtatctgtagagttcatttttttatctggtatttccttgcacaaaatggagtttataaattataaggggagccaggccaaggtatgccttctagacatagtatttccttgtttcattgtttgtattttaccaaagtacaagtatagtagtacgaatattatgtacaactctgaaggctgaacttgttgcaagcagggcttttctgcctacagagctactacgtgtatttttcttgttaaatctacacacatgacacacctacaaagcaacattctgttgtaactgaaaacccctatctgtccaaatgcaaaagcctgagcctgctgctgtgaatgacagcaggatggacagaaaaaaaaaaggaacccaagcaacaacacaaggaggaaaccagaacatgcagacaacacaagcaactggctcctctcctctcctcctaccgttcagttagcagagttaacaatgtgattagctgcgtactggaggactactactagcggacacaaagccccactaaagtattcattcgttcacaattcacaagccgtcaagcactgtgccattatccccaataagtagtactccaccacgccttctctcttcttcctctcctctcctctcctccgcttcacctccgtttctttcatcgtctatctctttctccccaacacagcgggcgaaccaaatccgtcgtctcgccggggtccgggaccacctcgtcgcatgcgcgctgggtcgtagacttggccgccggcgatcgccggagttggggagcgcggcggcggcggttccgctctcgccggagcgaggggtgggtggaggatgg

SEQ ID NO: 23169 - DNA, 164 bp, Oryza sativa
gaacagatctagtgaaaatcaccaagcatcaatcaaggacgcattttgtcgagcacctagctagcacaaagtatcattggcccaaaaacaaaaaaaaagaagaagaagaagaagaagaagaagaagaagaagaaaaaagctagtacaaagcacacctccctcga

SEQ ID NO: 23170 - DNA, 1161 bp, Oryza sativa
atgaagatattttttatgtaaaagttataaaacacgatgaaatctataactatttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttaagttcgaatctcacttgtagcatacaagttatattgtgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagtgacggtcaggtagttacgacacgtcactgatgactcatctgtaacgggtgacaagttttaacccgtcagagatgacttatataccggtcagagatgggttatctgtgacgggtgtttcatccatcacaggtgattttgtcatcagtgaccactaatcactgaccaagaccaaacccgtcaaaggtgagggtttgggtccgtcagagatgacctggtccggcgtagtgcgattcgatgggcatatacggttgacttgacttagcctataccgcttgtggatcgaacaatgggttactacacattattggagaagaagaaagttcaacggaattgaaacgacaggtgatcttacacacatacatagatgagccaaacaggcctggtgatcatcgacgtggcaattaatcgaggacagcttcaaggacgtcgagcaccggcgatgccagcccgcctgttgctaggttaatcgcgaccatgaagcttttcttgacgagaaacttggtgataccagagctgcagctccgccgaacgatggcaatgctctgagcatcactggtagttcggatggcagcgttgctggtgcaaggctctttttagttcccaaaacaaaaaattccatgctgtcacatcgaatgtttagacacatgcatggagtattaaatgtagaaaaaaaatcaattacgcaaattgtatataaattatgaggcggatcttttaagtctaattgtgtcataatttga

SEQ ID NO: 23171 - DNA, 1501 bp, Oryza sativa
cgggcggcgattagggtgcgggcgtgcggcgttggaggttgttgagggggagagaaacgctaaaaaaaaacagggtgtgcgaacgatggggatgcggatgcgggggcatgcaaacgacgggaaagacgatatgagccgttggatttagcgatcggatggctcatactccgcgtgtctgccagtgttggagtcaccgccaccactatagaattttaaaatagcagagatagagcacttgcccacaccctatacagtatgccactaacttttaacttgctgtttctggctttcattcggtgacggacggcatgatgcatgcatgtgacccttacttcgctaatgattttcaggcagttcttagatcagctttgcattccacttggttaatctgcaagactacaagagggtttaatctgcaggttaggtcttctacttgctagagggtaggagaaggctctgatttaatattacaagtttttagaggtggggtcttcctcagctcatttgacatcacgatgttccaattaaattggcattttcaccgcacaacgccggccacaggccgcaaatgctctccattgaataatcccaaactttgtgttgcgccgcgcagcgcgtgctttgctttgtcatcaaaattttctgaaatttatcaacttcccgtctcaatcgtcagagtatactactaatataacagccacaggacaataactctgtcttgttcgattggtcttccgctttttgttcttactttcggtaaacaaatgatttgtctccaaagatctggtatgggttaatctggcccttttcttggagtcggaggccatggtttctgactatcggggtggttttgcccctaatccggttattagttgtctcccatgtcttgcagtgtaaatgtttctcatctgaaaatcgggtgattgtttacaacaaccgtgatggtgagttctttattagtagtaattaattattagctgctgtctaggtagcccaagagcgacctgtgaatctatgattagttgttgtttgatggttaagctctgccaatggtagagttttcgtagaggagagggcagccgtctattaactatattcaataggagtacatctccttttagcactaaccttagtacagtacctcgaaagtaaaatcaaattttggatctaaaaatataataattagatcctgagataacgaaatccaagcaaatcaaatcaaactcaggtttgtaggcgtacttaaaggaagttgcaccggcctattccacatgagaacaatatctcggttgcacacaagggatgcgtgagttcttgccactcacgaaagcaattctttggaccccataaaacaagcatctttcaacatcttcacctaatctttggccataatctttcgttcgcttgttttgatttaaccgtatatgaataattattcttgtgcctcaaaaccatccacccaggtcggcataatctgttgatgtctcatcatttgttggtg

SEQ ID NO: 23172 - DNA, 1501 bp, Oryza sativa
agggtacaaatctgtcgacagattttttttttatggatatctttcgatttctggtccattgatttcgtgattagatccgtgctggttgccagagataaaaaaacacagcaaactgcaagatcggggattcgatcgtaggaccaactggtcgcacgcatcacgccttaaccaagtgagcagttattcaaatttgaactgaaataaaaattacacattagttaaacagtaattacatataacttacactgattacatttgaaagatttttctaaaaaatctgttgctagaattttagatagtccctaatatttatgactagagaaagtagctcatccattaaacgaccggacttgtttcaaaggtcgatcttatctccgaatgcttatacaatcctctagaattgaacttctgcacccctccatgcccccagaagatcaaaaagataaacaaaaatatagcttttggcaagggattatctttgaaatgctcaaatgcaaaagtccagggaagcagcttagggcacctccttatgagacacgattacacagtgcacggttgctggcttggttaaagcagcgatcactctatcccacttataaatatctctttagctcttttttaaacctctttgatggcttatatcttttaaatcatatattatttaaagatctatttgcactattatactccactaaaaatatgtgacaaaatgagatcaatgttgaatatatttaaatattttattaattaaaagtaatttatttaaactgtagaagtaacttagctatgcaatagaagtaactctctatagcattagcattagaagtaattacattatgtctgagttgatgtaagaaactatgtagagtaaattcacaagtaaagtgtagggaatattttcaagtaaatacatacattatttaaagtaattattgtattattttttaaaaaaaaacaaatcttgtgtcatatagaaagtaactcttcatgatattaaaagtaactacactgctggagggaagtaactttttaaacaatagaagtaactcttgataatattagaagtaaatacactcctagagggaagtaactataaaaaaataaaataaaaataactcttcaaggtattagaagtaattgaaccgctagaaagaattaacttttcacggtgttagaagtaaccttttgcattattggaagtaactacactagaggagttaagaaaattttttttgaataatttgaatatattcagtatgggtgtgtttggttgctagtatgtccctagtctggctcgtatccctcatccagggtgccctcaacctggataggataatgcaattggctatgtttggttgtctgcatgggtttatcctagatgatatgagatgatgtttggttggttgtatgacaggatgctgtacactagagatggtgtttggtttgttggttggaccttgggtctgggtgacctcttcttacatatggtgaccatggtgtt

SEQ ID NO: 23173 - DNA, 1501 bp, Oryza sativa
atatgcggtaattgttttcagtggagttggttacatactaatttcttataaaaatgttgatgattgtgtcacgttatgaacgaatcttgatttttcttataactcgcgactaattaaataaaatgttgaaatcattataaggaagaagtttataagactaccttttctattgcaatgctctttatcataaagacgaacgacctgtcactggtcatattactatataatacgctgaaacaactggtgctagggaaaggaaaaaaaagtttgaattacacctccgaactattgagcgagtaaaaattaccacctagactttagaccccctttgaatcaaatgaaattcataataattttagaggatttcggggctgtttggttcacatactaacattgcctaggtttaccatgttttcttagctaaacttaccaaaggtgaggccatcaaaatccaagccacactctagccaacaaaatgaaaccatgccacactttttagagtcacttacatgtgggacctagattacaaaagaggaatcttgccacatttgtgggagtcaaccaaacactaacctaacatgatcaaacttgcctaaccttaagtgtgacaaagtgtagcaacttatggctatcattcctataggaatttttcctataaagccttttgaatcaaaggaatgagctctatggaatcttatgaaattcctatggaatgcctcttcccatacaagttttggaggaattttaacaagaggtagaacctcatggaagaaatcctttgagtctttatctctcctcaaattcctgtattttttctgtggtccaattaaacggtcattcctatgtttttcctatgttttgcaatcctcttttttacacttacattcctgtcaaaatcctatatttttcatattcctccgtttttttattcctgtgattcaaaggggcccttagagtggttttgatcctacgtggcagactagtcaatattttttttaaaaaaatggtagtaccctgcgttcacgaaagttggtaggacccgtccatctcttattgcaggtggtttccactgatttattatgaaaattattgactttgctgccataatataggaccaaaaccactttggattgtgttaaggggattttcattcaataaaaaaattcaatattaatattaatagagcgttcgtgaaaatattaatagttgagagtgaaaaatgtatgattttcatgtctagggtttaatttgcaagtatccaataattagagggtgtaatttggacttttttccatagagaaatggggactgagtcaaacaacacatcattactgtagtagactgtgagtctgtgaagatagtataaatgtatgcttagcgcctagaggcacgccgaagccagacaggcagcgcagacactaaccgtggagtagtctgatcgatctatagaaatactgtagccaaaaactaggccaagagagagattggggtgttctgagcg

SEQ ID NO: 23174 - DNA, 877 bp, Oryza sativa
agcgcgctgcactgcgttacatgcggcgtgacgcgctcgtccaaaccgcaataaatgtggttaggtgagccctgctgcgctcacctaacccatacacgcggcgcaaaatctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgccaatcacgcacatcggcaatggtaactcgactgtcaataatgagcggcctcttcaaggttgccacattactcgagtagcacgcgaatcgggacgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagagagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccttcgccacacgcgctcgctctcaaacatctcttcctccggcgtca

SEQ ID NO: 23175 - DNA, 1501 bp, Oryza sativa
ttcgtccacggtgttggtcttgcctgtctgtagttaggtctcttaggcctcgccggtgcttcacgtgtcctgtggcttattgaactcgttgtggtgctgagattggagcggtgtgcttatctctccatggtgcgagagttttgctttggcttcttagaagttctgcaccttttgagggagtccggggcgaaagccttgcttgcccgtcttctgcggttcgcagttgttttgtctcagactttctgtgtcttctgcgtaatgttttcgtcggtttcactttagtatggttttttttttcgattttccttacaaacaggttcaacactatccttttaatatatttggcaatactctagtcccccgcttccatttttcttttaaaaaacccgataggctgacaaaccagccgaaacaagagaaatacaagaacaagaaaaaaagagaacaccgaggaaccgagaaaaggagagcaatcataacataacataacatagctcgtgggtctccgtttagaaagccatcttcgctctcccacttcatcttcgcttaattatttgaacattacatccataaggcgtacgtacagaaaacacaggacacagaaacaagatatactaacaaaaaacttgccgacactactacagatccgggctttagtgacgggtcatctgtgacgggccaacgcaactcatcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacaaatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgaaatctataactatttagttgataatattttcatttgaagtcatttagggtgttaaatatatgttaaatgattcagacaagcatagacaaaataataacattgggttagtagtcaatatgtgttaag

SEQ ID NO: 23176 - DNA, 1501 bp, Oryza sativa
aagatctcatgagacgaggaaacggaaaccccatgacttgaaccttaattaatttgttctagtactgcactgctacttcttgagttcttatactgcgtagtagctcatctgttgaatgatgatgcgtgtacaacctctgttcctccgttaaaaaaatattaatttttaaggtataaatttatacaagtatttattcagatttatctttaaaagctggttggagtaaaagagtagtcaactaccgaaggttagatttaactagtcctacaaaactatggttggtctcctcccttaggtgaaaacccagtctagctatgggcaggtgtcggcaggagcttctgtcgttgttcacctctttggaggcttcgtcttgaaggtcttgctactctctcggttacttatgtggttcgtagttttgtcacaggttttctgtgtcttctgtgtaaggttttgtcggttttctcttagcaaaccgtgcagttgtatggttttcgatcccggtttcccttataaatagagtcaactctcttcttctaatatatccagtagaacttctaccgtatactgtttcaacaaaaaaacaaaactatggttactagtgattgtagtttcatatgatctggattcaacaaaaaaaaataatgatctggattcaacaaatgattcatgaattgttgattcgtatggaccaacagaccgtcggaccatgcatgtcgctctcattatgcataatgaaattaaatttcattatattagttttgggctagttgatcgatcagaaagctagatcacctaattaatgaatgatgtgcaatcaaatgctgagcaagtttcagtcctttcataatattattacacttatatgccatttctcatgtactttcttcaatgtgaatgtgaaaaatgttagaataacttacattgtgaaacggatggagtatatgtgtaaatatacaatttagtgatcaaattaatatactactagttataaaaaaaatcctccggaaagcaataattttttccattattttacgatctgaggagtataaaatgaaatgattgtcctatagtctattatagtttaaacacaatatatctccacaaatgatacttcaaaggttcattgtattacccaaaattctttaaacacaaatacacaatatctccacaaatgatacttcaaatgagggtattttgggtagtgaagtttgttgtacctgtccaaaataccctcatgcctctttaggctgtgttcgcataaggtggataggaacatattccctccgcacggaaaacggagcgattcattagcgtatgattaattaaatataagctaattttttttaaaaaaatagattaatttgattttttaaaacaactttcatatataaatttttttaaaaaacacaccgtttagcaatttgaaaagcgtgcgcgcgaaaaacgatggagaggggctgggaaaagagagttgcaaacacagccacagaaggacagaagg

SEQ ID NO: 23177 - DNA, 1501 bp, Oryza sativa
agccgttggctcgactcccctcgtcccgcgcaaccagccggtgtgctcgctttcgcctagatcgccgtgtttcgctccgccgctcgccaccgccgtccgccgtctattccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccgcacgcatgcgccgcgccccgctccacaccctagcgccgcgccgcgtgctccctccgcacggtgagccgagccgctgacaagcgggtcccacccgggaccacgcgagatggactcggtccaccggcgccctctctctcccctccccgcgccctattgggccgtgtcctcttgggcaggccggcccatttagctcggccgagccgccccttttctctcgggtcgcgccctagccgcccgagggaagtttatttcccctccctcttccttttctttttccaaaagggtttaattaaatccttttcctttagaccaaaaatccaataatcttagaaattcaatatcttcccaaccgtaagtccgtttgactctgttcaacttccaaaattcctcaaatctctagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattgacggacctacctaatttgttgcatttgatccttcctttgttaattgttatatcatgtccccttgtaaccatctagttgcgcctcgatattcgtgcaccctgtgcgagtatcgacggtcgccttcaaacttaaaatctgaaaaaacttcttgggtaaaacttgggttttacaaaaggcttggaaaacccgacacctgggtcggtgcttgcgaactaaatgaattttcaaaaccgcggaccggggaacgtaccgggtgtacggtttcccgctcttgcacttaaggaccgtttccttggaatttcatccgaacataagacaagtacgaccacatgggtggaatgggacacccctggctaagtaattagcttatcaggggagccttgatgccgagagacatgtggattcgccggggtggtgtcggggaggacccctgggcttcctggcacagtatggtctgggacctaacctgttgttggtctgggacccctctcgtcggcatatggtaaatctgtgtcggctttggaaatgccttgtcatgaa

SEQ ID NO: 23178 - DNA, 1501 bp, Oryza sativa
gtgcacctctgaagctggtgctgtggatgtgcaacgtgccagcggttttccatggccagcaatcactatagcttgatcgctctcgctcgtatagctcgtgcggtgtactgtttttacgtacgtgtgcactgctcttaatttgtgttgcgctttgagttccgggtgccaatatatatacacagagagaagagcacgcttacatacatagacataagttaattaacttgttcttttttttatgttgcatttgaccttatgtttcatataattaatctatcttgttaattatttttcatatatttttaataactatttaaatatcatgtaagaaataaataaaggatatccccagatgaaaatacttttcttagggcctgtttagtagagctccaactcctaaatttagctacaggagttgggtctggagtggagttgtggagctgtgtttattttgtgagagagctccgtccaactctgctcccattttaggtggagctgaaactgtttagctgagctccaactctagaagagatggagcgagagctggatctgtactaaacagacccttacatacacgcatgatgcatccttggagggggccagacagtggatttgcaagagcttttacaaggtcagtcaactatgggttcacgcggttaattcgggtaataagtacagagaggaagatgaagatggagattaagagattaagtgtttcacagaaaaacgaggtggtaataacatgtgattaattaggttttaattattacaaacttgaaaaatggattaatctaatattttagaacaacttttatatagaaagttttcgcacgaaatgtaccgtttaaccgtttgaaaagcgtgtcatgagtatccaaattttcatccacttttacagaagaaacgaacgggagactcggttgtttcgctccggtctgattcagtttcgatcgggtatgtacaagagatgttgaaatgttaggaaatgtagtatatatacattgatttgaacctgtagtaaatagtactaaatacgtaccgaacacgacatggaatgcaacagcagcaaactgtgacatgtggaattttctcatcgaaaattcagaaaatttacaacatgctggtactctagtcgaatttgagaacttaaggtatcgtccttatagctgaactctggctagtcaaaaattctgaaaatttacttaactacatgcgtcgtgcgaaaaagttctacatattttccctatcccaaaatataataacttatagcatttaaaattgttgtaaaatataacaactttcccaccatattcaaacatccatatcgtttcgtttatgattatacttgtacatatggcttattagcaaaacaaataataatttgtgcttacaattttcatatactttcccttagcaatcaaaattaaatgttataatataaactaagataaaagaaaccacaaaattaattaagttttagtatttaaattttgcttataag

SEQ ID NO: 23179 - DNA, 1501 bp, Oryza sativa
tatagttagattaaaataacttaatgagttgtaggttcgtgtcagactgaatatttgaggtttgcatgcagaggctacatctaaaactcctttcttcttctgctccaccaacaaatgatgagacatcaacagattatgccgacctgggtggatggttttgaggcacaagaataattattcatatacggttaaatcaaaacaagcgaacgaaagattatggccaaagattaggtgaagatgttgaaagatgcttgttttatggggtccaaagaattgctttcgtgagtggcaagaactcacgcatcccttgtgtgcaaccgagatattgttctcatgtggaataggccggtgcaacttcctttaagtacgcctacaaacctgagtttgatttgatttgcttggatttcgttatctcaggatctaattattatatttttagatccaaaatttgattttactttcgaggtactgtactaaggttagtgctaaaaggagatgtactcctattgaatatagttaatagacggctgccctctcctctacgaaaactctaccattggcagagcttaaccatcaaacaacaactaatcatagattcacaggtcgctcttgggctacctagacagcagctaataattaattactactaataaagaactcaccatcacggttgttgtaaacaatcacccgattttcagatgagaaacatttacactgcaagacatgggagacaactaataaccggattaggggcaaaaccaccccgatagtcagaaaccatggcctccgactccaagaaaagggccagattaacccataccagatctttggagacaaatcatttgtttaccgaaagtaagaacaaaaagcggaagaccaatcgaacaagacagagttattgtcctgtggctgttatattagtagtatactctgacgattgagacgggaagttgataaatttcagaaaattttgatgacaaagcaaagcacgcgctgcgcggcgcaacacaaagtttgggattattcaatggagagcatttgcggcctgtggccggcgttgtgcggtgaaaatgccaatttaattggaacatcgtgatgtcaaatgagctgaggaagaccccacctctaaaaacttgtaatattaaatcagagccttctcctaccctctagcaagtagaagacctaacctgcagattaaaccctcttgtagtcttgcagattaaccaagtggaatgcaaagctgatctaagaactgcctgaaaatcattagcgaagtaagggtcacatgcatgcatcatgccgtccgtcaccgaatgaaagccagaaacagcaagttaaaagttagtggcatactgtatagggtgtgggcaagtgctctatctctgctattttaaaattctatagtggtggcggtgactccaacactggcagacacgcggagtatgagccatccgatcgctaaatccaacggctcatatcgtctttcccgtcgtttgcatgc

SEQ ID NO: 23180 - DNA, 1501 bp, Oryza sativa
ctagacatcacatttatgcccttttaatggttgttttagttgttaccgagcttagatactactaaaatggtcctgatcaaagcctacatacagaagctaagtgccaagtaaactccctttcctgatgcacgtagaattgtactacttgtgtcgcggttgtctcactaggccgggcatttgggtaattcattttattattgtctataggaagttttactataattagtgcttaggggtatcagaaaacagagtaatcaccagtgaaatatgcggtatttcctccgtcacataataagttaatttagtacgagatgcgataatatgtgataatattagtaactgctctctgtgtgattactgattgtctggttagataacttgttaattaatcacctcgttcgatcggatcaggcagttgagtagtactactacgtacggcaacgacgtacctactgctagtctactgctactccatacctaagagcacctacaatggtaaagtaaggtgctatctataaaacatgtacatctcagcaatagactagattaatagtaaatcaccttaacagtatgtctacatagttatctatagctctctcatgcattgcctcgtttttctctatagactatctctatgttagtagatagctttgctctctctcttcatttaatatcttccaagtaggaaaatatactgacatggatctcttatagagagcttatagataaccattgtgggtgccctaagagaagctccgtggtcaatgtaggagagcgacgtgactcgccttttatttgagcttaaatgcttaatgacagggggtactgtatatattaccgtacccgtgtagtcgtatgttttgacgtagatctacgtacagagactagttatggcaataacttactgctacatctctcataataactatttttttcactctttctgtttatctcaaaataaatttattttttaatgatcactgcattggagtttatctaagtagaagataaatatattaagagcggataaagtaaaaataattataaagatcaccaccaccattagatctatgcgggaatgacgtttggctagatcggagctcctaaaacatataagcgagacaaacgcactactaaaaaccattttcacagacaccatatttatttctgcaggcaggctaaaacgttcccaattatgatcgttcgtacaaatatataaagttgtacctgatcaaaacctgcctgcgaaaattgatttccgtataaagtagttttatactggttacctggaaaaataaaaacatttttgcaagcgaacctcttaaaaggactgtctacaacaattgaaatttttgcagacggcatattaggagcaccgctaccaaagataaaaaaatcagccaactatattctttttcccaaaattatcctctcactctcgtaccactcctttcttatcctctcctctctctccctcttcatcttccacacttatcctctc

SEQ ID NO: 23181 - DNA, 962 bp, Oryza sativa
cagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagg

SEQ ID NO: 23182 - DNA, 1501 bp, Oryza sativa
atatgaaaaaaaatgattaatactagtattttgcagttactatttgtccaatccaaattaatcttctgatgctattttcatatggcaaatcttatagtatctcttgtatattttttttctctttatcttaacgatgaagttgttaaagcttgattgcatacgttctaataattcgtgatcaggaagaagtattaagttacagttcaagatcagggaaaagcataatttcatctgagtcttgctctgatcccgttgaaaacgttttaaaatcttgcaatatgcatggaccactactatgaatcaacatatcgccatccttgatattcattaactgtggtggcttaattagttgcttcggcatatatactaatttgacagtacaacagttatttcagatgctgcgtgatctgaagaattttcgtccttagaggcatcttacgcgtgccatccatgcctgaaggatgatctcacatctgagcaaattaaatgcgatgaattagattcccatatttactcgacctcttattgctagggatatatataacctctctttggtgcgtactaatcgtctgattatctcctgtcactgttgcttactcaaagctaattatatgaggctcatttcctctcttttctactgtactcaccagatgcaacttttctgcactgcagatatatgtggacgctcattgtcatccaaaagcaagattagctcctctaattttgagcactgacgcatgccactgataaaccttttaaactatataaacaaactttcagttgcaagaaacgatacagtgcatgtaactatactataaccaggaaatgaaggggactgatgtctatagcatggcgccgacgaccactgaatagatgcatgcgcgcatcctctggcttgcaagaaattgcctgtcaattctggcaggcaacaagaggatgaaaagaatcacaacccctgaatggtcacaaatatttcacaatagaagttagtattttctccgtttcacgatataagactttctagcattacccacatttatataaatgttatgtgtctgggcattgatagaaagtcttacattcgtgaaaaagagggagtagcaacttaattttaggtccgtgcagtgttgatatccagattaacgaaatgtttttttttatccgtgatatgttcctctgtatatggtctgtgtaatacacatatactacttttaattattttggttttcttctcagatttcttcttgcgatttacttatgttaaagggtaattttatcattcttaatcaggtactgtcacaccccaatctgataccgccgtacaacggcacctgacaggagcgtgtcgtagggaaaatggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcaga

SEQ ID NO: 23183 - DNA, 772 bp, Oryza sativa
aaaaaatattttttgaattttactagccatcctatacatggttacacatcactacctacaaattcacaatttttcacacaatataacttgtatgctacaagtgagattcgaacttaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatttcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtga

SEQ ID NO: 23184 - DNA, 1501 bp, Oryza sativa
tgacaaagtgatggaggaggctgttgttatcagaggtggcttacaggccaagagagatctagagttaggaggagctagagagacaggcaaaagctttggcacctgcgtccttgtcaagcctcgaaacagttcagtactcccccaaccactccaattggggtggcaactccagccgtccatctccagatcagatctgatggcacatcatgcattccctcagtttgccaggcagtgcacatcatcaaatatctctccctccattggtggggcatatttttctacgtgcttgatgtacaaggaagaaagcctccaccacagctttgctccaactcaaagcggctagcagcctaggatcacgagtgagagtgatgctgataatctctaactatattgctctactgattagttcatttaatgtagcatatatttattgagtgaagtaatataaccttcacaattgttggcaaaacgtctcagataggaattaggatatttaacatgggttggaaatggggcatgagatataactcggataaacaactagcctaagatttgcacaaaggatttgttcaggtaaaaaaagccctgggctttataaaatagaacttatctgcaattgcagtcctatcaggcataaattattctcacctagaaatatagcacaaaataacctatattagtggtgcagtgattttacctttaaactctttctgcccacttcctcaacccatgcttatctaccactttgaagcaaaacagtactcaaaatgatctctacacatcatattctgcttggtattagattgtaccaagtatgaccagaagatatgttgatgcgcccataaacccattctgtccaccataaacctccaattacgcaagagagtacatccataaatccattatgtcctctgttctgctagaatataataatcaaactactatgttataattgcattcagagcacgaacagcgctagactgattacgcttgattatctataatgacctacctccaatctaaacaaacaaaatcgggatacgctcacaaggcctgcatcttacgaaattctgttaagttccctaattcccgacggaatccctccctaactccgttccgtttttgccactatccagacaaggacagctcaacgccaccctgtaactactgttcatccaataaggacagttgagtcattctactgatgctttggccggggtgggtgtgtctcccggtgtgtagtattattatacgagcatggtttggaccaaaaggacaagagtggtgcattatagcagacacttgtatatattgcccttctgtactctcccttcccctctctcctacccccttttccttctaacctttagcttttcctgcctccctccttctttccctcctctcttctcttctcttctcttctcttccatctcctaatcttcccctaacaagtcctagctaaattcagatccttagttgctggtttttcttgttccttttc

SEQ ID NO: 23185 - DNA, 1501 bp, Oryza sativa
aataagtagaggaagacattcagccccatcgtttcgcttatatatacttatacttataagcaaaatttaaatactaaaacttaattaattttgtggtttcttttatcttagtttatattataacatttaattttgattgctaagggaaagtatatgaaaattgtaagcacaaattattatttgttttgctaataagccatatgtacaagtataatcataaacgaaacgatatggatgtttgaatatggtgggaaagttgttatattttacaacaattttaaatgctataagttattatattttgggatagggaaaatatgtagaactttttcgcacgacgcatgtagttaagtaaattttcagaatttttgactagccagagttcagctataaggacgataccttaagttctcaaattcgactagagtaccagcatgttgtaaattttctgaattttcgatgagaaaattccacatgtcacagtttgctgctgttgcattccatgtcgtgttcggtacgtatttagtactatttactacaggttcaaatcaatgtatatatactacatttcctaacatttcaacatctcttgtacatacccgatcgaaactgaatcagaccggagcgaaacaaccgagtctcccgttcgtttcttctgtaaaagtggatgaaaatttggatactcatgacacgcttttcaaacggttaaacggtacatttcgtgcgaaaactttctatataaaagttgttctaaaatattagattaatccatttttcaagtttgtaataattaaaacctaattaatcacatgttattaccacctcgtttttctgtgaaacacttaatctcttaatctccatcttcatcttcctctctgtacttattacccgaattaaccgcgtgaacccatagttgactgaccttgtaaaagctcttgcaaatccactgtctggccccctccaaggatgcatcatgcgtgtatgtaagggtctgtttagtacagatccagctctcgctccatctcttctagagttggagctcagctaaacagtttcagctccacctaaaatgggagcagagttggacggagctctctcacaaaataaacacagctccacaactccactccagacccaactcctgtagctaaatttaggagttggagctctactaaacaggccctaagaaaagtattttcatctggggatatcctttatttatttcttacatgatatttaaatagttattaaaaatatatgaaaaataattaacaagatagattaattatatgaaacataaggtcaaatgcaacataaaaaaaagaacaagttaattaacttatgtctatgtatgtaagcgtgctcttctctctgtgtatatatattggcacccggaactcaaagcgcaacacaaattaagagcagtgcacacgtacgtaaaaacagtacaccgcacgagctatacgagcgagagcgatcaagctatagtgattgctggcca

SEQ ID NO: 23186 - DNA, 1501 bp, Oryza sativa
tgtaaccatgatgctttagataaaataatttaagccgactttgatatgttacgcaaacaaagatggttgtactagaagaaaagaattttgcagccaataaatatacggagtactagtagtactacttcaattgtaggttttgtcgagttgtagttggatggttccacgtcaattccggagttgaagcatacacgtcacagctgtgcttgcttggtacacgtagggtgcacgccacgcgtgtcagccaacagcgagcctccacgtggactcaaggagtagcactgtacgtcttcccttctctctctcctcgggtcaataatagttaacccgttgactcgatgggccgtgttttcaccagcgcggcggaggcccatttattcaactaccgataaaggggcccacacaaccagcccagcatcatctccgtctccgtttgcaccgaggcctcggggcaagggcccaacccgtttccgaatctcgaggcgcaagaggccatcgaacggcggagccttaaagccccaacttgtccgtgcggtttcttactttcgtgggctttttttctccctcttgattgcggcgcgactgcgagcgagagagcttcacgcccagatccgggcggccatggcgaggaaccctacccgcaccgtctacataggtgagcgtctgtctcctcttccccctccccgcggcgctcgcggtggcttcagattttggttttagttcggattggagtagattgatgtacacctcggtgatttgattgatcaattagttggttggtacttggtaggttggttaagttgtatgatgtttccgtggtgtcctcggttagcgtggttacgcgtgatttgtggatttagcgtggttgctgttcctctgatttctgatgggtgcaactgcaaatgtatcgttgaaaggattcctgttgttccccttgtatttcttttactggctaaaacgatgagtgcatttggaaatagagctgctagatgctagtatcaaagcttgacaagtgattgcactgttgctgctatgaactttacttgataataacgttggactgtgtttcacaagtagcatttcaatttctacacgtttcttaaacttacctggcatggagatactgaacttccacttttctctctttttttttttggttgcgaggaacttttagtcttttactgtttgttgcattagtgaatctgtagcggctctagtctattgaacttttctccagttgttagctttcttagcaattctctgggctatgctaatttattcggaaccttgtcaatttatttgcctgcaaatgcaatgttttttgtggacagtcctggtgtcatctggtattgtttgtatgtatattgtatatctagtgttttatgtagtctaagcagcttcatttctctgtatcagagtattgtattaattatattgcaattttttcctacaataggtaacttggatgaaaaggtaactgaaagaatattgtatgagattc

SEQ ID NO: 23187 - DNA, 1501 bp, Oryza sativa
  unsure (1)..(1501): unsure at all n locations
tatttggttgctgtcatagttagtggagacaatggggatatccaggcaaggaatctgaagagtatgtaacttctactcacgcgcatcaaaatttcagtatctcatcttttactgcctgcttatctggtgagatattataagagggaggactcagtaaactcctctaaaaaatggttcgaagtaaaccatttcaattattcagctcagtacgcaaaacaatgaggctggctttaggtatgtatccttcctccctgcttccactgtaacagttcattagtctaagtgaaattatttagcaattaggtcctaggtaactagctgagtagactaataaactaggctctaaaaatcttctggatcttattttgtagcagaaggggttgaccaggactgctctgtcaaagagcagaatgtccttaacatcagcactgcctgcttgcaaattatatgcttacatggtatgtctcttgctctcttcattagtcattacaaaacagtgttcgtagagatgcatacttagatccatgctattgttgcccaaatagaaaaaaaaaattatgattaacatcgtaacatgttctgtagaatgaatgggtatggaagcattatcagtatataccattgatagactagctagctgattcgcccctccttccagaaaacagagaagtgattggttgaatgtactcatgaaagtcgcaaaccaaggaccactatggaggcttcaccttaagatatgcatattaacactggaaactatgttcatgcattggctggcaatggcacatacatggttggttttgtcaaagtgcattgcatgacaagatctcatacgatttgatctctgggttctaggaatgcctaagatgcatgcaaagtttacttctagaaaaacccaaataaaaaaaagataatattagaagtatatacactatttccctttttttcttcattgtcctgaaaagattggtggcaatcattccaacagtagtgacagaactcataaaaatagccctgtacaatgtaaggtgtcccccttgtacattcagtcattcacttccccttatatataggggagagactagagagggaccctcaccctgagctcattgaggtggccaaataggttctgatcacacctttctcctcctccatgcttactacactggcactgtagtgcatgcaagaggagaggcaaaaagatgatgatgtccttagcagcttaggttgtggctacctagctcttcaactagcttcttcccagaatccacatagagaggcagagctatatagcagagtaggaagatacatacacacacatatgcatataattcctagctctagctggtgctagctctaggagatgtgtccattccattgcagtgccacagagggctcgactagactagtctgcatagcttctttcggtttacacaagagtnnaggtgtttgtttccaagaggccagagtgatcgatcgagcttagctcatcggttcttgg

SEQ ID NO: 23188 - DNA, 1501 bp, Oryza sativa
gtgtggccggtgaaaactcaccgagggaggaggaggcagtcaccgccgcgcggcttgcaccgcccacgcccaacgccctcacctcacctcacctcctccaccacccaccggccgccgccatcaaaccggccgacggagatgccctcgactaggaccccaacgctgccgacgctgccaacagcttagctgccgaccccaacaccgtcgacgtcgccatcaacctgaccgccacccttaacacggcggggagggaggagaggaggtggcggcaaggtcggaggaggggaggcctgggatgaggaggccagggaggcggcggtgcagagaaaggagatgaggcggtggcgaggttagaggaggggagggtggggatgaggcggcagaggatgggcgagggagggaaggcggcgccgacaaggttggaggaggcaccgacgatgagatgagacgcctccgctcccaccattcctgctgccttgaaccgcaccgacaccaacaccattgacgctgccatcaacgcggcgggaagggaggataggaggctgcggcgagggcgcggatgaggaggtggtggtggggagaggaggtgccgcagctcccaccatcttgctgcctcgagcctcgccgccctgttgccctactgctgagctctggcgcagatgaggcagcgatggcgaggtcagaggaggcgtcggcgaggagagatacgccacggcgagattcctgtcaccccacccctcatgccgtcctgctactccctgcgtggatgatgggtgccaaagtaggagccggcctgtgagctccacccctcacgcagccgaccagtgagatcctccccatgcacagccattggccgacgaggtcttcccacgcacgcggctttcccggccgatgaggtcctccccaatgtgtggcgcggccggccggcaaggtcctcccctgcgggtggcgcggccttccggctaggtcctccctacacgtggcatggccggcggcatcgtctgtgctaatggaagaggagagaagaggactagatgaaagagagagaggcggggagatgaggtggaggcctactggcaagtgggtcccacctgtgactcagcgagccgactgccacgtcagacaaaaccacctacgaaactgctcagggagtatatttgcaacggttttggaaattaggggcgggttatacccagttttgcggttgagggatgtgattcagccaggggcatgagttgagggaggctgaacagacttattccgagacgaagttgataggcgacgaagcccacagcccacctattggtgagatggtgcgagccgtaactctggcgcgctcgcgccggtccatgtcacgtcaagcaaatcaggattaccggttctattcataagcacgctgcttgctattatttagctgaattttaattaatattgtatcatgtttttatcatattcatattcatttaagtttgagattcgtattagaatcaaattcctagtt

SEQ ID NO: 23189 - DNA, 170 bp, Oryza sativa
gggggggggggggagtaataatggcgggaagctgtggttgaggaggtagcggttaattaagttgcggcgccatgtggcatgtgctttgcccgtgtacaagtacatatgcgtccaagtaggaagaaaaacgaggcgccggtatatgatctcccgaccgtgtcacgtagtca

SEQ ID NO: 23190 - DNA, 259 bp, Oryza sativa
tagttttactctgatcagaggtgtacacttgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgc

SEQ ID NO: 23191 - DNA, 1501 bp, Oryza sativa
agaaaaattagtggttctgcttctgcatagtttggaggttctatagccgtctaggcaaaaaggcagctagatatctttccccaatctgccgacacttgagtgggagacacctctgttaactatgatgtcgtatactgatgttgcatcaggtcgtttcacaggtaccaacaaagacatgaaggaaaaccaagttaagggaaaggaagaaagaaaatgattccaatagttaattgctcggtttaccttggagctcatggattatttgtgatttggacgccagcagtgtgcgtgccaaactgtcatcacattgctctaatcctcttttgtgataatcctaatagtttgaagagatgacgtaacgaagaatctaatcatgctctcctggcttcgagtccgacctacaatatcattgtcaagtgactgtattctaagcaacatttactattatacagtttccagtaggagggcaaaggacaaaatcgaagtcatcatcagctagggagacatatcttaattttctatcaggaaaaggcaagcccaaaggagatgaaaatactacgcacctagataggctccaacaacttgtaatatacaggccaatgatttgccaaacgaaatatatatatcatattgtgaacttttttcttgagagatatctgtatattttcggaggggggggggggggggtcccctgtctagccaatagccacaactttagcatttttggtaagtccttggtaagtataaaatactattcttcattgcatacacaacttttccatgattgtaccaccgatagttcggaaaaaaaaagaaagaaaatgtaccaattctgaaaaatggagatatcaaatgttcaagttaacctatgaacaaatttaattaaaaacaatttatttattcatctacttgtttgagagctagaaatttcattgttgtttccctctttgctcagtttctcccgatcaagtgacaagcctaaaacttgaactcaagtgaataggttccactagtctaactagttaattgagctacacttatttcgctccatctaaaaaaatcctcaaataggattatttcagtatggtccagtgtttttcctaggttgaagagatctaattttgacaaataaaaaatatatcatcaattaaatatattttcttgcggggaatatcatcaactatatatgatcctgggtatatcgttttcaaatgctaagaacgaaattgctaaagagaaaatgaccaaatcattggattcttttggcttcaatttatcattggatcccccatgttcttgtctcgacattactcccagtatttcttcgagtgaaatagcatggatgcaaatgctgatcccatcacaactaacaaagatacatagcacatgattgctcactcaccgctgacagagctaagcgattcggatcttcttttccactgggtctacacaatttcaccccaacttcccccttctgtaactaacattcgtttgagtgtcc

SEQ ID NO: 23192 - DNA, 343 bp, Oryza sativa
agggattcggcccatcgaaccgcgagggaggcgaaatagacttttgcggagggatttgatttgggaaggatttggattcgggatgaactcgacgatagatcggggatttgagatctgagatggcacggacactagacaacaagcaaagaaacagatttcgcaattaggatttttaagagatagttttcccgctaggcgccacgacggaacgggcgctacagtccgcccccatgtgcgcggatcttgctatgacaaggcagatctagagcgggtgatggcgggaggtatggaggtggctgcggcaacctcagcggcgggcgggtgatgacgggagtggcgacga

SEQ ID NO: 23193 - DNA, 1035 bp, Oryza sativa
cagtacgatcaagcttcgaagcaaccacctcaagcgacttgaattgggagcccaacactatatccacatatgtgttccactccaactccccattcaaatctagcatgtacttgtgtgaaatgggtcctgctccaacatcatatctaccttgtatagctatagactgattgctccaccccagcacatcctttgtatgacaaactaactcctcaaaactaggttttccaccaaatataagttgcttaacactcatcccctcgaaattgttaccactgttactttgctctaccaccgaaccaccatagtgcaatcgtactaatctatccatctacaacattaaccgacatattagcatattgcattttttaaaaacttgaatttgcaataaaaaaaaatctaacctacaactatgtcccccaacgaaattgtccataaatatctaaacatacgcaaacttccatttgtaacgatccatcctaaatttgaactctcgcattgtgatgaaaattaaacaaaaaagaagtgttctttactaatttgggggaaaaattagggttcttccctaagtgccgaaaatctccactaaaaattagggttctatgagcatctaaccattacatcaccaacaacaactacaaccacagagtagagaaccaactaatttgggaaaataaccccaaatcacgattctagggttcatccatcaatgagcaaatccaagcaaaaaaatgcgaaatgacgagaggattctgaggagaataccttgccactatgtcctccaataatttcccctccaaaatgcgacgatttagtggagattttttcgattttttggaggggaagagagagatggttcggcgcccgcgcgcctcagtcgagagccactgaggaagaaagaaggccccggctgctgtgcgcgggtcggccaaaggtgataggacctccgcgccagacccgatggcgctgaggtcccgaagcttagcgccaagtcggtcggcgctggcattgcgccgttccgttcatccttcccttagg

SEQ ID NO: 23194 - DNA, 1501 bp, Oryza sativa
gatgcctgatactgaatggaaagcttctgaacaattgtgatgtatggtcagagaatgtcaaattttgttgcacttgatacttgaattttatctgatacttgtactgtgaggtgatcttggtaccttgttgtgagaagtactgagttggtcatgcctaatacatgtactaagctagtcatgactgtgtagtaccagtcatgatacctatagtgaccatgtgctgtaaggtatcaggtctggtgccttggttttttgtgaggtaccagacctgatacctaggttgtttctaagcaccagaccctggtacttgtattttgtgaggctggtacccctatcctgtgaggaatcatgtctggttcctaggttaagacatggtacctgggtttttttttgaggtaccaggtctggtaccttggttgtttctagacaccagaccctggtacctgtattgtattgtgtgaggctggtacccctatcctgtgaggaaccatgtctggttcctaggtttagacctggtacctgggttttatgtgaggtaccggtaccttggttgttgctaggcaccagaccctggtacctgtatttgtgaggttggtacccctatcctgtgaggtgccatgtttggttcctaggtttagacctgatacctgggttttcattgaggtacaaggtctggtacctagtttagacaaggtggtggtagcaggtaccgtgtgcctcacagtaaccctaggttcaggtgtggtacctggtactaggtaccaaatcccattgtgtgaggtaccaaggtaccatatcatggtaccttcactggaaggtaccaatcaaagcctcctatgcttgtaggtaccaaccccattttgtgaggtaccaagaccctgatacctttcaaatacagggaaaaaatattttaggtaccaacccccatatacttattgacattttgatttcatggtttaaattcgcggtatatatttttttaaaaaaatatcacacaacaagcataaaaaaagttgagtgctgcaaatgaaagataagtttggatgtatttcacatggtgacactgcagtagccattacatggtgacatttgttcacatattcacatgatttaaaacaaaaaaaatggtggtaccaccagatagttggtctggttgttgggggggggggaggtccgtacatggttcaaaagcactatggagttgcctttacattttaaaacaaacaccatcactatactttaaatgacgcgatgtggatgtaggttgttgaagcgatggtaaatcaacctatggccggagcacgacaggtaccagtggaaagaaacgaagggagccaaaagaagatgcagcactgccgacgtggaggatggaggaatcggccggagtggagtgcgccgagtggaggagccgattccgatcgaaggaaggatgtgatgggagtggcgccgcagcaccgccggcgtgggggacggagggaggaagaggagcggcggcgcaggc

SEQ ID NO: 23195 - DNA, 1501 bp, Oryza sativa
aagagaatggtggagcagtatgcgatggtggagtcgtgggaagggaggatattgagctagcttagtgcgtttgggtttgttatcttaactcggtttggtaaccttaacgatctaaaagcataactcagcttggctcgactcacaacttgactcgttaacgagttctctcattaatatcacatttgcatctttgaattgatttaccaatttatcatatattaatataatgaataaacaccaaatgataaataactcattgaatccaaataatttataagcaattaatggactaatgtacttatgtataaaatgtataaaaatatatattgacctcatggcctagcaagctacacaagtagctaacggtatatcttattaagctaatgagctaaaaacctagctcgactcaatatactatggctatgagttcaagccgttcgaaaccatcggctttttttttaaccgctagtcatgagttcagtgcatggctagcgcatatcccacaccacatgtgcgggtgtgtttttaataggaatttagtaatgttgagaggatttatcatctatctttctttttcttaaacgtgtgttagagatctacccgcaaatgtgtaactatagtgtatgtgcacaatgcacagtgcacgtgtgttttctgtgtaacagggggaaaaaagaaagaaaaagaacggcagcggcaacgtgggcgcccaacgaaatctgaatttctgaacatcccggaacgtaagaacagcgctacgttggccgagaccggagagcgacgtggatgttaagcttactccaggcctcagaaaaacaagaggatccgggagactgaactgatgatggaccgggggcgagggccaccgcaagatgcattgcagcaggcgcgagcccgcatggccacatctcgcaaatcctcgcttcccctccccctcgcccatcgtttaccgacgcaatctgccaatctcgcattcgcaagagctgtaccgctcggtccacgagcagccaaccttggcatttttacctccgaaagcgagctcgacctcctcaagaatgacagaatcgaacgccgaatatccatcagctgcgtagccatcaccgcctgcgtcgcagagagggcctcccatgcagtaccgcgtacaatatcacgtactacctgaaaggctggaacgctcagttcttcaccgcgacaagaatcaccgaggggaaaaagaaaaaacggcggacacataatggatggagcagctgaactttgagatgtgtgtgacacacatgtgtttgtgtgggtgacgcgatggctgtgcgagaacgctgggagccatacgttgggctatccgaaatctcatctctcgcccaatccgggcctcacgatgacacctcgctgcaccgcgcaccacaaacccctggcgcgcccaatcccacactcatatatacacacttcccggcctcgccgtcctagcttgctgctgctgcattcttcttgatctgatcgtcggaca

SEQ ID NO: 23196 - DNA, 1501 bp, Oryza sativa
gattaacttctccccaggccggctgtccttgttgactggtcgaggtggactgaccctggagcaagggggtcttggctaattggacatgtgaagcactgaggcgtcagtccattggtgcctggtcctgtatgcaagtgatcactgttcacatccaattctgctcttccaccagcgcactaaagtttggaactttggatactctctagtctgaaccagaatccagaaaacttggtaagctgctggcacatctcgtagtacaattggtaagttctactgcacgatgtttgaattatgggattgaatgggggaattatcggctagctcaatcactcaccagtgatatactgtagtagggtttttctgccttcctttacatgatttccatcatgccgcatttggtacgtatgtatttcgagggattttcactaacaaatcaaccattttttttcaggaacagtagaatctttgaaaagaaaagcgcaactgctgcttatctttgaaaagaatagtagtacttcgtatatctgttgtcagcgtgtcgtctttcgcccgatgaatatttgttgagacttgagaagggtacgtaaacggctgtgcccatactgcgcagcaattaggattccacatttccactacccaactgtccaagcttccaacctgtattattctggttaggagatattgggcggtgccactgacgtaggaagacctcgctaagtctttccacttgtaggaaaagattgacgtaaagagagaatcgtctggaattttggttggtggtgcaatgaatttttggctgctagtcgaacatagaacatgcccaattaaagcctcgtaggattagaatttttatcggtaacatacggcctcttgaaaaatctcatctaccaatatcttacaagatctttatacaactcaagttcatgagttatagtagtggtactatactgcggagtactctacaacttgggctgcatgcatgcatgattgcatggacctgactactgtccaaattaacgtaacgtgagcaggggactgatccgtttttcgttttgaccactggtccacggttcaaaccaacagggcacagcgtgaacatgactccggtactagtagtaggagtaggagtgcacaataggctaactatacctctgagcactctgtctgtgggccacgtcgtgtttttagccgcaataattcaggaaataattgggcagagagagagagagggagagaggaggggagagaagagctgaggctgtctgtcccacgtgactggacagagtgcccccctgccggggaggagaaaccagctgtaaagcggggccccctcctctatcgaggtcacttgcgcgcaaaaagccaccgcccactgcctccccccgcgggctcgccggcacgtgcggcccaggtacggcccgcgtgcaccgtgctggccgcgcggatcctcttcgccacgagaaaacccgctacgcgcacaaaccacacaacccaacgggaa

SEQ ID NO: 23197 - DNA, 1501 bp, Oryza sativa
gtataacccgcccctaatttccaaaaccgttgcaaatatactccctgagcagtttcgtaggtggttttgtctgacgtggcagtcggctcgctgagtcacaggtgggacccacttgccagtaggcctccacctcatctccccgcctctctctctttcatctagtcctcttctctcctcttccattagcacagacgatgccgccggccatgccacgtgtagggaggacctagccggaaggccgcgccacccgcaggggaggaccttgccggccggccgcgccacacattggggaggacctcatcggccgggaaagccgcgtgcgtgggaagacctcgtcggccaatggctgtgcatggggaggatctcactggtcggctgcgtgaggggtggagctcacaggccggctcctactttggcacccatcatccacgcagggagtagcaggacggcatgaggggtggggtgacaggaatctcgccgtggcgtatctctcctcgccgacgcctcctctgacctcgccatcgctgcctcatctgcgccagagctcagcagtagggcaacagggcggcgaggctcgaggcagcaagatggtgggagctgcggcacctcctctccccaccaccacctcctcatccgcgccctcgccgcagcctcctatcctcccttcccgccgcgttgatggcagcgtcaatggtgttggtgtcggtgcggttcaaggcagcaggaatggtgggagcggaggcgtctcatctcatcgtcggtgcctcctccaaccttgtcggcgccgccttccctccctcgcccatcctctgccgcctcatccccaccctcccctcctctaacctcgccaccgcctcatctcctttctctgcaccgccgcctccctggcctcctcatcccaggcctcccctcctccgaccttgccgccacctcctctcctccctccccgccgtgttaagggtggcggtcaggttgatggcgacgtcgacggtgttggggtcggcagctaagctgttggcagcgtcggcagcgttggggtcctagtcgagggcatctccgtcggccggtttgatggcggcggccggtgggtggtggaggaggtgaggtgaggtgagggcgttgggcgtgggcggtgcaagccgcgcggcggtgactgcctcctcctccctcggtgagttttcaccggccacaccttgcactgacatgtggggctcacgtgttgactcagcatgtcaacagagtctcaaagacgctacgtaggacaaaatcgtctcccaaaccgtccaaggagtcaatttggaatggttttgtgagttggaggatagattatacccggttttgcggttgaagatgcaattcaaccatgcgcatgagttaagagaggtaaagtagacttattccacttggtctctgcgtctcctgaaaggctggcctgctaccaagcaggccactacaaatctggccctaatactgactcgtactctttcaactgctaccaagc

SEQ ID NO: 23198 - DNA, 1501 bp, Oryza sativa
gcctgaaagtctgaaactgatttaacaaaagctccttactttggggaaaataacaggagttgtcggtgcaatgaattcatcgtttaaccgagaccccaaggattaattagttcccacttatggcagattatattagatctgcactagttctccattcattcagttagacgtgcattttaagtcagaattaggttacaacataaatagccattgttcaaggaacatggacctttttttcgcatcatcgtacagtgaacagtggtccaggattaaatgggaaacaaggatagaaaaattcagagataaccgcagcggcctaacataagtaaaactagttaatgagtggattaattttcgagctcaattttgaacaagcgagactattccctgcaattgcaaacctcgttgtcccttccgatctcgtctcattcatgcatggagatcaggtagtgcactgttcgagctcatggtccagtggccatatcctgaaatgtgtcgatgctctgcggtccactcgaccatgcattccattatatttcttcattatctgctcatcagcttgtagcccttgcaaccctcacgatacctctacctagctactgatggcacgatcgagagatatgtgaaccattcagatctagtactagctagcttaatttgatgcatgtagttactcaattttctgaaacttaatcctgcaagttcggatgagtactttaatttgtgtacgtatgctgatccgatcctgtcaacaacctttgacgtaattatatatatggggctccatctctgacgaaactttgcaccaatgaaaaatcatacgaaatggctacatatcaaccgaccgatcgacgtggttggcgacattcgcccggggtccggcccgtccgaccaagtgtgcagacatgcggttttacgcgcgctgttcatctgcataaggactggaacgccaccgcaatcgtccggtgtccgggcgtcgacccagcgctgcagccagccactgtagcggcatgcagcatccacatccacatgcacaataatcgcgcttgccaccgtttttcttcggtgtagatgacgactgatctgatcagcatttgcagatttgccggggtgtggcattatatcgcgagctagcatatgagttgtccattgcgttagctcattacaacattacgtacgtaccctccctctctaattcgatcctcagaagacgatgggagaaatcgatcgagcaactctgcgagaaatgacgatcgagtagcacttagttaatgcatcaacagttttggattggtttgcacacagcacacagtacgcggcaggatcttgcttaattttgttattgcaagttgccctatgtatcgggactgtctaataggataggcagccgactgaaattattcgctgtttcaaccaatttcttgactatatatgatcctgcagcacagcaagttgcacgggcatgcaaagctagcacatcatctcccatgcatacgatttc

SEQ ID NO: 23199 - DNA, 1501 bp, Oryza sativa
agtactcaggattccatcaaaaaaaaaataatacacaatatttaaaatttatcctaaaagtagtaacatttttttcacctacattctaatttcaatcaatcacaacatctctttgttcaccagacatacagagcacaatctaatttagagcccagtcatcgagccaagcgttgttgggacttaggagaggagaggagcgtggttaggagggagagagaggagtttatgtgaatgatcgatcgggtaagagtgtgtttagttcacgccaaaattgaaagtttagttgaaattggaacgatgtgatggaaaagttgaaagtttatgtgtgtaggaaagttttgatgtgatggaaaagttaaaagtttgaataaaaagtttggaactaaacaaggcctaaattgggtcaaccacatcagttagtcacttataatgcccttataacctatttgataacactctagctaactccaagagcgaaatctcaagtatagctttggagtagtctgaatcccgcttcatctttttagtttatcttttcagatcactctaacatgctcggctctttttaaaggtagagttaaagcctaaaatcgcatggttggactgcagctatagatgatacttttttcgtcaataaaaaacaaacataatacgacatttgagtatatccaaatctatagtactaaaatgtgttacatctaggtgacacttttttcatcccataaaaaacaaacataatatgataatccattctccgtagtattctcgtattaggtttgtttttttataaaatttgtactaaatatgatctgatggcttaaaattgttgatgatgtggcttcttgcatgtcttactttatagaagtaaatgtctcttaatgggtaccaactatataagaagataggatggagggagtatggatctccaataacagtgcaggcagtggcggagccaaagcccggcttgaacaggcaatggccctggctccaccagctgcacgcaacaattcaccagtaaattagtgcctaattatcttagtaatcacctttcttagtcaccggcaagacagtacaatgcaactagtacaacagtaaacgcgctcaacacaaacttttaaaacaaatgttcatactaaagttatctatgaattatataggcttgtatatacctcatttgttgttagacttgcccgactcataaaaatttttgaatccgccactgagtgcaggttagcccatccgttcgctatcttcgatctgctgttcaacaattccgcttccgccttccagtggcggttacgtaaacgcctggcctcctgttattctccgccccgtacagaaggaacagtagagctgtagagcacacatcattctcgttctcctcccccaaaacctccacttgtttcttcagaccccaagccgatggcggaggcgtcctcgtcctcggcggcggcggtcccgccgctggacccggaggcgattgccgccgtggcggaggcag

SEQ ID NO: 23200 - DNA, 1501 bp, Oryza sativa
acaggagtactcagcaagccatgggaaataagtgtttaatgcaggcttcaaagaaaggctgttgtttttgcaattgattttatttgaactcttttctgaaacaactaagtgagtgcttctcaaacgacacggatgagacagtgcgtctcgtccggtcggagtatgtgcaatgtttcagtcttttgaattgataaagattggcacccggccaacagctttcaaacggccacccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggatacactttacccacacgacattactaacctggatcatccagcccgtgcagaacggccacgtctagagaccttaaggcttttatgtcaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcatacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtctgaaggcgaccgtcgatacccgtgcagagagcacgattaccgaggcgcaactaggtgggtacaagggaacatggtataacaattacaatggaagggtcaaatgcaacaaattaggtaggtctgccaatctgccttgcagacgggacaagcagattaagtgcgatcctatcaatgcataatattttttaagcaacataattaagttcaaatataggctcaagatgttcaaaggtggcttgcctcgctcgagatcttgagcttgatcctcgaaatcctcgcactgcgggtcttcgagctccgaaactacacgcgaaacaggacaactcagcaaacggcgaaaataaagccctattactgacctctaagtgtgccattaggtagatctcgagatctgaggaattttggaagttgaatggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaggatggggcggctcggccgagcttaa

SEQ ID NO: 23201 - DNA, 1501 bp, Oryza sativa
  unsure (1)..(1501): unsure at all n locations
agaaacatgcttgtaaatagttttactcttactctatataatatgtcggtattatctggtgctggttcgttaaaaaaaataattggccagtttaacgaagtgagcatagctcatttagttaggttcctttggtagaatcaatctacccgatttcaaaatcctagacttgacacggatgctcgcatttatggttatttattttttcagtgataggcgacgtnnnnnnnnnnnnnnnnnnnnnnntgataacttcatcaatctaaatatgtgtcggtccagtttttcggatatgcacgtagaaatatggtatacgtgtgtttataagggtgagtaaacgtgtgtttgtaaaaaaaagcataataaacatgcaccatagatcacacgagcgaagcttatcttgaaactgcaggctccagtttggccatcccaggctcccagcacacccgctcaaaaagacagaagtttagagagagagagagaatatgcggtaattttttttagtggagttggttacatacaaatttcttataaaaatgttgattgtgccacgttatgaacgaatcttgattttttttttataactcgcgactaattaaataaaatgttgaaatcattataaggaagaagtttatatataagactattttttctattgcaatgctctttatcataaagacgaacgacctgtcaatggtcatattactatataatacgctgaaacaattggtactagggattagggaaaggaaaaaaagtttgaattagacctccaaactagtgagtgagtaagaattaccacctagactttagattggttttgctcttatgtgatagactagtcaatattttttaaaaaaaaaattggtaggacccgtccatctcttcttacaggtgggttccactgatttattatgaaaattattgattgagctgtcataatataggaccaaaactattttggattgtgttaaggggattttaattcaataaaaaaattcaatattaatattaatatggcgttcatgaaaatatttatagttgagagtgaaaaatgtatgattttcgtgtctagaggttaatttgcactcatccaataatttagagggtgtaatagttgagagtgaaaaatgtatgatttttgtgtctaggaggttaatttgcactcgtctaataatttagcgggtgtaatttggacttttttccatacagaaatgggcactgagtcaaacaacaccacatcattaattactgcagtagactgtgagcctgtgaagatggtataaatgtatgctgagcgcctagaggcacgccgaagccagacaggcagacactaaccgtggagtagtctgatcgatctatagaaatactaagtagtagaacacagtactgtagccaaaaactaggccaagagagagattgggcgttctgagcgtagccaaagacatggcaactgatgcccacataacacacttcgcccatccacaacaccgccttctcaaga

SEQ ID NO: 23202 - DNA, 1501 bp, Oryza sativa
aataattattatcacctctttgtttgaataatcccaactaatactatacatgcacccaatagaattaagcatcttgatttaaaaattaataatctaggtgagagaatttgctattaattgtcatgcatacatgcacgctttatattatgaaacacctttaaaaagtagttgcgccctatattttgaaacggagggagtaaatgcattgtatatttataagtaataattttacatattatttattaatggcatttaacttccttaaattggccttattgttttgatgtttcctttatactattttccattgtcttcccaccttcctgtttaccaataaataattcttgtatgttgatttactaaaaaagctataggaagttgtgaattttaaattatgaatcatatatgctatatgctcaaaatgattatctaaagagaccgcacttatttactatgaatattcacatttgacaactcacatactttttaaagaaatccatccaaatgattaagtagcttaacaaaatagaggattagaaggggaacgattttcactattacgtgagaagagaacggaagaggagagaagagtttggatctgagagaattgaggaaaaatgaacctatcttgctttgcccatctgaaaattcaggacttgaggacaactacggtgggcaccagcactggtgcggcgacacgatggaggaaggcgcgagctgctggtggagttggcggtggattagagcagcagtggtggtagatgacaacgatggcattggtggcgacggcggatttgggcaagcgatagcaccggtggtggaagtggatgacgatggctgatggatttgggcgagaaatagatagcgatggtgctgatggtgaatctaaccgagcgatggagatatcgttagctggggattaattgacgtgcatgtttaggagtagtgaccttctccttttttactgccctatgtttggatgggatactaaatggtcacctttcttgagtatacaaaagttacctcttcatcttctctaaggtaacctctttacttttttagagaattcaggggccagctaatatacttgattttcttccctcgtagagcattcacgggatatagtacactgtatctccttggacacgtggcagtttttggagagggctttgcctaatttctaggacgccacgcgacccaacaggatgcaagatcttagtccctgaattaggtctttaagatttccttgttagaaaagagcctgacaatggtcaattgcaaaacaaagataacaatgcattgaccaggccaaagaccagaaatagacactgctcttctgtacgtcaaatgataaccacagaacacgatagaccacaacaacggtcaaaccatccacgcccgtacgtgcgtagccaaactgcatgcacggccattctcgagtcgaccaccctataaattgagcgtccctgcggttccactccaaccttgcgggccaagatgg

SEQ ID NO: 23203 - DNA, 1501 bp, Oryza sativa
tcgatttcctttatcatgtttatgctacaatcaagactaaaattgaacttttatgcgagtcttcccacttgaaccatgttcatcgttgccaaatctagcgtcccccccttccccggccggccggccgcgcggcacaccatcttttatgtttagcatttgcctccttgtttggatggcaccaatgagctaaactgaggtcgaagataaggaaatgattgatattttgaaaaacaaaaccgactatgctggcataattaacaaattaagtatcttctatcttttgttatagccaatcaaagtgtcagtagattcaaagagaaaattccttctgtgtcctgaagagttactcaatcccctgtatgcctctaaaattttgatttaatcatttacatacccttaccattagatttccgtaagatatacgagtgaaggcgtgtgttagcttatcagttttttttaagaaagacaaaaatgccacaggttatcacctccaatctccaaatcgtcgttgctccacatcccgtcatgcaacggctcctgcatccagtcggcgatggtggctcaatatcggctctgcatcccgcgcgcggcagtggcttcgcatcccgtcgtagcggcggttcggcatcccgtcagtgctcgaattccgtcctcggcacctggatacacgagctctcgacgtcccaccaccctctcgcgccgtcatgctcatgatgtataaatcaatggatctgtggttgcttaatgctgatggtgtatggatgcaccataattaatcaaattgttaattgtgtatccctgatggtgtatggatgcttcagatgttttttttccttcccgtcaattgatgctcctgataattttgtatgctccttatggtatttctcgtatcaccaaaaagatctattaaatttcttcttccaaatttatgttaaatttctgttgagtgctataacaaaagataaacacattaaatttcttcttccaaattcatgttaaaaattgtatgtcataattatttagtctcataaaacactattaaatttcttccaccaattttatgtttaatttatgctgaatgctataaggtaaacacattaaatttcttcttccaaatttatgttaaaaattgtatgtactaattatttagtctctaaaacacacagtgtgcactcatgaatattacagtcttttatcaagttgacagccaaacatgcgctcaatttccagctcctacaacttgaagggtattatggacattttcaaccaaattaacgagtggaatgaagtaaacctaacggtagagacgtgtaagggatcaaatcaaaatttcaaaggtatgaaagggatcaagtaagtttcagaggcatacaagggattaggtaactttctaggggcatacaaggaattttctcaaatccaaatcacaagcaagttctcccttcactttagataatctatagaacgatgttccatccgggtgcggatacttaacgcccac

SEQ ID NO: 23204 - DNA, 362 bp, Oryza sativa
aaaagacaaacttgggtgggcatagcggcgatttattgggctttgtgactcagtagaaatgacttagtctttaatggctacaatcacgtatctttcttgcaggtaattttcaaagcaactcagttgtcaaggctttgctctttgcttcttaaggaagacgaaggcattgaagtaatcgcgaagtgcaagcttttagagaagcgtatgatggagctcttctctacttttgggtgaaactttagaagaaggattgaagcatagcttttagttcctcttgcttgttgtccatctttaaaacttatttatgatttacccatgtaacgggagagtcttatgtactcgtgtttgtgacttttaggctg

SEQ ID NO: 23205 - DNA, 1501 bp, Oryza sativa
ctttcttgttggtgcttagtgcatccatattagtatcatagtccacagcctcagaccgaaaagcagtaacatgtctaaaatgcatagatgttatcaaaaattgattttagatagatgagctgatgaaaatttgaaaaactgaaagattagggatgatgctcttgccttgtgcttctcttcaagcttctcaaaaacttcaaatgcctgatcatctgtcaaaaaaggtcagatccaagtaaggatcgacacatatatggatgaacaacatgtagcagtagcattgataattcagattttattgctgctaacagacatgacaacagaatcgtacaaccccgcaagcaatgcagtttgctaaagttcatgacagaagcaaaagggacatcattctttatgaaacaaacctgagcttctatcccaacgcagcttcttactgcttggctgtcctcgcttagaacctgaaaagaaacaaaatgtcaagagagtattctgctgcaacaacatagcagataaattttatatgtacagaaatacaaaaaaaaaaatcaagattaccttgcactagttccacagggaaatttgcaggagttagtataagatatgacgcaagagcttcacgtttggaatgtgtcttacgtttcctatcagaatacctttcaatctctttatcatcattctctgatgggatatcaacacacaaaaaaaacttatcagaaatagctctacaaaagcaagcacaaatctctacaaatgcaaggaatgaagcaaaaccagaggatgcttgattgcttggaaggaaaaaaaagaggctgaaatgttcattaatttgtaaaaatgtttcaatggagatatagatagggctaatacaaaagaagagtaggtactaaaatgatgaatttctggttaaattgagctcgcagggaagcaaggcccaaaagaatattatgatttatggattctaggccccatatcaacaccaagctgaatgcaagagaaagttctctgtgcatgtcgaagtcaaaattatgtagtccatcaaagttcaacaatatataggaaaccataacaggttccactcagtaaaacagacagtcagtccaaataagccagagctccagtaaaacacttcagtacccaattctttgacccaccacctcaaaataaacatgaattacttcttgtaacatgtgttaactatctgacctatgctacatatatagtcgatttgtattaatcgagaagcaagatatcctaatgggcaggaagaagaactaaaaaatgtcacaataagttgagccatagtagtacttttcttggggacatcctcctccaggtggtagcaagaagtcttccagaaatcctcaaatttcaaggtggactgtatcaaagccttctcctccatggtcgccctggcgcacgtcatctccggcagggtgatgtcctgaatataccgacgcccaaatccggtgaatcgccccaaaaaaaaatcacaccacgagca

SEQ ID NO: 23206 - DNA, 1501 bp, Oryza sativa
taaacgaaacaccaccaaaaattcattgcaatatttcgattcaactaataaaacatctgaatacatggactgaaacatgaattactcagcgcatctgtggcctgatacgtagcattgccggattagtcctggaaaatccaaaataaaagggtatagctatatttatggcgctatatttttcatcaaaaaatagtcggcatgtatttacattgtaagtccctaaattatatatgtaattttagtgtatttacaatgtaagtctcaaaattacatatgtaagtactaaaattacatatgtaaattcgaaaattatatactaattacatatgtaagtggggtgtaaatgaggtgtaactactgtgtaagtggctaaaaaaatcgactatagcatgtggcgccatatttttagtaactccgaaataaaatatgggcaagatttaaacatacatgccattagccagaagtacgaatactataccagttagtagtgctacataacttgacatgtacttggaacaaccacaggtacacgggcctagaaggcttcgctgcttccccaacatatatgcatggacaaatggaccgatgcaaacattccatgcgatttgtgttgggccgataatttcctgcacggaatttcgtcccgttctctcgtgactacaaatccatttccacaacccacattttcctggagccaaaccgtgcttgccgtgcggcgtggcagtcaaaactggacgcttcaattccactgtcccactgtcccacccacccaccactcaacggctcatgatttcgcgttccgtggtttgatcgcgtgatctcgtcacggccaccgttttccgccactcgcagacagaaacagtcggtgatcgatcggcttgattcctactccctcgcctcaccacgctcccctgcgtcaggtcttccactactgccgctcccgacgccaccgcgcgcgcacgcaccatctcgatcgcatccagcctcatcaactccacttctcacacgcagcacgcttgcaaaatccaaacgtgacacccccggcccccgcggcgaacaactccacgaaccacgcccaaatcctcccatatcagcagctagctagctagctagcgcacagcaacacatcacttggtgagttggtgtacacaggagggtggagagatggtgaatggatactgcaacctcacctcgtcgcctccggtggccagcggcgccgtggaggccgagaccaaatgggaaggcgtggccgtcggggcggcgacgctggtgaggaacttctcgtcagcctcccagaggttcaggcccgtggagaggagcaggtcgacggccggtggcaacggcggtggcctgcaggccgtggtgcggagggcgttctccatgaggaggcagccgtccagcttcgcggatgggtactggaggatccacgacgacatggacggcgacgacgcggctggcgagcatcaggagcaggcggcgttccaggatggggagcaaaaac

SEQ ID NO: 23207 - DNA, 1501 bp, Oryza sativa
taactctgtagtttcctaagtggatcttagtagcacctaagaaggattttactgcacgcataatcaatccattggaatgtgaactggggatcagtatcttacatttcttactcctactgtcctagtgttcaccatgggaactgtaacttaatggctagtagtagtgtagtagtactttctacagctgctatacaattttttgtaggttaatcattcctcatttcctccacagacattgttattagcatgttgctggattggattctcaatcttttctgccacttgtgacaagccgatgctactgaatttatactgaatcgacgtgacaaacactttcaggatgactttgtgccatagtactagggtattattacaattgactgtaaatcatgatttttttttcttctttagtgtgtgaagagaagctcaccctttttttttctgaaacaaacaaaccatttctcaatcagttatctgtacacaatgaagcgtacaaaagggaacaaaatggcttgtctcacgctatatctctttatcaccacactgtcgatcagcacatatattttagacagacgagcatatatggacaggcaacggcatgtcgtgttcgtacaaatatcttacatcgtgtgggcacagatgatccacagccgtccggcagtaggggtctcgcatcctctacagtcactcgcttagccatgacataagcatctttcttcttccccgtcacaacaaacagaagaatactcccttgcaagcaaaagagagttgcagtttcagtctttttcttttatacacatgcttaacagcgtaattaagcttgcattgctaatcctgataatcgagagcaagcacacatactacatcacatcgcatgtgagggtgttgtactagaaaagagtaaacttcttgtgagcagccagttaactgacattgcagcatgatgcccatcagaggttgattggtccctgcacaaaggccacacaaaacttccctcctttccacgagcgctgctttttccctccttgcatttgcccatttcttttgcttttccctttggcttggccttggctaacatagcctctttgaatcattccctacacttcacagcactgcactaaacgctctttggaggatcatgtgggctgctattactgtgtgagtgtgcttgcatgggagtggggagccactcttttgatgtgcccaaacatgattccaagattattttttgtaccaatcttgcagccttccattcccatcaactgttgaagactcccctatcatcatccatctcctagtttatttctataggagtgccaagtgtggcagcctttcttgcagcactcctttttgttactccaagctttttcctgtagttttcttctcctctctccacattgccaccaccaaatcagctgagatctcacttttgattcggggactgtctttaagtagaggcagccaagctgagatatcctcctgtgtgttctcccgttcttgg

SEQ ID NO: 23208 - DNA, 1501 bp, Oryza sativa
acaatctcgacccaattcgtcgcgtctcgggatccgcacgcgcgaacgtacgtacgcgggcgtgcgagccccctcggcggaatcttcgcatcctgtggatcgcgcagggcggcgcgccacgccacttgcccgccgcggcgaaagcgaccgcgccgcgaatacgcaatgggacgacgggagtgcgcggcccgcttgctctctcgcggaccggcccgcgcccgcgcccgcgtgcgcgcaccatcacacgcgcgcgcgtgtcctgattctactagaacacaccgagaggagataccgcccgctgccgctaccggcctaccgcccgctgccgctaccggcctaccgttgttgctgcaatcctctcccgttttttctcctatacttttctttagatatcgagaattcgagatactttgcccgcgtacatctgccgatccggtggtgagatatttcgcaactctcgcgcatcccctcgccgtggaatgtgctaacgtacatgcactaccagctgctgggagtagtagcctccttttcttttcttttttcagaaaaatgggctggagtagtagcctcttgtgcagtgtgtaccatgcatagagtttggaatcctcacctgtaaaacgaaaggagaagaaggctcctgttttctgaacctgtgatgggtagaattccgtctctgtttcgttcaccgctgcccgcaagtaactcaggttcagaaaaaaaaacaccgcagcaatcataacgtctcgacaggcatgcatgcaaggggacaagagcggcatgacaaatattcaaacagaaattggggtcaaagatctgctgattcacccccgtgccctacatggacaacgctacaagttcagatagcaagagcacaaaaccgaaagctgcctggccggtctccgcccctggctcccagccacaggagcaactctctcgccgattcatttgtcatatgtgttcttcctcatgatgtacgcgtggcacgtaaagtattcctatcaactacggagtggctcgaacacgtcggcatactagtatttttgtacaagaagaaataatacagttttgtacacacatgactgattagattgagatgttcttctttttcttggcacaacattagccccgtgaactgatatgcagcataattccagtcacaggagcagactacggcacaagcagggaagtgcgctgtctgattgaaaagtaccagttggctttgtctctgcattgtacagttcaaaaatataggcataggatcactgaagttaactgccattacatcacctttagcccggaatagtgcaacgatttagtgctgatctgttgttaagatcaaaccttaattattgctgcactggatgtccctgctcgagcagatgctgctttttgcatgtgagctttgacctgtccctggtgtgaccgtgtgaggcagacagtaatggaattatttgtttaataattattcaagctgttgatgaacagtggaatctgtccatct

SEQ ID NO: 23209 - DNA, 1501 bp, Oryza sativa
gacgagtccttgatcatcaatcattgagtccacgctccacctccctcgccgtcgacggcgagctcaccggcggaggcatctggctgctgcggtgaaggaacgtcgcgctcgtagggtgaaagccacttggcgcgcatgtactcgggcttgcgccatggcgggaggtggaggccgcgcttcttgaggctggcgcgcgcggcgtcggcggccgcggccacgaggaggcggaggcggtcctccttcccgacgaacaccgacggcaggcgctggagcacggcgcggtacgccttggtgggccgcgcgacctcgaactccgaccggaagtcgacgtcgacgaggatgcgctcgcgctcggcgcggtcggaggcgggagggaggaggacgtcgaggtaggcgtgctcgccttttgggtgggaggaggacttgtcccagcgggagatgcagaccgcggcgtcgtgccccgccgcgcggagcgagtcggcgaggaggcggaggaggtcgcgcttgcgcgcccccgcggcgcggtggcgctcgacgagcgtggagacgtcggcgaggaggttgcgttcccggaggctggcgcagtggacgaggccctgaggagaaatgcgagaaacggtcagcaccggcgttcgtcgccttctcgccgccggcaacgcggcgaacatgggaggataataactagcggtggcggagacaccacactaccttgatggtctctgcggcgtcggaggtggccgccgcctcggcagcagcggggccgtcgtcgtcgtcgtcagacgcctccccgccgtggaagcaattgcagcagcgcgcggcgcccgccggccgctcgacgccgacgccgtcctccaagaagctccgcaccatgccgtccaggcacacggagctcggctccgacgactcatccttctccccgacacccgcgaccgacgggagcctctccgccggcgacacccgcagcagctgcctctcgaacagcctcttcagccgcgacttcgccggcgccccaggggacggatcgatctgccccgccgccgccgccgccgccctcatctcctcacaaccgaacgagacgacagtgcagggtttcactggatgcgggtgcggcggcggcggcgatcgtggtcaccgacgatcgcctcacgcatagccgtcggcggcgtctcactggcttcgatcggtgcggctagggtttgtttttcttttctttttttccttttcttttcttctcctttttttgcttcgaattttcggtgtcgatctgttggaagaagacgaagaggagagcctggttttaaagggatccggaggggtgacgtggcgcgaggagatcggcgtggcatgctgcgtggtcgtgcctatctaaacgttgtcctacgtggcgactgacacatcggtcccaccggaaatgaccctgttacccctgcttggcctttagcgtgtgagggcattgagtgcagtgtcgaagctgtaaatgttgctgtattttgtgggtagt

SEQ ID NO: 23210 - DNA, 1501 bp, Oryza sativa
aaactttataataatgggtagtaactcattaaacaaatatcaaaatgttattccattataaaaaaagagcattactgcatatgtgatgcttataatatgactatatgagtatgagtatggccggtacgaagtgacagcgtgtgacacggttgctttcgcttgcaaacggaagaattccagcggaagaaaataatatttagagtaattaattaagatgccctgaagaagactaaagtaacataattgtgttagtatctccttatacaatgacgtgccatccttagaaaaacttaattgttagtaacataaattggtcgcccggccagcccatgtgttccatccggcaaaaatgacacatcggatcaattccttcatgcgtacgtgcattgaatgttctactagtattcaatggagcatcggatgctctagctgagaggagaggcccagctatgcatggtatctgatttatatagtttaattgctatatatatttgttccatcttaatgtttgtttttttaatgatcattcttttccttgttggggcatatactataagtcagctttaacctttttcccccttccctcctagtcaccttgctgaccaacaacggatgacgcaccaaagaaattaaagcatctatctcattttctttcagaataaaaatgttttttaatccctataaagttatacatgttgccagctttgataaatatatatatatatatatgcagccagcatctctctccctgtgatcaaattaaaactgcacgacaaattaattaatcactactaggtagctagatatgatcgatctaataaggaaggagaaaagaacagacctgaagatctcatcatcattactactaacctgaagatatgatttatatataatactaactatactacagtatgtggcaccaaacaatacctgaaaatctcatcatcattactactgtctttgacatacatatattactccttgttatgtaatctaaacgcgtaccttgtcctattttccatgccagccaagcatccaaccttctcattcttcttttcttttttttttaaagagaaaatgcatatataaagctgatgaacaaattcttcctctatctttttcttaaaaaaatatttttgggcatgaagatgataagttgttcaacttgagtggtgtaagaaagtaaggctaattaatactataatatcttattggcatccttctaattgagtgcacataattaaagcaatgcagaaatacgtacgtaccgcgcgatatatgttgatatatgtagtaaagcaaggaacggaatattgtcaaattgtcacttggaggccaggcatgcatataaattgttgccaccagcagcatgcttgatgccatatagcaaggcgaaagcaacattagcaagcacacatatacatttgcagataggtatagctaagctctagccagataaaaagaagattatggtcaagagatcctgaattaatgggtagct

SEQ ID NO: 23211 - DNA, 1400 bp, Oryza sativa
cctgcaaggtgtagcagtacaagactaccagtattattttagtaataaatcgcgtcatcactgccacgttacggcgttatacgtacgaaggagtagtagagtactccctccgtcctataataataggttttagatggatataatataatattatagtacaataaatcgtctgtccagtttcattatgtcatatccatccaaaatctcttatattataaaacggagggagtagtaagtactggtgctagtgtaaagtcggagtagcgcgatgacgaggtgactcttgattaagggtgtgtttagttcacgtcaaaattaaaagtttgattgaaattggaatgatgcgataaaaaagttgaaaatttgtgtgtatgaaagttttaatacgatggaaaagttgaaagtttaaagaaaaaattggtaactaaagcaggcgtaaatcgcatgagaagtgcaagcagccgtactacgtactagtacactcctactaccacccggagttgtgtgcaacagtgcagctataggctgccgtgtatttatgcgtagctgacgcagccgggtggtgtggtgtgagagaagacgggagagctgcgaaagggggagcacgcatttacgcgccgcggttgcgtttgcgccccttgcaagggccgcaagcgtcacgcagtcattgcagccaagcatgcatgtaccattgtccactgcgccccccaatcgatcgatgaattatgtggtgtgatgcacggaagaagaagggggggggggggggagaaagagtggtgatgatcggtttggtgccatgtaggttttctgccatagggtggtaaataagcgtcagagacctaacgaggtttctcggtgaagtgagaccggccattttctgcgagataagatcaagaagagttcgtactggtaccgatacaaaggagggtccccttcatgactcatcaagtgtgacaccaaacagatcatttttacacagaggggagagcgaaatggctgtctcttttttcccggtcagaaacaaaagagggaggtgtgagagagaagaaaggaaaggaaaggtgcgtgtctgtgtgcgagtgtgagagagaaaggcacggggaggcagttcgttccccttccccctgcctgcttttgcatgcagcggagtacaatcattgtgtgatgcgcagcgggggcacagccggagcacgcaataaagctacgctttcttacccgggtcagtttcagttccaaaagctttttctctcccccaccccggggagtgagccaactcgccagtactactgctctcccttttccaacggaaacccccgaaaaaagacgaggagtgcgatgataaattgataaacgaccggaacagccgtgccgtttcgaactgaaaaaactacggggaggca

SEQ ID NO: 23212 - DNA, 1033 bp, Oryza sativa
aatcatggagggggcagccgccgccctaccccgggcccgaccctcttcgggggagtgccacgtgggtgctaggagcagcctcctccctcaagttttaataccctcaggcgaagagggggcagccgtcactccacatcgggcccgatccccctcggggaagtgccatgtgggtttcggggtggcctcttccctccaaacatgatacccctggaccatattattgacagtagcccccggcgttagccctaaccgaatgaatatagttcttttcgaaacaacagcaagagtgataattgcatgaaaaagatcactagtgggcctgtttggtagccggggctgctgctgcgccgcagcccatagctaatgtgaacagtgccacactcaatatgtgtagctgcagctgcagccgttgtagccggcctgctgaacaggcccagtaacatcataaacaaatactacaagaacaataattgaaagataagtgcagggctcgtcattaccctcaaccttctcctagagagcagaaaaattatcgcgtccgcgctgtggcacaagaaagcacaaaagcataaaaaattaggcttcttagtcttagccgcgtgtgtattcttctcctacaagcatgtgcggtgcggacgggtgctaccgtacaccaccggtccaccaccaccctactccgcactcagtgagtgcctcgctggtcagtgctcccgtccctactccctacaagtcccttcgggctccaaggcgctgcgtgccacagcaaatccacctaccaagcctagcttcttccacatccttcgatccgcccggaacgtctgcacgtacataagtaagcacgccgcaacctttcccgccacccttccgtgccaccttttccacgagttccgcttcacacagcaagctctcctcatggaaagcctcgcctatccacagaaacagaaacctcctgctctcgagccgctgccacggccaaccgccgccatggacgacaaaggcaaagccaaggctgctgacgccgctgctgctgccg

SEQ ID NO: 23213 - DNA, 1501 bp, Oryza sativa
atataatatccacccaattgataagagagaaaccacacaaaatgacatttttgcccgtatcttcttctcccctctttcagtcttcttccaacgctcactcttgcagtgagctccattggcttgcccatggtggacaggcgctcagcgtagttgacggtgcggtcgcacggtatgccgagaatgagcgtagcaggaagttcctcacgaccgtttagataatttaaaggtgacggatttcctcgccgctgcagccataccggcatccaccaccgcgccgctactgcctgactccgagccgacggcgaccacggcgccgacactgtcactgcctcactaccttgcttgttctcctttcaaccagccgccatcgctccatgcgctgacgtggacagactttcagcgccatgccaccagtgccgctctgcgcgtgccccgccatgttcaaggagagagagcgcctccgccggagcatacacgccatgcaccgccaccacctccactgcactctgatgttgcggcgatgtggtcagcaagctccggagtcagttcttgatcatggccagcacaatgccgccgttgccgttggctgtagtggcactcaccatatcactgctgacgccatcgtggatgacgagctgtgaggaggtggctaccatgacggagtcagcgaagtggagcgaggaggagctaggagggtacatgtagccgacgctgctgccggagcttgcgtagcaagtggcaccggtgctgcccttgccatgatgctgctgttgctccgagaaggagatgatgccgaggaagtcctctagcttcggctctgcggcgagcgccgacaagaaatagatggggtgatggggattggggtcggccggtcggggatgtattggggaattgatggaggatcggggaaaagaagaagggcaaaactgtcattttgtatgatttctctctcatcaattggatggatattatattttaatgtgttcagtgtcctacagcaaattaccatatttttgaagtgtctttgggcaaattcacgtttttacagtgtcccacagctaattacacatttttttaagtatcctgtagcaaatttttgccatcagttttttacatgccgtgaagaagttttgtatcatcttgcaaaataatttttcaaacttccaacttttccatcacattaaaatttttctacacacacaaactttcaacttttccgtcacatcgtttcaatttcaaccaaattttcaattttaaggtgaactaaacacatcctttgtttccttctaaatcgcttgaaaaaaaaaggctttccactcggtttttgccatccaacgatcacctgatcgatggaagtgggagcatcacgaaacgagcggcaggactgacacgagagtagtaaaaactgcaggtctgcagccttaacttctcctgtcacccgctaaataccaaaactacccacaaaatacagcaacatttacagcttcgacactgcactcaa

SEQ ID NO: 23214 - DNA, 1501 bp, Oryza sativa
gacgccgaccgtcgtcgccttcctctccgccgcatcggcaccgccggcggaggcggcggccactaggcacaccgccgcgagaagaagcagcagcggagctggtctagccatcgcccaacactgctctctctctctctctctctctctctctctctctctctctctctctctctctctctctctctatctatctatctatctgcgagtgaggaagacggagacagaagggacgcgacaagctctgcccgggatggttgctggccttggccggatggacggatatgtaatgtagtcaaaagcgtagtagtagtagcaactagcaacttggggatgcgataagatggtgacaaagttgaagtgttcgtgtgtgctcccaaggcgtctccgagaaaatgtcgcgcgcgagccgagcgcgcggggccagcgcgagcgatttgtccttgactcccgcgcagcgtgcgctagtgtttttgcacagcgatccggggtccagcgatcgattttgtcctggctctcactgcgatgcgatgcgatccgtgcccacgcggccggcgtcttccgcggcgaatggatcgtgcacgatcgatggtacatggacggcgacggcgtggtgcacggcgaatattcgctcgcttgccctgtgatcttagatgatgagctgaatgattgatgagtttgatgactcgctcgctggttcagcatctggatggcttttgtgtcgatgtgccatgtagtatcatgacctcgtgtctacttttgcccacacggcatggtgcacgtgcaactggtacacactttgccaccgtttgatggaatggaatggaagggagaaaaaagtgtagccgtatcgtcctagctgcaaagggaacgcctgggcaccaccaaatgggcatgggggcaatggcctttttgttggagcaacgtggctgtgtagagaaatgcagcggaagcaccgagcaccgtagtgaggagaaaggtgcggaccacaactccacaaaggcaggcccaaacaaatggcacgcggccctggcccatcatcgacaatgcgacagacaaaaaaatacaagcaggcacgcagacccttcaagacttttaactcgccgttcatcatccggacctgcttgacaaggtaggagaacttgaatatcttaaactaacccaaattaatctgtaaaaatccctacatgcaatgcccgctattctcttcttttcgagattaacaaaggtcttaaagagtaaggaaccacaagcaagtaataacacaaacaggtaaaccaatacacaaattttattgccagttcctccgactgactaaactgacatgagaaggtgttcaggacaattgccacggacatgaatgtacaaatgactggactaaagcaaccacggaccatttatctagacaaaggaaaaaaagccaaagaagttcaaatcggcaaaataaattgccttgtttatgtacacaaccaaactaacagaattcggcagccggagaagcaaa

SEQ ID NO: 23215 - DNA, 210 bp, Oryza sativa
gactctagaggatcccctgagaaattagttggatgcaatccaaaggttgttcagttcgaggatgtcaacaattcttagctagcagttgttgatggaggagtaacatacaatggcatcatcgatgcaatgggagaggatatcattgtgcatatcattttcaaactttctcttcggcattgcttactcaagttctaaccaaattatttgttt

SEQ ID NO: 23216 - DNA, 1501 bp, Oryza sativa
gttggaacacacactgggtctcggccaaaattttaaaagtctcgagctgaataaaaacactggtaaaaaaaaaaggagagagagaggagagacaggtcgcttcctgcttccattggagaagaggagaggagaggagaggagaccgagccggcggcggcggcgacgaggagagggagctgatcgggcggtccccccctttgccgaggggacgccggcggcctccgggttgggtccacttggcagcggtgagcggcggcgggggatggcggaggcgcggctgctgcggcggcggcggctgtgcttggcggtggcggtcgtgtgggtggtggcggtggccgtgagccgggtcggcgccaacacggagggttagtgtgatttttcatcgaattcagctccgtttttcggcggattacgcccacccctatttttggacttgctttcggattcgatgaatctattggtcatcgggtgattccgtttgggtactagtacatgttacctgcttctcggtacatatgggcgtggatggattgactcatttaaggggatggagcatacgcccaccgaccttccttttgtagactcgatggattatctaggctatagctctttgttttgctgcctctcatggtgtgttgtgaatttgctcccagcagggagatttgtccgaggtaggaaacgtttcttgagtaagtttggtaggtgtgatttgtatgtgcacagaaatgggatagcttttttttttagataatggaataaatcctgacagaaatgggattgctaatatctgggatgagtttggtgtgctattttggccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaagattgggagttatgcagatagtattgtaagaaatgaaagtactgtatcttataccttcttgtactcaatatatgcttgcatactttagcctgaaaaggcgat

SEQ ID NO: 23217 - DNA, 983 bp, Oryza sativa
gttatttcctctgagctctggtcagagaggtcaacgccttagtgcagctttgacccgctgataagctgatacgcgtctaattagctctttcggtggcgtacacgcgctgcgctgcgtatctgcatcacactgacctgttgccttgcacaacgagctaactgataattgagctaaacaattaattcaatcattcaacccaagaattcaaatcgaaaatgtttttgacgctttcaaatttctaaaatagcaggcatttcgctatctattaatttaattagtgacgtggaatcgcgtacaccataacaggtactacacacgtttcaattacttatcattttttttcctaagttaaacattactatttttatcaactcatttaaaaatttatagtttactagcatgcgaattgtgtacttataaaatattgctaatagtgaatactaaaactctgtaattatagtttatcatgatgttaaactcggtaattttcttaaaaaataatatttaaagatactcatgtttaacttggaaaagactaaaacaatgagtaatttgaaacatagtgtaaaaatggttagggtgtgtttaagttgttttggtgtaaagtttttgaagtatatggacacacatttgaagtattaaacgtggactaataacaaaacaaattacagattccgcctgtaaactgcgagatgaatttattaagcctaattaagtcgtcattagcaaatgtttactttagcatcacattgtcaaatcatggcgtaattaagtttaaaatatttgtttcgcaatttacatacaaactgtacaattggttttttttttccacatttaatactttcatgtatatgttcaaatatttgatgtgacgtttttggccaaaattttttaagaatctaaacaaggcctggccgatgaacaaatcttctagggcctcaattattaggtttctgggcccgatgcacgtgcactcatgcagg

SEQ ID NO: 23218 - DNA, 641 bp, Oryza sativa
cccaatactcaagcttatttctttgctattacactttaataagataataacccttcggtccttccatttcaaaataactttaagtttagacttggatgttcaaaacaatatagaagaaaaaacaccaaagtgtcactcactaataggaaactagtatgtgtggataggtagataggtaggtaaggataggtaaaagatattgatggaataaaaaaaatcatcgaattgtgaattagagcatgatataggtaagttgataaaggtaaacttattttgacacgaggtagaggctaaagtaaagttattttgagactaagggagagttagctagacttaaaaataagtagaaactaagtcaaaacatgccgcatatgataattttgagtaacatttttacgtgttgtacatgcatgttgcacatctcacaattttttaaaatatttttatgtacatttaagtatacacaacatttacaatttaacgtttgtacaacatgtactgtatatttaacgcacaagcaatatgcttgtatatatgaaaatatggagaaaatagttcatgctttgactctatgaggcattactaaacaaactaatttgcatgcaaagtgtgaaaatttttacctaactttgtctcaaaga

SEQ ID NO: 23219 - DNA, 816 bp, Oryza sativa
catgtcaaatcagtactcaaattagtgatgatggcgcgaagaaataaatcagtaaatctaggataatcagctgatatgcatggctcaagaatgtagatgagggccctattttctccaaggttgctcacggatttactatagaaaaaaagttgatatcaccagttggtggaccttggccatttgcaattattgggctattctgtgagcagcccatgacactgaattatctgtcacttttcatcagtatatgcaaagtcaaatgtactggaaaaaaacagcatgatacaaaacttgcaaaattacaacttgcacgcctaaaacttgctctccatcattgcatctcaagcaagacagttttttcattttcagacgcaaaggaaaatcacggatgtagtactagtactccctccgtcccataatataagggattttaagtttttgtttgcattgtttgaccactcgtcttattcaaaaaaatttaaaattattatttaattttttgtgacttactttattatctaaagtactttaagcacaacttttcgttttttatatttacacaaattttttgaataaaacgagtggtcaaacaatacaaataaaaactcaaactcccttatattttaggacgaagttagagatcagtatagaagttgcacgcatgctaggaatattcaggccaaggagaagatgacaatagaaaccttataggggacaggaggattaggtcatcagatatgctcatatgcaagctatccaaaagtgaccaatggatcgattcccttggcctcacgagtttgtgtccttacatacaga

SEQ ID NO: 23220 - DNA, 859 bp, Oryza sativa
ctcactcagggaagtgaatgtgagtaccgtcatagtgatgctgccaggatgaatcctagggattgctggtattggttcaatggcaactgcgctaatcctaaatgctcattcaggcacccggtactcccttgctctccgttttttttttcttcaaccaaaactactgcaattattatatgtttagtgccactgcgaaacatgccgacactgtaagctactatataagtttctccaattagcttattcttgtggcaacaattcttgtacacaactgcacatgataatacttactcaatcaaatactacgagcaacctggggttgataactaataatcttgctcacttttcagccgttggatggcctggtcggagcacccacaacaccacgaacatctcaacaatctgcaccacaggtttctgtgcctgctcaagctcctgtgcctaatcctgccagtggcacagccaagcaaggagttccatgttattactttcaaaagggcatgtgcgtaaaaggggataggtgcgccttcttgcatttgccacaggctactggaagtcctgcccctcagcacacaacaaaggtttttgctcctgcttctgtgcctcatcctcagttgaagaactcgtggacaaaaccaaactcttctgctcagcagaatgcacctcctgccatatttgacaagcctaaggacagtgctcataatggcaaaactgctcagaagcaaaatttgacaaacagggctggtcactcgtcaggaattattcatgataaaaaaggttcttatatgccatcgggtgtaacaaagaattaccgacctccaccctcaactggagacgatttagctgaaaatggtgtgga

SEQ ID NO: 23221 - DNA, 256 bp, Oryza sativa
ggttctccggttcccgaatggtccaaccatatgggcaagagctttgatcacccacctgacacccttctgatgggcataaggtttttggttagctacaaggcacaagtcgccatcgggtgcatcgcttgaaagggcccaaatgacccctccaccggagacttctccatcagcggtgatcccagctcaaaccttcagatcttcctttggaacggtaccagaccatatatccgctttattggatttgggcctagcagca

SEQ ID NO: 23222 - DNA, 1501 bp, Oryza sativa
attagtacctacacatatggcagtgagactctctctagtaattacagtaagacacacttctcagaaaagaagtacagagcttgcccagagagaaagagagaggtgaagatggaatccatggtagcaggagacctcgtacaggcctacgtgttgaagaaagcctgcaaggagaagatgagggccgaaacaaacgccggcgaggcagcggcggcggcgatgacaggaaagaagacggcggtgggcggtggatcgtccgaaaagaagacggcgcctgaggttagcaagggagaacgccggggattctctgggctgatgatgatgaagaagaaggtgcacccgaagtaagctagcagatcgaactagctagctatcttcaaaccaccactgattgcagatttgcagggcttggtcatcactcgtcagtggcacatagttgttgctaggttgtttttgctctaaattaagcctgtaaaactgttctcgtgtttccttgtttcgctcttaaggagtgcaagtgtataattatggcaatacatgaaggcatgaaccagcaaatttcttggttactttgcaaaatgttgtggaatgttttagtaattttctcggagaaggaaaatgggttttaaggggctgttcaaattgatgtcatttttaatcataccattttttttctgacatagttgctaaaaatatctctacgtttagtttgttgccaaactttagtaaatacatagaaaatcttttggtaaaattttgataatattactaacttaccaaaattttagcaatatttattttagttacaatttgaatagaccctaaaaaatcttcaacacggaagatcctgacttctaaagaaggacatatcattagttacagttcacaagctaacaaaaattgcagcgtacgtgccggccattcagcaagctgcacaaagcttacgacaagccaagggacggtaacagcagcttacctaagtacctcgtgttacttaaagacacaaaacaaatattctagtaccctaaactcctaatctccttttcacctgagttctggaggatttcacgagcatcaaactgcattctgtatccggccgctcttcgtgctgtggtatactgtcctgtctgtgtaagcggacaaatagcactttgggccataagttgggctagctgtgccacgctactttatgggattctttatattgggcctaagtctccttgctaaagaaactatccaatttgattccctcaactataggttgagtctaattcatatccctcacctgcaaaatcaggtataacaacacctccaactattaaaacaagtgcaaaatgattacctcgataatattgatggtagttttcattgacgtgacacattgacatagtcttcatcctacgtgtcaattttacaagaaaaaaaaccatgggaccacatgtcagtcactagggaaaaaaattgcggtgccacttgttagccattcctcctctcttctctctcg

SEQ ID NO: 23223 - DNA, 1501 bp, Oryza sativa
gcgcgccagcaccgtcccctgcgcgcggagcagcagcggcgatccctccccgtgcttcccgaccgcgtccttcaccacccggagcgccttcgcgtggttcccccgctgcagcgctgccagggccttctcgcagacggcccggaccgcggcgccgccatccgccgccgccgcatcggggtggccggccgccggaggggagggaggagtagggtttgcggcggcggcggcggtgttgagggttcgcttctttcggcccatgggaaaggggaacgaatgagattggaggggggggagggtgcgcgatagaaaatggcaatcgaatcgcgatttcgacttggggtgtgggtcccacacccaccacgcgactctctctggaggtaggtttgctgcgtgcggatcggagatcgggccgccgcgggcggagtggtacatagatgatggagagagagagagagagagaaggcaagctgagatagacggttgcggttttgcatgggccgggacgggccgtattttttagtcttcgggctttctttccgctaccggatcggtggtagtgggccagaactcatgggctatttcacaatccatttttgtccatgttagggttattaaatgtcagccgaacctttttttcaactcagtccttatattttacagaaaaaaagttatgttcattaccacccatagtcaccgcacgtagctatatctatgaggataaaagtgcattgaaggtccctcaacttatcatcgagttatagaatcatctcacaaccgtaaaaccggatgcaacgtattcctcaacttacaaaaccaatgtaaactagatccctcggcggttttgaccccggttttatccgacatggtggttaagtcagcatgggacccatatatcaggtgccatatcagcaggttctcttccccgtcctctcccttcctactctctctctctttctcttctcttccgacaagccggccggcggctggggcaaaggccgccggggcgaggcgggagaggaggatgaggcggacgacgaggcggcggctgcgatgcgggagaaggcgagggcggcagcggctgcgacgacgagacggcggctgcgatgcaggagaagactacggctatggcgacggcggctgcgatgcgggataaggcgagggcgataaaaactttctagattataacattttctaaacaacaaatattaataacacctaaatttagcaaatcattcaatgaggggaaaaaaaatcagaaaatcaaccatcagccaaaattagcatgtggcttgcctcccccacctccattccccaccaccaccttcctctctccatgcagcaccccccacctcctcgcctcccacacatcgctcccgcgcattcccaccgcccgcctccctccctccatctgccgccgaggagttccccgatcgcgcgcgcgcgtagcgtagcgtagcctaggcggcggcggccggggccggagggggggacatggcgccgc

SEQ ID NO: 23224 - DNA, 1501 bp, Oryza sativa
gagccattgggtaagggacgctctgcatgcaccattttattattattaattactatgtaattaatcaattcatttgttagagaaaagaatatatatcgatctttcaattcatcaagttaaaattgctagctactactagatatattatacatatatgaaaatgacttgcccgagcactgcactgaagaagagacacaccaagatttcagccgtaagctttggtcttgtcttcctgcatgcatatttggcacatacgtatcaaccaactagtaattaatacacatatatatggtactatacagctgctagctagcaatatatagtagtaccaatactaatcgattaacgcatatatacgaaattaaaacctatcaattaactgatatgcatcggactaaacgaataactgccatttatacaaaacacttatcctgagcacactcaagggaaccatagataggtaagtgaaatccaattcatgaaataatttaatccatggacggcaccattgtggtaaaggtcgtaattcaagtgaatcaaaaagaattaagtgtatatttacctctcccggaagtaggcgattggggcgaggaagagagtggcgatgagctgacggagcgtgatgaggacggtggagcgcatcccctcgttgaaggccatcttggtgagggtgttcatcaccgcgaacaccaccaccaccccaaccattgtcaacgttggcttccaactattacagctacccattaattcaggatctcttgaccataatcttctttttatctggctagagcttagctatacctatctgcaaatgtatatgtgtgcttgctaatgttgctttcgccttgctatatggcatcaagcatgctgctggtggcaacaatttatatgcatgcctggcctccaagtgacaatttgacaatattccgttccttgctttactacatatatcaacatatatcgcgcggtacgtacgtatttctgcattgctttaattatgtgcactcaattagaaggatgccaataagatattatagtattaattagccttactttcttacaccactcaagttgaacaacttatcatcttcatgcccaaaaatatttttttaagaaaaagatagaggaagaatttgttcatcagctttatatatgcattttctctttaaaaaaaaaagaaaagaagaatgagaaggttggatgcttggctggcatggaaaataggacaaggtacgcgtttagattacataacaaggagtaatatatgtatgtcaaagacagtagtaatgatgatgagattttcaggtattgtttggtgccacatactgtagtatagttagtattatatataaatcatatcttcaggttagtagtaatgatgatgagatcttcaggtctgttcttttctccttccttattagatcgatcatatctagctacctagtagtgattaattaatttgtcgtgcagttttaatttgatcacagggagagagatgctg

SEQ ID NO: 23225 - DNA, 275 bp, Oryza sativa
ttatagctcatcaatcaagctatttcccccacatttgctcccaaactggagtactagtcactccctccctataggtatgtaagtccagaaactccagatctacctttgcctcctttgggtcccaatttctgacacacactctagtctgcttgccgcacgtacaagtacgaatgaatgaatatgccgtttttttgacaaattgacccttttcaaaaacttaattcgaaactaacccctgccaaaaacttcaaccaaaactaggccgtcggctcagc

SEQ ID NO: 23226 - DNA, 1501 bp, Oryza sativa
tcatcagagaaaccaacacaggtgcatcatcagggagacagtaagctgcttggcgttcacattgccaatacaaaaaacaaaattctccacgcaggaaggtaacaagcaatccaactcaaccgttgacttgtctttgtacttcggtgcagtttttattacaaaaagcaagaataacattcattggtatgcttacagcgccggctgtcactggaaaagaaaaccattatggagtgtccgagcatttcaaaatgccttgagagatttatggcctacaggaagtttctgatgtccaacttcttgacatcaggcatctcctcgtctttgaactcctccctgataacaaagcacgtcaacgtgttattaacctttttcaatagagacgcacacatgatatgatatgcactggatattagttagcttgcatgcagcaagctgcaactcttattacttctgataagtcccaactcaagcagataaccaattagtatataaagagagatgtacctctttagttgaacctccattgcttcaacacattccttcttaagctccgtcagctcacttttggcaatttccaattcaagctcttcctcaatcttgggaagatcctccttgcggattccaagcctatttgaaattttgaaatggaaagcaaaaaagcatgaaaaaggttagtccaactaataaaaaatatatataacacatctagcatgcacaggaggaagaaaaatcaatatatttccctgcaagccagcaataatggatctcgatcacctaagtacggagtaaaaaacaagctacagttggttacaccatcatctgagagtatatttggtcccttaacccttgttagcgaacaagaaaactcttgctagtgagcaaggtcagataaaataactatacatgccctgaatcgcctttgaaaccagaaaattatcatgcaagcagcttaaggaattgcacgtttgatctatcatgtggatttttattctcactgaaatattcagaaaaagtatatctctagagagtagacgagcagtgtaaatgatgatctgaactatctcaaacttaagttgataacaaaatgatgaagataaatactttttgtttatcttctcaaactctgccaagaggagacccatattcttcttgtcactcctcagaagtggcttcttaatctccttctcaactttctcaagggcttccatcatcatagcctcagcacccatatcatctataaggccactcctatgtaacattaagtgaacagaagaatattcagacaagcaaatagtgcaataaaattgttatgtaggcaaatatcacattgatttaattctttacaagggtattttggggctgagaaaaacataagatgaaaattgtgaaaatgataatagatgtactttatcctgatctcctgaagagtattcaagtaagtccgtgcatcagggatgccctttgtaaaggtgtcgatggtatatttaatcctctcagagtc

SEQ ID NO: 23227 - DNA, 1436 bp, Oryza sativa
ttgcttgactgacttactgacttgaattgtacatatatatctgatgttgtctttccttccttgtcgacctgtcatgtgcatttactctacatagccttcttctaatgcttgcgtgcatgcgtgctaactgttgcaggatatacactccctcattatgtccttgaatttcacccaaatcgagatcaaaacagccaactttctcaactcatggggtgatggtgtgctagttatggtatctggtcttgtacagaccaaggagtacagccaccaaaggaaattcatccagatgtttttccttgctccccaggaaaagggttactttgttctcaatgattatttccatttcgttgacgaagagcaagtgcaacctgcacctgttattgcccaggacaacttcgagaccaacatggcatccaactccgtcgtcgaacctggtataatatatctttgtagcttcataatttcctgcaattttctttttaactgttcagccatatttcttatttctttttcctatttgcgatccatatttcttattctctgtcaatgatctatctaaactgttgtgccatgttattcgtatgttctgaactatgttatatcttctagcatgccttctgtgttggctgtctatgagcaccaacaaaaagtatgttccgtatgcgttgattactgatggtttcaaattgtaatgttgccatggaaaataaaagtcaataccttgcacgtatgaataggcctattgctgctgcttttctaatttttgcaattatgtagttactaactatatattttctacctcaagttccagagtacattcacgaagaggaaaatcaaagtgctgtcccaataacatctgaagaaagtgatgctgttgagaactatacttactctgagccaccacagcaagtagtttctcagtcagacaattggggagatgagcctcttcctgaagaaccaatttcttcctttacaaatggaatggcgatggcaccggaggagccagtgcaatctccacctgttccacctcctcatgtagaggaacctgttggtgaaccagtaaagaagacctatgcctccattgtatgttgcaccttcacttggttgatcatgattatttttctttttgtgatgtcatctcatgcatatttaaaaccttgatggtataactcatgcagctaagaaccgcaaaagctccactggtgttccctgtagcccagccagccccgactagacctcaccaggcaaccgagacaaaccaggctgcacagcattcggttatgacttcgtctgtggcaaccgagaagccaaaaaccgatgtttatggtgaatttgctgtccaggatgatgaaggttgtcctttagtttgagctagcatcataatccctttcactgatttgagttgcacattacccactgacttttaatatttctgt

SEQ ID NO: 23228 - DNA, 316 bp, Oryza sativa
catcaatatgaatgtgggaaatgctagaatgacttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtcttctctctcatctgattcctgcgtttttcctgcgctccaatcaaacgaccattcctgtgtttttcctgtgttttgcaatcc

SEQ ID NO: 23229 - DNA, 1501 bp, Oryza sativa
gaaaaccgcagcaggtagggctcccggcaggtggtcccctgttaagaatccaacagagaaatggaaccaaatactcaagaacagatagatcgacggggattcctacaaattcctccgtcgccgccgccgccgccaatcacctccagattttactaatttgatagatgaacaaacagagtttgcttctgtatttagctctctttctctctctctcacctgctcttgcttacagacaaggccttgggcccttacgcacacgcacgcttacacggcccactccggcccagatactctagtattagctttcttatgtcttcttcccctcccgccagcatcctcctccttggagctgttgccatcgcccggatcaccactgcagacatcctgacattcccccttccttgaaaattggcttgccctcaagccaaagctcgaggaaaatgggaatgaagatcctccaagtcctcccaagttgcttcctcaactggacaatcagaccaatgaattaaagcttgttgaatgacagcattacctgacttacgcacccgggtatccagaacagccacaggaacttgcttctgctcaagttgaacatgaagatgtgcagaagagaatcccttaaaaccccgagctgatttaagttgtgacacgtgaaagaccggatgaatagagctcccagcaggcaatgctaaatgataagcaactgccctcaccttgtgcagcacctcataaggaccaaaatatttgaagctcaatttgtgattggccctggcagccacagaagtctgaacatacggctgtaacttcaaataaacccaatcccccacagcaaaagtcctgggactgcgttttttatcagcttgagccgtcataatttgttgtgctctgttcagatgttgctgcaggagttgcatcattaatcctctatcagacaaccattgctgcacatttggaagttcacaggaattgacagtgatgcctaactgatttggagtgtggccatataagacctcaaaaggggttttgccaagggtggaatgctaactggtgttgtaccaatactcagccaagtataaccaagtggaccatttagaggggcaagagtgagtaaaataacgcaagtaagtttctaaacattgattcacccgttctgtctggccatcagtttgtggatggtaagccgtatgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtctcatatctgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 23230 - DNA, 211 bp, Oryza sativa
tatcgtggcagcgtgaaagcttctcctccaaaactcaaagccgcgtcacctctcattcactctcgctcttgagccgatgaaaccgagagagagagccctgcttctccgccgcccataactccatcgccggccgcaaggatgacgaccgtcgcatcgcctattgagccgcggttgtctcgatctcttgtccgttcccttgtctcctctcagt

SEQ ID NO: 23231 - DNA, 1501 bp, Oryza sativa
cattgcacggcaccaatataatccccatatgctgttcctttaggcattgacgcaacaaaaaagaactcatctttaatatctttcatgtttttgcacatcgaaactaacagaggcaggaactttgtgagctcaacacaacccttatcaccaagattccaatcagcaactcagcagcagcacacaatgcaccaaatccacacctcgtcttactcacgcgcctaactcatgcttccccaaatatattccaagccgtagagtgcaccacaccaacgggcattcgcctcatcccaaaaattactactactacctttttttcttacaaggtacagcaagatctaaccggagaacccgctactaggcgcggggcacccgcaagaggggggcatcgcgggagcgaagcaggaagagcggcggctggggggagggggctcgctgtacctggaggagggaggtggcgtaggtgacgtagttgcggatgaggccctgggtggtgatgcggatttcgttctcgctgatgacggcggcctcgggccgcggcttctccacccgctggtaccgatccatggctactccctccctccggcgaacccccggcgatgcggctcctgcggcggcggcggcgctgctgttgtcgaaggggagaggggagcggctgaggcggtttgggtgaggcttaaaaccctagaaataggggggagtggagggagttagggtttaacggcatccgcgggtggcagccgcaacggatggagagggatcacccggctgcctcgagattcgtacttttattttttttaattttcttttagtactataaggctgtttttgagagagagagaggtgattgagaagattgggaatatacacaaaacgagttgagccattagcgtatgattaattgggtattaactattttaaacttcaaaaatggattaatatgatttttaaaacaacttttatatagaaaatttttataaaaaacacaccatttagtagtttgaaaagcgtacgcgcggaaaacgaaacaaacaaactcccttttgttctaacgcagcctaagtctcgctttgtttggctttggaatattgttatgcttctctatggttattaggataatgatgattagtgttaaatcgagaattgcctttttcaggacacgttttggcatccggttgatgctttattgactgatagtgcttcaatggaaatatggaatttctccttttctttaaagctcccgtgtaaataagtttttttaggttttcaatagattaggtcaccttttcattgaaaaatagcatgtgcattcatatatttctcttatgccaagttgccaactgatgttctcattggttacttacattgaatataactcgcatgtggcattaagggtattgccataaaatattatccgtggcaaactatttattatttttggatagtatcattcgcggaccatccttaccacgaatttaaaaatatgattactcagaaaacgaac

SEQ ID NO: 23232 - DNA, 1501 bp, Oryza sativa
cttcgacatttaaattgctcagaacaagttggaaagcagggttgttaaatccacatgtgtattatgcagacaagttgcttaaagtcaaactgatgaacttcataattgattcgatcatggtcggtactgtagtagtttggatcctctgacagaaagaaaataaaattgctccatttaagtctctgaagctcctgcaacgcatgcacaaatccctaatttactgaaaattaagatttcttttgcttgtcagtttggacaaattcaggccacctcgcggcttgccctaaattaattatctcctagattcctaattagtctcaccggttgccattagaacatgtaaaatggtcattaacagcgatctcacctttactaattaagaatacttacttattgatacgaaggatagaaagaggagagataaaatatcgttattatgggtaacgactcttaacctctataatataaaagcatggttgcatatataaaggtgaaaaatgaaaaaaaaaagtaataaaagaattttttttagctaatggtgagagtgttttaactgttataaagatacgacttctaaataatcttgtattttctaatggatcatacacatatttactgttaaacatatacttatctcctaattaatcccacgctccttcattgcgtgcacaaatccctaaattactggtaggtttttttcgccggaggtgaagaagatccgaaccgaattacattaagatcatgagataggcttcagaagtcatttgccggttgccacaggctaagattatctcgtatgtttaggcggagctacataaaagggattagagtttctaggcacctggtcaagtggcggagctaggagctcgacacgcctagggctcaaattgaaggctaacaactatccatatcaattcgtacttggaagtgcagtacaagtacgaaaaaaaatgcaagactgaaatacaatttctaaatatgcaccaagtacagtaaaagtgtagaaaaagtacaagactagactaaaattttattagaatacctaatgcgacgtatattcatgattttcactcttcatcaacagaaggtagagaacctgaagatgaatatagaaaatgatattacataatgtaagtgatgcaaattatgagaacttaattatttgtagacaaagcaatgcatgacatacctctaggtaatttgtgcttgcgcgtcctcaaagcacgataatgttgtataatctgacgatcttcaatgctagtaaaaacatcccgctcaatatagcatatcatgcagtgattcatccattcatcattcatcttgttccgcatgtcagttttcataatgttcatagctgagaaggctttttcaacaggcaaatttaaggttaattcaattaagtgatacaccaatggaaaaattctctatcactttgaaccatcttaacagcaaggttaccaaggtcagagcaacttgagaaatccaaatcagatctcacatc

SEQ ID NO: 23233 - DNA, 1185 bp, Oryza sativa
tatatagctgccccgctggcttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgttatgtgaactttcaaagatgttgtcaactttaggttgtacgcatcatattttgccaagcagtcggtatatcacttgaatcatattattcggggattcacaccgcatatgctatatattggtatcaagtcacttggttgactataattatcaaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacata

SEQ ID NO: 23234 - DNA, 336 bp, Oryza sativa
atgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaa

SEQ ID NO: 23235 - DNA, 1501 bp, Oryza sativa
accaccacgagcacggcgccgccgccgctactacctcgccggagtagccccattgctcagctcaggctaagtgagatagagttggatatgaagtgatgagttgatcgatggaagcttaattaggtgtctatttatgggcgagtttagtgacccaagtgaccaagtgtgtgtgtcggtccaaaaatattcatcgtattaaatgtggggctaagatgaggccatcgagctagtttgaatggttttgagtttacttcgacatttaaattgctcagaacaagttggaaagcagggttgttaaatccacatgtgtattatgcagacaagttgcttaaagtcaaactgatgaacttcataattgattcgatcatggtcggtactgtagtagtttggatcctctgacagaaagaaaataaaattgctccatttaagtctctgaagctcctgcaacgcatgcacaaatccctaatttactgaaaattaagatttcttttgcttgtcagtttggacaaattcaggccacctcgcggcttgccctaaattaattatctcctagattcctaattagtctcaccggttgccattagaacatgtaaaatggtcattaacagcgatctcacctttactaattaagaatacttacttattgatacgaaggatagaaagaggagagataaaatatcgttattatgggtaacgactcttaacctctataatataaaagcatggttgcatatataaaggtgaaaaatgaaaaaaaaaagtaataaaagaattttttttagctaatggtgagagtgttttaactgttataaagatacgacttctaaataatcttgtattttctaatggatcatacacatatttactgttaaacatatacttatctcctaattaatcccacgctccttcattgcgtgcacaaatccctaaattactggtaggtttttttcgccggaggtgaagaagatccgaaccgaattacattaagatcatgagataggcttcagaagtcatttgccggttgccacaggctaagattatctcgtatgtttaggcggagctacataaaagggattagagtttctaggcacctggtcaagtggcggagctaggagctcgacacgcctagggctcaaattgaaggctaacaactatccatatcaattcgtacttggaagtgcagtacaagtacgaaaaaaaatgcaagactgaaatacaatttctaaatatgcaccaagtacagtaaaagtgtagaaaaagtacaagactagactaaaattttattagaatacctaatgcgacgtatattcatgattttcactcttcatcaacagaaggtagagaacctgaagatgaatatagaaaatgatattacataatgtaagtgatgcaaattatgagaacttaattatttgtagacaaagcaatgcatgacatacctctaggtaatttgtgcttgcgcgtcctcaaagcacgataatgttgtataatctgacgatct

SEQ ID NO: 23236 - DNA, 1501 bp, Oryza sativa
catgcagtctaacaaaacagcgccagttttaataggcacaccgcgcacaacagttcatatcatatcaggctggtttgtcacaaactcacaggtacactgaaaatatgaaacgagtatttgaaatgttcaaaatatgagtactgtttatatttttattcatattttgaaatgttcatacaaaaaaaaattaatactcatattttgaaataattttaagaatttttagttatgtttttttattggcaatgtagatattgtccaagaaattaatggtcatagtcaaacagtctcatagtcatcgatagagtgtcagacaatgtgtacggagtctatattattagtgagccgggctaagagtcaaccctttcccttgatccaaaacattgggcgtgagtgatcttgtctcacgacgtcatcgatcgctgcaaattttgagttcgtatacaaagacttggcgtgcgcgatccggtcatttctcgaatcactagcttctctaggactaacctagtgtgtcggtgtaacaaaatagggggtgtgtttagttcacatcaaaattgaaagtttggttaaaattagaatgatgtgatagaaaagttgaaagttaatgtgtgtaggaaagttttaatgtgatggaaaagttagaaaattaaagaaaaagttgcctaagtaattttatcatctttaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtctcgtaatttatatgcaaactgtgcaattgatttattttcatccacatttaatactacatgtgtgtgtcaaaacattcgatgtgatgtttttggtaaaaaagattgaatataaacacggccttgaggattgtaaaatttccctgataaaatacccataatatttgcattagtttgcgtgcttttgagtttacttcggcatacaaaatattcaaaacaatttggcaaaacggaatggttaaatccacatgtgttacactgacaaatttacttaaagtcaaagtaaatttcagaatagtaaattcggaggagtacacttgattacaagtacattaactaaattgttttattccttgacctgacatgactcatgcacgctagtactcctcccgagttggatcgtaattaaccacgcaactaaattaaccgaagtcgtaattaatgcatgcgattatcgttgatgatcgagattaattagcctaacccctgattaattaaggggttaattaatta

SEQ ID NO: 23237 - DNA, 312 bp, Oryza sativa
atatgaatgtgggaaatgctagaatgacttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatctgattcctgcgtttttcctgcgctccaatcaaacgaccattcctgtgtttttcctgtgttttgcaatcc

SEQ ID NO: 23238 - DNA, 202 bp, Oryza sativa
ccatctccccctccctccccggctctctctctctctctctctctctctctctctctctctccctctcccccgctctgcccgtgtgctgcgcacgcgtgcacgtgagccgcgccgagccgagcgccctccgccctcgctgccgtttccctccgacgccgcccaaatcgccgcgccgcccgttgcttcccgcgcgcgcgcgcca

SEQ ID NO: 23239 - DNA, 1501 bp, Oryza sativa
tgattgtggtccgctttgaagtcagtgactctgtatttactctctggtgtgactttaataatcaaccgcgctggacaaccaattcttgtatccagccttggcttctttgcttccaatgattttttgtccctgttgtaaccttcccttgagcaaacaaaagtccttactttggtaatatttccggaagatttgtgtgatgtacttttccgaacactaaaaccaacatgtccagcatatttgttgtagaattcataggccttgtcctcactctcaaattccatgcctacctcaggaaccagcttagcaagtgcagcttcatctataggtggttcagcttctatcattcgtctcattttcccctagaaaaccaatcatactattacttgagtaaataaacagaaatagacacatttagtattttagattatcatcaatgcaccaaaacaggaggaaaatggccaagagacagctataaaatttcctcggaaatgaattatagctgaacatggtatcacacaacaggctcatcggtattctgtatcgaaaattagagcgcagccatacctttctgtacgcaatgccgcacgcattacagagagttcttgggccatcagggccgcggcgcatatggggcgtcgcgttgccggatataccacacctcaagcacctggccaaacacagtaaaactatcaacacgacaaatggaaagcccaaggttcttttactaaaattcactcgtgcaacaggacaaacaaaatcttctgagcttaaaccagagcacgccagaatggatgaaccccgaataccacgcaaaggcgagacgctacgagacctcgcccacctcctcaccgccgatgaactcatgaacacaagtgacttgccacacacacacagagagaagctctcaccgcacgtggccgtcgaggccgtcgtcggcgttgtcgcggtggagctccagctcctgctcctcggcggcggcggcgccgccgcggctcccccgtacggcggcggcatctcccctccgccgcctccatcgggggccaccagcatgtgcatcatggcatcaccaccaccaaccctgccaagccacactcgcatccaaaaacaacaccaaaaagaaaaaaaaaaccctccccaaaaaaaaccacaaattcaagctcgatttgaaccccgaggaggagccgaacagaggaattccgttggaaatgcttcggctggtcgggatttgggagctagggtttgggtctccgcgagaggttggtagtggagagaggagcccaggaggtggtcggatccgatgcggcgttggggggcatgtgacccaccgtgtggtgccacgtgtaccccctttcccatctcgtactgtatcctgtaccctcacttatcgctgacgtgtggggacaccgatcctggggcccgcttgccaggcggcgccgcatctcgggagtacaagtagccgagagcgcagaagagaaggcggcggcggctgcggcgagtgaat

SEQ ID NO: 23240 - DNA, 1501 bp, Oryza sativa
gaacttagtggtgttcacaatgcattgaaggtggcaaactgttcaacaaaactcacttttttttacatgcattaaataccttctccaatttgtgtgtgcatactcctttaaaatcaaatttaatgcatattcacttcaccatttactaattactgtgatgtttaattggtggtctgctttccccttttttaatgcactatatggtcatccttcgcttgaattagtaatcatggtttgacaggtcatatgctaaatcttttgccaattttcaggcttcaccaattgaaataaatgggcggcagatatatgttgaggagcggaagcctaacagcggcataagaggtggaagtaagttgctcttttatttttccaacacctatgcaatatttgcttgcagactacacacagcttcatggtgtagttgatggtggcatatacttgcgtaagtatgatatgaacctggtgcgtgtttggcattggcaggaaggggaggcagaggtcgtttcggtggaggagggcgagggtatgctagagggggaggcgacaacgaatatgcgggcaaccgtggtagtggcaggccatcaaatggctaccagcgtgttcctcaccatgagaggggcattttggggagccacaacgcaagaaactaaatggttcaccaccccatggtggtggcctggtgggatatgcatatgctgcaagcatgaggttttgatccgtcaaaagggagggagagctgcataactaagaactactgggttgtttcctccgttccgttaggttgctttttttttttggttttgggttttgtcgcagcagcagtttgttgacgaagaatgtgtggtatccaactttggctagacgttttattatgatgcaaatgcccgtccttgatgtgccatgcctgcattaagagcaggagcagcagctcagcttctcttgcgtgattgtttgcaatgcttcccctcgaggtatgctgatcgatttgatgctccgagtttatcatatacccggacttatcgtttagatcagaaattgaggatttgcccccagtcgtgcccatgatatgtgggtcagtggatgaattctcaaattaattctaatttatcaaccgagaattagtcgctgcccagtttgttgctaatactggcataaaatctatcacaagccagcaatgtcattcttttgccagaaaatctatcataagccagcaatgacagtttggttagtgacgaatccaaatttataacgtaaaagttcttttggttagataagcatatatatacttcatccctctcaaaataagtgcactcttcaaattaaattaggagtgcaattttgagggagtacccaataaaaactagtgttctttgtatcaaaatgcaataaagtggtgctgtttgtatcaaaatgcttggttaccatcacacattgttgtttgccaaagtttcgggggcgtaacaaaccaacatatgctttgctcgagtcatactcttatgaa

SEQ ID NO: 23241 - DNA, 1501 bp, Oryza sativa
tctagcttttcttaaagcaggtcaactccaggacagggtttgatcacctgcctcatagtactgtagatgttgattagtcatggtttgttggtggcattgctgatcatcaattctggactcattgtgcaaaatatacagctaggcaattatgaggagaaaaaattggatctttgtcaattagatctatgtctagaaaataacatccactgcatcccccccccccccctcttctaaaaatcctttaatcaatctgaacatgcatgtagcaactaatttgaagtatttaaccaattgttccttggttaaaataagggtcacacttcttcacaaggttcagtttctcaagaagaaaagagtacatatctaccattaaaaatgtgaggggtgcatctctcaatgaaacactggctgatgattccaagcaactgattgattaataaaacaaagaaaccgacacaattggtaggagttgagcttagcatggcacactgcacacagtaatggtcaaagagacaagaaaaagaaaagaaaaaacaaataaaaactaataatctgaacatgctatactgtgcatggcacattaaaacattcttcagtacagtcttctgctttgtatgctccctctgtcaagtcagcctggccttgtgactgaacttcttaattagctctatctcttgtcccatatctctgaataatacaggaactgtacacctctggtatttgactttgttgcggtataaaaaaaaataatatctaattcataattacaaataggtccctcaaatattatgtatttgaaaatttatacccttgtgcttcatgtggtccatggaaaaacatttgtgattccattttgccccccaaaagtaattaactagccgacgccaaagacaagatggagagtgaccaaagtgttcttctcacatatatttaatagaaagttgttgatgctccgattaggaagtatcttgctttgtactcttgcaagcatatcgtgggattgaacaaatccatcatccatttgtctgatcacctttctttcttttttcctccagagatttgatcgactaatccgatcaggtcgagctttaagattcgtgtccatctccatcagatgattagttggttccctgtcagaattcagaagtgattagcaaagctgaaaacgtgtcacttatctgggattttggggccatctctctttccttgcttgcttaacctgttctgtttggataatctcgagttagtacatatactaataaagctaatggtttcttaaacatcatgattaaattctgagttagtctgaccatccgtctaaaagaaaattcagagttaggggctgcttcaatgatgagtttcaggaaaaaacagaatgggtggcatacttatcaggtactactcctattcaggtttcttcataatacttgaagtaatgataaagcaatgatgaacaacttgggtactagtaacactattactcaggaaaatgatgcacata

SEQ ID NO: 23242 - DNA, 1501 bp, Oryza sativa
tgcatcagggatgccctttgtaaaggtgtcgatggtatatttaatcctctcagagtcggatagaagatctgccctgcatttacacaatggaaccataactgagtaaatagatcaataacatccagaataagtgttacaaaatgaaagcaataaagtggaagcctatctcgatagaagtatatatatatatatatatatatatatatatatatatatatatatatatatatatatatatatatatatatatatatatatatatatgccagagtatgttttgctgcataggatggatgcattaatgtacaagtaaaatatttttttattttcgatggggcatcctacatcaatggggaagatgaaaaattgtactagggcaaaccggcaaacagtagtaggtaataagtaatatcaaatgggagttatttctacatatatactgaaatatacaatagtgcttaatgaattcaaggtttcgtaaaccgcaaaaaatctgatttatttaataaaagaactttacgctagagaatagaaacaatcaccacaaatatgtgtaaaataaacacaaaaacaatgacaaatcaaaggaaagtaataaactaaggaccatgaatacatgtgacagattataagtgatcttacttttgtcttacagtcttcatgacttgggcataacgagaaactgctgcaggatcatctggatcaatagtgatcttttccttcttaagtacaccaagggcagtctcaaatttcttctttacctcaaaaaatatgcccttcaataggtcttcatacatacaaaaaaaaaatcagaccaccaaaattataatacaaagtaaattgtgcaacttaaatacagaagtaatcagaactacacagcagagtttaatcaaacaaactccaactcatgaacatatgtaatctcttcagttttgcattgaaaaacattttttgaatgacataaaaacacataacattacttgtgatactgcgatggacaaaggtaaagtacagaaagcatttttttctacagctcaacacaatggtcttatggaaaggagttttgcagttaggattaaaagcatttgaaattcctacagaatttgcacaaaataaattgttaaatgcacttaaaatttaagaggcttaccatcaccattgacgggagtacgatctgcctccttggcatacaagcggacttgagtggcacctccatttgccaaggcagcttgagcagagtatagctgccagaagccagagacattaaccaatgacaattaacataaacaaagttataaaaaaagtagagaagctagagatttctaaaacaaaacattccatatagctttgtactgacaactttaccaacatggacgtccttattacataacatatacttcctccgtttcacaatgtaagggcccctttgaatcgcagggtagaaaaaatggaggaataggaaaaacataggattctgacaggaattgaagtgtaaaacaga

SEQ ID NO: 23243 - DNA, 205 bp, Oryza sativa
aaggttgatgtggcaatgctgacaggtggggcccacgttgactcacccgccacgtcagacaaaaccagggtcaaaaccaccaaaggaccttaagcgaacggttttgttagttgagggacctccggtatctggttttgcggttgggggacgattttgtaactcgatgacaggttgagggaccttcggtgtacttttccctttcaga

SEQ ID NO: 23244 - DNA, 1501 bp, Oryza sativa
tctcccccttagttggagcctgcaagttcaacgggaaaaagagtgactgattgcatccacagcttgtggcagatactaggattctgaacagagttgtaatatgtcacaatcaccaccactacgagaaaagccaattatgtaatgaaacggtttcctgaaccctgtggatacgaagcgatacatactatactaaaaactttaatatgctgacagaaatgtagatttgtatgttcatgctttcatattgctattctattcttgtatcagtgactgtatagaactatagatgatacagtagtcacatcgtatatagcaagaatcgcatagagaacaataagtaaacaacacaaatacactgacctgaaaaaaagcagcctctggatggccacagttgtaacatttaatacttctggtgcgaggcagggtgggatcagttgctgcatcttttaggatatctttgggttccccagcaggtttacggagaacccttttgtacacacaagtgtcagtggcaggctcctgcttatatgaacgatccaaataaatggaaatcattagtcaacctacaagaaaacttacacacaaattttttaaaaatgtcggaactacgaaaactataaatgcaatatagctgcaaagtatgtaagccttgagaaaaactcagcaatcacttcaataaacagaaaaaaaagagaggacattttgtggaagaatgcctaaaacaccaaggaaatctgtcttatttctatcctgattacattggttcttaatgaagttaatatgtttcagaagctacaacaagggacatatcaaacttcttttaagggacacttagttgtgatttgttacattgatacctcaggtaggttgttgcagtgtgcataattctggcatatgtttgtctctttccaatgagtaacatcttaagcatagtttgtgattacaagacaagttcctgattttctgagggcattgtatgccagataagctagaaacacttctcaaggaaagagagctaaagcccttgtaatatacaggctctatgtgggagtagatcctactttcaacagttctctgaccacagattttcagcagaaagttcatctcaaacggctagtgggaagccacttatgtaaccttaatccttaacttgaaagggaaaattggtttcataccacccgaaatatttcccttttagtcttaccaccaaaattttggggcatgctttgataccacctaataagattccgtttctttttttaaccaccagcacccattgccattcaatttttttttaacctctcctgctccgtatcgcccattacaccctcatatcccgcggtcccattcatccatcacacctctgccttctgcgctccccatactcccaactcccaagtcagcaccttccattagttgaaggaggcaactgagtttgtgaaatttattgctgaatccaccaaggatatctccttgtatatgctatttcaatgctacctca

SEQ ID NO: 23245 - DNA, 302 bp, Oryza sativa
ggactttattcggccttttactcttttctatgtgcattacaattcttggaaataaaacaaaacctcttgaatcttgatcctataagacagtaacagttcaacaataattgacagcagcaattagtgatcatgcttgtagatgatttccacaagatgaatcaatttctttatccatcatcacacatcttaaactgattaagaatcatatgaaacaaaagggcacatctagtctagtaatgtatctttagtaaaaagacatagttaacagcagtgatgtatattttttttactttctttttagg

SEQ ID NO: 23246 - DNA, 1501 bp, Oryza sativa
gtaactgccaatttctgattaacatttttttaccattttgtactgtttctgactgttaatgtattgctttctctatacaggtaaagtagaactatagaagtttacttttgaatgacactgttttctttttttcttcacgaaattaatgaaggaataaccaagttgggtaaaagagtactgctagtgatttttttttcgaaaataaaaggataagagtgtacaattgttatacttgctcaataggctacatattgaaaaataggatccctttaaacgaatctaacttttatgtaacaaaatcaagaaatggttaagtttgaaaagatcggcgtcttaattctgtttgctataaaccaaagcgaaacttgattactaattactgtgcgctaacctattgcatcgtttaagcccatgctttgctttttaagattgtttaggaacacaaatgaactcagtgctggcatactacatgaagagcatccatagaacccttcaaaagcaaagaacatcccatagatactatgaaggagattaacatgaagagatcatggaacaagaagtcacggtgatgattttccttgcgaactgggcatgatacatatatgctcaagaagatcatggagcaacaagtaagaaacactgatgatttaccttgcaaactggccaaagtctgttagctgatacatagagagctcatcaccattcaggtgatttctgcaacactggagctctctacgtagttttgcatatgcagaaagtatgcatgcatggaaacagaaacaagcaagttctgcacaaaactcagagactacgagaagccattggttacctggccatctgttgcttcccttgcttcttcttccgtcgccattgctccagatcaggacgggaagaagatcaggatgggaagaagaaaagaaagtgaaaacaaaagaaagaacgaaagaaagaaagagaggcttcttccctagaaagtcttgtgggtgcttgaaaagatggcggtctttataccaccctttcttctgtcgatatattttctattgctgagcagcggttaggaaagcaatggcagactgacactgctcttgattggcggttagcgctttgcttaaccataatctagattaactggtagaatgtatcgctgaaatggttgatcagtgaacatggaaacttagcattaggtgccaaaatgccaactggtacatgaggcacatggtagtggtggctggaccagtgtgtctagcattcttgcattgctggacccacagaaccttttctgtgtgaaattattgcatcgataattgctctcaagtatcatccttggatccctatctttcattcttttttccttgagtgtacctcggaagaaaagtttaattttcagtgtaaaaatactattatctgccttttcttttgttgcttggctttacatataacataacatgattgttcaatattccctacaggtgcaggtcatctcataccagttaggctgcca

SEQ ID NO: 23247 - DNA, 307 bp, Oryza sativa
ttatgggcgatcaactagccatcgtgattagactcaattctattaattaatttaacttaaagaactggtgtagttcaggtggtttggttgggtctgttcaatgtggggtagcattgtccagtggagatttaatattgccttaattaatcaatagtttttctgctttcaactataatatgtttgcaaccacctttatgcaaatagccacaaacccttctttgtctccccttgcacgtctgcatcatgggtgtggcttgctgagtacagtggttgtacttagccttgctaattattcccccttttcaga

SEQ ID NO: 23248 - DNA, 922 bp, Oryza sativa
ataatgttatttctagattgttttaaatggatctccgtttataaggttgttacctggtgggaaaatttttaccagtatttagttattaagagaaatttttttctctccatatatacatgagttaggaaatcatgtaaagattctcattcacacaaaagcaaataacatgaaaaaaaatagagaaggaattgagaatgaatttagctaccaaatatttcatttttttcctttcatctcaaagaagatatatggacaaaactttttgttcactgatttatgatttatttaagaagagagagattggtataggtacggggtgacgtgcttgatttatgtaactaaggataataggagaagagggacaacgcgagcgagtttctcctctaatcgcaaaaacttgagagtttccaactttcaccatctgagaaaattgtagaattggtggaggttggaaacatgtgctgactaactaattgtagaggattgggtaggtttgatttcaaaatttgataagttagacgataaataaaatcgtcaagaaagggatctcaaatagctaacatttacgtcttaaataagatagatgggacgctcctccctagagtagaccgtgttaaatgcttttattttcatctaaaaggtacaaaatgaccgccataaatcctaccagcgccgccaccgccaaacaaagcctcccaagcacataataacttgtgtacactcttggtgttgctttagccgcgccgaaagtaccaacaaaattaaaggaagcaacaaataaaggcatttagaattcctcaccaagcaacccccttctccccccaaagctatataaacccacaccgcctcaccctcccaatctcaccattttcactcactcactcacactgaactcctatggcctccgccgtcgtagccaagc

SEQ ID NO: 23249 - DNA, 1501 bp, Oryza sativa
gcaggaagcaactttggattggcactgcatctgcattgcatacagaaaacccatccatcgcggattctgcaggatccacggaccacggtcctccacgcacaatgctctccatccccgtcgcgggcgcacacccagcggcatgaaatgtgagagcgggcggcggagaactatcgtcgagcaggtggcgggcatgccgtggaggagacacacggacctgctaccgcaacggcgcttttggcacggggcagtgctggcggccgcccgccgtcactcgttcttcaccccggggtagcccccggtttcacattgcgctcgtcccctcctctcccgagcttggcgaaggcggcggcggcggcgcagccatgagagcgggaacagccgggaaggcgaaccaatcgcaatttccccattaaccttgttcgccatttacggcgacgcggcgtatggccccgtcaccgtcaggcgtagtatgccgctacggacaagagtgttttgcacataaattcaaatttcgttttcatattataggatgcattttgatttgcggagtgttcaaaaattagatttggtcaataattcttgtacaattgatatttaggctgcgtttagatccagggtgaaattttttgccgtgtcatatcggatatacggatagacatttgaaatattaaacatagtctaataataaaacaaattataaaatctgcctgtaaactgcgagacaaatttattaagtctaattaatccgtcattagtaaatatgtactgtagcaccacattgttaaatcatagagcaattaggctcaaaagattcgtctcgcaatttacatgcaatatgtgtaaattagttattttttcgtttatatttaatactccatatatgtatccaaacatttgatgtgacgtggtgaaaaattttgttaggggatctaaacaaggccttagtagggtataataactacaaaaccaacataacaaaagttaaatcctcacatttttcataatatatacttgcattttgcatgcactaacgtttgaaatttgttcgattttcttttagctaggccagaaactgaccttggtgaattggtacctactccctccgtcaccaaaaaacgaatagacatatcctagtacaacgaatttggacagggatatgttacaattagttgtacaagatatgccacatccagtactaggttggttttttatgggatgaagggagtagagaggaaaatggaagcacgggtgatccatttgaggccaaaactcgacttaaattttgaatttgaaaataaaaagacatgtgaaaagggagcttgtacattagcttcaagtacatgcacatttttctagaaaaaaagatgtaaggagagcaggggttcaaaactgaaaatgcggtagcaacaggtgcatcctctcgaaagctcttgcacaaccaaacttcaaacaaacagtacaagtaattccaaacgagcacccatattcagacttcggagta

SEQ ID NO: 23250 - DNA, 1501 bp, Oryza sativa
ataaatccggagaatatttaaaagaggagggggaggggagcagtcgcggtggggcccaccaccccctcgctccgcacacgaaccacgtgcggaatccgcgcatttagtactcgcatcgtcccccccagcccgcgaaatgataccgaattgaataaaataatatttaaaagaagaaatctgttactccgttccaaaatacagttacttgtaataacaaaatattcttctatagtaaacctatttatccatcaatatccttctaacccatcacaaagttcacaaccctcgtccatttatttcattcatcttattttttatctcaacaaatcataatatttctccaataaattttacttactttcttaatacctactactatgtctaaaaaaagataaactttagctacgaatctagacacgcatatattcgtagcttacatacgtgtctaaattcgtagctagaattgaattttttttaagacgctagggtaccatctatctattttataattatttactccatctgtctcagaatataacaaccaatgattgatggtgttcatcatctatctattttataattatttactccatctgtctcagaatataacaaccaatgattgatggtgttcatcattggttgctatattatgagacagggggagtatatttctagaacagatgtaactcccttcgttctaaaacgtagtactcttattatgatataataacaaagttggatagagatgaatccagtggtaataattgagataaggtaaaaggtaatttataagtagtattttggaacgaagagagcaactattttctccattccaaattaaattatgggataaacatatcgtaataatactataaatttagacatatttgtattactacaatatgtcacattgtgttagattaacttattccagtacggagtactccctccgtcccaaaaaaaaaagacaccctggcttccatgcccaacgtttgaccgtccgtcttatttaaaaaaattatgaaaaaaattaaaaagacaagtcacacataaaatattaataatatttttttatttaaaagaattataaaaaaatttcatacaagacggacagttaaagttggacacgaaaatatatagggtttgttttttttggagggaggaagtaggtaattaggagaagaaaaaaatgggaagaaagaaaatccgcgaggttaaattgaatcgaattgagtggtgaccagaaaccgcagcggctgcgtcgtctccgtctcctctccttgcttataaacgctcgcgcacgagcctctctctctctagctctcgctctcgcagctcaaccactagcagcagcggcaggaaggcgagaggaggaatcggaggtagctggacggcggcgaggcgacgacgagccggggtggtgcagcaagaacggcgcggcgagcggcggggaggagagattggatcgacgccgggtagttaggaagggagcttggagaga

SEQ ID NO: 23251 - DNA, 514 bp, Oryza sativa
tgttttgtatatgatttactttcacttacaaaccaacgaaaggaacatctgatgcttattattttcatataaatcaaatgggtattttccttgatctttgtaagtttgtaattaggatgtactatgcgcaatgcctctcataaaatggtggcttctgaaacaaaaaccaaactaggcttaagatataacacggtgtcttcttaaaaaattcgaacaatacattatgtattatttatcattgttgtcatgccatacctttggcaatctcatgctgttgatattattgctgttattattctttatattatgtcatatgcattatcatatcttttgtgcagactacttgaatcagtacatggtggaaataatagaagatatgaagggattacaccacttgatcagcaagaccagttattcactaaagctattgattttcctgtaaaggaatcacatgcatggactgaaaaggttatatcttttacctgcttatttatttatctatgtttagagcagc

SEQ ID NO: 23252 - DNA, 497 bp, Oryza sativa
ctgtagcaaaagttagcaatttggcatttatcatttagaagtctatagtagcaaattttgccaaaaagtacgtttagagccgtgctctctctttctctctttactagtaaaatgccaacactttaccatgcatctaaacaccaactagcaaaacttcaatatcaatcttttgcaaaaaaaaaaataccacagcaaattgacctaaacaggctcttagagaatgtattaggaagcatattcgtgagaatgtgagtgtggtgttatctatatatagtatatagtatagtatgcgcgcgcatatatgtatgcattgtaatcgtaaaaaagaaaagaaaaagaaatacaacaccattatcatcacagagaaggaagaaggggctagaagaaaaggaatgttgttgtttcggcccaaacaaaaatcaagagcatttacctcccctctctctctcttttccggcacgcccaccgctgaacaaaaaaagaaaagaaaagaaaag

SEQ ID NO: 23253 - DNA, 1501 bp, Oryza sativa
tctccaccgcacctcaaggataggtgcccatgattgcaggcaacgctccacgcttcaagatcttctcaaaaagcagtatatcttccgccgggagttggtgaaagatatgttcaaccagttgatggaacaccgcgccttgaatctgcctaaaccacggagacctgaccaggtaaccatgactgacaatccattatattgtccttatcataggtatgtcggccatgctattgaagattgcatcgccttcaaagaatggctccaaagggcagtcaacgagaaaagaatcaatcttgatgcagacgccatcaacccagactaccatgccgtcaatatggtgtccgttgagcctttccctcaaaaacaaagagaaggtaggcgtgcaacatcatgggcgccgctagcccaagttgaagaccaaattgcaaaaataatactgacgaaagcacccgccactcatgtggaggctagccatggcgacaacaaccgaccatggagtgttgtgcaacggaagcctcaaccattgagctttccaccccgtcgcccacaaatgaagttgtcaccgcatactcacccaacttcaagaagatggctagacccaagtcagcgacgtcctccacctcgatttgtccccttctcagagggagacaagtcttttccccgctggggtcgtgagctacctactttggcgcaatttctgcccaagggttgggagcaatcctcaataagcacaagggaggctatggaggtggacaattccaccccgactccaaacattgctccatgcaatgtcatcctcacctacaatgactccacaagtaccggttccgatgaaacgtttacgggaagggagcgagaaatattccatgctgagttggatccagagaagacgaaggtagaagaggtcaacataagcctgcgaggggggaagaccttgccggatccccactagtccaaagctccaaatgtagacaagcctaccaaggaggcctctcctcctggagaagctccagaaacaaaaactggaagcaaagagaagcctgctgtcgactacaacgttcttgcgcatctcaaacggatcccagcactattgagtgtctatgatgctcttatgatggtgcctgatctgcgcgaagctcttataaaggcgttgcaggctccagaagtttacgaagttgatatggctaagcatcgactctacgacaaccccttgtttgtgaatgagattaccttcgctgatgaagattgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggca

SEQ ID NO: 23254 - DNA, 760 bp, Oryza sativa
catccgattcgtcgatgatattttttgttttttaatatacgatgatattaacttaagattggttatttgttaaaaaaacttaatgtttgtatgtcttataataaaaaccgacgatgtaatttatttttattatccaaaaatttgttttattaaaaaatatgtaattaccatttatttgttgtgatttgtttttataattaaacgtattttaaatgtgacatatattttttatatatttgtataagatttttaaatgagaatgttgattaaacgtgtatttaaaagttaatgatttggtattaggaaaccagaaggagtagtactgagttagcaggcagataattacagctgacagattaaacaaatacagtgatccactgattagatgctaattgagctttcctcctgggaatgtgtgacagctagaggaataaggaatcgaagttgtcaaaagatgtgctttgacattggtcttgtagacagaggtctcatgtggataatcttgtaaattaattagtagttgttgagctttgctcatgtcacatgcatgatggagttatctgcatccatccatgcaaagcaaatcagcaaatgcatgatatattgttgcaagatgttgatctgaatgatggtaacacaatggcatattatttctctctctggattagcctgaactctgaacaaacaacatatgtcacagcttaatccattctctgaggttgacacattatgagtgacaaaactgtgacaaactgacagc

SEQ ID NO: 23255 - DNA, 1501 bp, Oryza sativa
tctgtgaatcatatggacaacaatgtaaaatctcatagtaattcttatttaggttgtttgcagaaagttaatttgggtcaactgaaatgaaagcttgtctgttggctctctcactgaattgaccccattgtaattaatgcatataattggcctatatattacactttcaatatcgtaaaacctttttctttgtacacttcacctagttgatctagtatctgccgggctcatcgggcttatcttgtcaatgaacagtaataagagctatgtcgggctgtttgctgtgtgcttctgttcaaccaatttcgacacagtgtactttgcgaaattgggaattgagatgcttggtgtgaaaattggctgtgctatcatgatgatggcccatgagcccacgaaacctcacgactcttaattcatttacttgtttccggttaagagaaattgtttcagatatttacaatgtttttgaaatataagtttaatccgtctcaaaggttgttttaataactattttttctctgtagaaattctgataaaattataatattatgaaactttttttaggaaagttctatgcatataattgtcatgaatttaatagaaatgtttatagtgaaattaatgtcctaagattcaaacttttctcttacaaatatactccatgctatgtttttaccaaaagatcaatgaggtattagcatatagtaaccggctcacaggcgctcgtgtccgtcagggcgctctaaacctccatcgcacagtttctatccgatcaccttcaccctccgtctccagtagtaggatccaatctttcccaagttttttttatctttatttaagttcctatagaattaggtctattaggttgtctagggtttgtctttcaaatttttcatggatcagatgtgtagtcttttgtttcttctatttatttattctagttaccttattgaggttctcggtgaaaaactagtaagatttgtatgtcgggttgtcgatgatcaagccagtgacacgctttaaggcttgagtcgctaactttttcgtggtgatggttagttgttttgttgtaggaatagagatggtagcatatactttcatattcaatgcttttgtatgtgctggaatttgtcaatggtgttggcttcacatttgctaatgtataggaatttcaagacgtggaatctctttgggctgtgttgccagatcaaaacaggcccaaaaagttttagagttagacaaatatataatacgtttattctgtgttgaaaatattattatatttttttataaacttaattaaacttaaaaatgtttgattataaaaaaaattaaagtgattgtaatatgaagagagcaagtaaatataaatgaagtgaggtccacacacgttgacgaggcaacgagatacggcaccaataccaatctctgactcctccggcctccggcggccggcgagagagatcccaccctcaccgacgacggcgagcgaccaccatgt

SEQ ID NO: 23256 - DNA, 1501 bp, Oryza sativa
gcacaaaactagcatattctcgcaatatcgccttttatgacaaaagcatatgtgcatgcgcaattgcacatccattctggtaagcagtgttccactactgacaccgtgctaaattactgttgcaggagaatcggttgaaggaagtgcaagaaatgcaaatgaattgtgagaaagggctcagatacatggcttgcgaggctccattagtaggaccaatggctgaattatggttagctcatcatcacctctcaacgtattcgattcgatccacccttttctgttagatgagacttagttgaacaaagtactcaaatatatagcaactaaatgtcttactccctccgtcccaaaatataagtatttttagctatgaatctgtccagattcatagctaaaaatgcttatattttaggacggagggagtagtttccaagtcatttcactttatgcgtgatatatcttactgaaatactactactacgatgtctttcaggaaactgaagaactcggagactcctgagagcgagtgggcagtgcaagctgctgccgcttccatctactcgacttgcaacctggtcatgagaaccgagaatgtttcttgcttctgatctcttctcacaactggaattagtttcttgcttcttcttttttcttttctttttcattttactgatctttacctcagtcagcgttgtgtgttaggttatgtttttttttctctctttatctatagcctggcaatgatctcatgttgagtaaatctgcagtggtttgtgctgcactgcttcatgtaacgtgaaatactctgtaacgtctgctgtttccaacttacaatttcacagccgcgtgaaataacaaatttattcctgtatattcaccctgtttcaaaatgtttggagtggagtaagcttgaactaaaatagtctgtgattaattaagtattagctatttttttttaaaaaatatattaatttgattattttaagcaactttttatagatttgtttaaaaaagcacaccgtttaatagtttaaaaacgtgtgttcggaaaacgaggcagggttaggaacccagaacaccgaactaattaagcgcaaatttcagaaaaaaaaaggtacggagtataccaagagcaagtttaatagtatagccaactactagctataaatcatctatagtcaacttaatagccaattcatacaatagttacgtactacactattaacatctagtcccacttatcatacacacattgtgtcttggagtccgtgctatagctggctacaaatctgtagtatctgctctaagcagcaagtggaaatacggacacaaaaaatgtaacataaaaaatgtaacatggccgggcccaccagtcagtgtcagtggactgggccgttgaccagacgtgtaccccaccggccagtcggcccgggccggtttaaaccctctccgccgccgtcgccccgcggccgccaccttcccatgtccacctcccccaccg

SEQ ID NO: 23257 - DNA, 835 bp, Oryza sativa
ttatcaattatatgcttatgcatatccatctatccaaaatagtctgttctaaaaaaactatccaaaattgtccatttatgcttgtgcatcttgttgttctctactagctaggtagcctttgatgatcctacattatttggtagataatataattaatgtaagctatgcaaattcaaagggcgcgtagtcctagctagcaatttggcaagtgaatgcatatatactatggttgaatgcatgggtagtggggtgcctcttttcccacaaattgcttattggctgcatatgttgtctcctccaatccaaaggcaggcgcactatagtacgatatggataattttcatgcaaattgatactactagtggtatagtgtagcaccacgatcaaattgacagttgtacggtggcgtttggatgcaaattgggcagcaacaaattaattgcatgggcactccacgatgaagagcagtggacgaaaacattaatgttgctgcagaatactttctacattttctttcctgatttccccgagttctcattattttttagcctgaatttcaaagatggcagcgttaaccctgaattcaaaaatggccagcgaatttgcctgaatttactgttgggactattctgtgaatcatatggacaacaatgtaaaatctcatagtaattcttatttaggttgtttgcagaaagttaatttgggtcaactgaaatgaaagcttgtctgttggctctctcactgaattgaccccattgtaattaatgcatataattggcctatatattacactttcaatatcgtaaaacctttttctttgtacacttcacctagt

SEQ ID NO: 23258 - DNA, 1501 bp, Oryza sativa
ttccataaccttggactgattcgcgagacgaatcttttgagtctaattacgccatgattttaacaatgtgatgctacagtaaacttttgataattatggattaattaggcttaaatacttcaaattcgtctcgcggattagctctcatttatgaaattagtttttttactagtctaggtttaatactccaaattagcgtccaaacatccgatgtgacatgggctaaaaagttttagccccatctaaacaccccctcattcattcattttttttcatctggctccagctcacatgatgtatcttggtacccaccaaaccacatgcttcctggtgattctgctgccacacatgaatctgatcttccagtgggtataactggagtaacagatcaccaaccactcccaacttgtgattgacaattgtaaaatatatatacacataatgcaccatgctaactagctcatgtaagggtgcgagcgtgagttttgaccgtgtgcatcctagttatgtagagaccagaccgtgcttagctcagtacaattgtatttcctcgatgtaattggctaagttaaataaaaacttactttgtctaaagaaaaaaaactggttcatgtacacacagtctcactatacatacttagggtacactacatcatactgaatgcagtgaaatggaatggaatggaccactgcagctgcagtgcagtggagtgcagtatctgcagatgcaattggtgcaatggacctggctagctgcaatgcttgactcattgcctgggaggttgctacattgatggagtagagccagctctcaccccagtggagattgcagaggacatgctgcaaaagggagggaatcaagggccaagaaggtggtctcacctcacctcagccaccacctttcctctccaccacccacatattgcattgcatacataagagggaaacaaatatcaccaagaaccaaccaagaatattctccttctccgtctccggccgccattgctccggtcggccatcgccggcgatccagatgagagttgagcttgatggttttgattgtttcagagcctgcagaaatgtagctttgggcctcatcgtttgccctatggcttataagctaaagccaaaatttgaattttaaaacttgattttgaatttgaatttgatcctttttcaacatagtttttttttaactttggcttttcaatcactaagaatatatatacaaaagttttactcacatatcatttttttaatcgctaataaaccgttatggcttataataagactagaccaaccgatggggaccttagctgatgttctctgaatgtgagtacaaggactaacaagtctagtgacatcctgaaatatatgagtattattggtttgaattgattgggatttcacttgtattaaatgacatatgttgccaagatttgttctctttggtcaagtgaatattacacaactacatttctgttttgatccggctacatga

SEQ ID NO: 23259 - DNA, 269 bp, Oryza sativa
agggccggggccggggtttgtttagttcaactaagctttcgcttcaaaccagaggggaacttattacctgggtatcccactgctacatgaaacaccgacccccccttttggggttttcccaaaaaaaaatccccccccaacttagtggcttccccagtacataggctgatcctgcctttctttttatcgtaagtataattacgccttcactaaataactatactagttttactcggtaccaatgtttatgttgtttgcttgcctgcagg

SEQ ID NO: 23260 - DNA, 652 bp, Oryza sativa
ccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgt

SEQ ID NO: 23261 - DNA, 185 bp, Oryza sativa
catagttactctacaaatttgtactacgggggtagagctgggtttttgctgctccacagctccactccactttaaaagacacactaccctttaaaattttagtgtatttacatgaaaatgccactgaactacctccaccaacctccccctcccgttctctctccttctccgtctccctcccgagc

SEQ ID NO: 23262 - DNA, 161 bp, Oryza sativa
ttttttcccaataagccagcccattaagggctttttgtgggtctattcttaaggaattttataagatcctatgttcaatcattatttaattggttgctatagcgtccatatacacatgaaaaaattgtcgtaacatgacggatatcttcactttggacagg

SEQ ID NO: 23263 - DNA, 1501 bp, Oryza sativa
gtacctcatacttgaagtcagctccagcttgcatgtcagtttccactgtcaaatcatgtttcagaaaaaagctataccacctcaacctcttctttttctttttttcttaatgagcgtatcaaaacaatatgaagctctaggcaaaagataggagcttacagttgctaggatctaggaagccaatggccaccagagctccaggcccaacatgagccaagaatttcctccatcttggctgttccacccagcaaaaagtaagcataggattgaaacaagcactagcttattgtggcattagaactccatgaatgcgcaaaatgtagtcgcttacctgcacccgaaactgcccatctttttcactgtcaatagtcttttctttgtactcatcagtctcactaacactctgcaccacacctccatggagagtttctcgtccaacctctctcatctcaccagtcccttccatattctatgttgctaatgcaccttgtctggaagatatgaaaaagtatgtcttgctctagttaagagccacatacatcctttgtattttatagacccagagaccagttgacgactgtcccatacagaaaccaaaacttcaagtacagtacaagagcagagtgactagctatcatgatggttcctgttgattcctcgcttattagatgcctttcagatctgctactcttgttgattgcagtaacaactgagtctgcaatattaaaatggaaattctaatcactttattttcagtattaaccacctcaatctagaatgtttaagctgctgaaaaatagcacttttagtcacatttcaacagcccccgccgcactataagttgtttagtccactgctacaactaaatgagatgcaaatatttttcatcggacaaataagtcatcacaaattctggtaaacttgggcaaacaaatgcccagtggcatgaggggcccaaggctaactgcagcataacacaatcacaattacaagctgactaccacgcataagaattcaaagctgcattacccaaacacctagacgtaaattcagcatgaccatcgatgttgtcatccgtcaaacctgaggatctacccaataggattttttaaattagaagggatttccttatctcccatacacagccacatgggtcgtatgggtcttcgctcctagatattttttggcccttatacaaagtttgatatgttcctttacagctaaacacctaggcttaggaaacaccaacgtctctacctaagatacaataaaatacatttgataaattgttaagaacattaatgccgccgatgtacctttgcttggctgttgctttccgattattttggagcctttcgggcagccatttttcggtgaaggcaaccttaagcagctcagacctggtgcagtccacatctctgtattctattgtagctattcagatgataagacttaaaaaataagcaacagatgaaaggacaataagcgtacagtcagattg

SEQ ID NO: 23264 - DNA, 1501 bp, Oryza sativa
ttgtattataactatggctcgttgtatctccactagctccgactcatctagacggtcgttgttggatgaaggtctccatcttacgttatcatgactgaacttaagcattcatcgacttgtatgcagggttttacggtgccaatgcacacttgaggtaacacaaagtgccatgtgtcgatcagattgtaagttatgaataattttttcgtcacaagtgcggcgatatttggtaccaaacaaaatgtatggcatataatagttatagtaatcactttggctaacaaactgcggcaattctaagatttgatgtgacaatctttgctacaatccgaacaagcctaatattttacaaagataatccatcgcatagctagatcacaaggaaaaaaggctatcacgtgaacatgttccaacctagttctggcaacagttagagcacatttggtttttcagttcgcattacgcatcactcttccgcgccattccatccaacatttttatgagatacatgggcctcatggcccaaataggtgttgtgttttttctctttattctcaaacttgcttttctgttttcaaatacatatgtataaatttccatgcaatagttctatgtagaatatttctatgctaaaagtttctatgtgtaggtcctaattggttacacatattctctaataagtcaaaacgacttattagaaaataaaaattaatttataggtaaaattttttatatatgtattctttgcgacttaaagctaatgttaaaaaaactacgttgaaaatatcttaaaatcaaattcaaaattaaatttgaaaatataaattttggctttagctttggcttattaggacaatcaatggggctcgtaaactttctagatcaacatacttttcaaaacgtgggggcctgatttcaaatgaatatatccaaaacgaggaaggaatgcctatttctatctcatcttcattctaagtttatctgacacgaaaaaggaccatagacacatatatagttgactcgcgcaacttcagttcacgcaaacacatgttgagaaggctattgggcgatcagtcgcgcgcatccctccccgtgcgactggacacgtgtcgcgcgtggggagggagcggcggacgcgccgcgcgagagtccgacttttccttttttttttccgtgttttccgtttctgtttgtttggcttttttttttccgtttctgttccgtttggtttttccttgttctttcggtttcccttctgttttttttcggttttttaatgtatgaataccaagttttgtattcgtacatatgcaaagtttatatacacgtatgcaaactttgtatacgtgatgcaatttcttgtttttattttttaatacgtatgtatataaagtttgtatacatcgtatacaaagtttatatatatcctatataaactttgtatacattgtatataaactttgtatatgtgtatatattttttatgcgttaaaaaatattc

SEQ ID NO: 23265 - DNA, 157 bp, Oryza sativa
agtagtcctctgttggacctgttatgatgatgcatcatcgagttgcttattgccgtactatatatgtatgctactggtggtgttttgcatgggcactacaagagagagtgctgtgcttactggcgatggcgatgataataatcaactgaagcagcaa

SEQ ID NO: 23266 - DNA, 297 bp, Oryza sativa
tttccaaatttattgtccgactaagctgctcttgtgtgcaaaccttgaaataatataatatatatctagtaattgcataataaaggtttatggaggattgaatatgaagcaactagttttttttttgttgacgtaacaactagtatatattcagtgaatatcactttcgttgttgacaatacatgagttgttcacaaagtagaaacaggctattttttttggttaatttaattctggcacaacttgaagacaaggttgatagtgctatactgaaacgcactgtgcttcattttcagg

SEQ ID NO: 23267 - DNA, 1501 bp, Oryza sativa
ggttagctggtgtgctgtagatatacattgcatgttacaatacacgaaaaacagatttcttggaaaataaatgtccttttcttacctaccgttgggagcaatgtcagagacaatctcttggaattacaaaactactccagcacataaagactttctttgaactcacaaatcaagagcttgtccttgagctatttcagcagcacattttaaaataaaatattttgtttccattgagttcttgtgctctaatttgtaaagctgaaacagtagaggaatcgatcactgatcagtttctattggagcagctataatttctgattggatagcttaggataaaataaataaatagaaggagtttcaggatgaatttgcaagcctgttctcatcagttatcttcccagaaccaaacattctgttcccattgcccgctacttaagcgaagaatatattctcctatgcatataaatttggtagtcttgcaggcatctttctgaaagtagcagaatatatgggtagagactagagagtactgttttttgttatattgacatccactaataaagcatttctctcttagcaaacattctcttggcatttttttttaatcttgattgcgtgttcttgatcttctgtaaattcgttttacttgctttcctttgtcagttttgcctgatacagtaataccatccttcatttttccccctttttcatgctatacattttagttttcttatctgttctcctctgcttttgtttacttcagtgagcaaaactgtcaataaacgaaccatcattctgctgtagtacttgcttcaaaagattgaatttgcatttatatgtggcaacacttgcatcacctatgactagtgtacattaaatttgggcaagtcaaggctgcacttgtctgtaaattttgtcaatgtgggttgccaagttctctatgcatgttagtgtctcttgacaatggcttgaatctgcttcccatttccccacttttcaattttatatcctggctttgtcactaccagcctagactacatgggttgtggagtggagatgatttgccaattgtgagcatgtttttgccgtatcttctccaggtcacctttagcttgtttctttgtttttcagaaacacgacaaatataacaagaacactattgattgaagaaaaagaatgttagtgccatttatcaaccagacaaatgtttgattagccactagtgattactaacggaagtgcttaacaatgaccgcaaacttttggatgattcaagatctaggtatcataagttcacaacatcatatcaggatcatgccttcattgatttatggaggaaatacgccttgggtgaattacctcctctggggaccagggttcaagacaaagactcttcccttctcttggggataaaaaagagctcgatagcttgaattgtcatcatatggccagtgggatcgatttgggagttcaaaaaacaattagaacataagaacaatat

SEQ ID NO: 23268 - DNA, 216 bp, Oryza sativa
caaattggttgtaggaggggcaaaccacacttggctgtgttctttaccccaagtttcccaaacccatctccctcgttttctatgtgtacacttttcaaactgttaaacggcgcgttttttgaaaaaaaaattaaacgaaagttgctttaaaaatcatattgatccattttttaaaaaaatagttaatacttaattaatcacgtgctaatggatagc

SEQ ID NO: 23269 - DNA, 1501 bp, Oryza sativa
ataaatttactactaaatatgtagttttgtgatacggtatcttgaattagtagttttgcgatagtatggtcaatgaagtttttaaaattctactaaaaaaagtattgttttgtaaatacaactatatctttaaaagtttatttgtctatattttctctctctaattaaattccggcagtgctcctgccgttggtttcctaacaataataaataaataaaagttattcatggttaaagttgagacattgatgatcagaaatgacaagtaaatgaggacgacgggggtaatttagcacgaccgtatattgtcgattggatgcccatgctgttaggtagaggtaggcatcagcgaaacaatttatgaaggcaagaacgcggccatcaggccgactgtgacgcaggccaaggcacacagacacgggctcagtttggatgtaatcatgtaattaatcagtccgatttggaccttacaccaaaccagccttaacttaatcacgtcgatgactaataaagttttgtgttttttttggtaatgctgccaatttggacttgatatataaaagcaaattatatatataaatcctggctgattgattatatatatctatgttacccattcctttttaaatatataacgttattatcttttagacagatcatttaaattcttttgggacatatcatttatttattttgttatgacttatttattactacatcctattataagtcacattgattttcttttctaattgaacttttttaagtttgatcaagtttatagaaaaatttagcaacatttataataccaaattagtttcattagatatagcattaaatatattttgataatatgcttgttttgtgttatagatgttattatttttttataaacttgattaaacttaaaaaaactcaaaacttaaaaaatatgtcgacgcctgtggtgacttcgtcaatctcaagatatactaccctagtcattcagaggtgctcatagaggtagggtgtgcgtgtgtgcattcataggggtgagtgtgcgcgtgttgtagacgcctgcatttgtactgtgtttctaaaataaagcttaaaattgctttactatgaaaaaatgtcaaaatgacttataatatggaacggagtattataactactttaaacataacttatatcatttatatatgtataatttgttttagtaatataaatggttcaaatgtcatgtcatggaagccaacaacgctatacatagtactatatattataacggagaaaataattcataacgttgctatttaactaacaaccgatctggacaatataatgtgccacctgaacagttctgatcatacagacaacaaattttgtagccatgtgctctatcttttttctcaaagaaaaaagatagcaccaatctgaactgaaaaattgtatgttctatccaatgacagcaagataaatcaattgatctatgtgccattaaccgttttaaaattttcca

SEQ ID NO: 23270 - DNA, 1050 bp, Oryza sativa
tatggtaacatcagaaagataagcaagaatgaagaaaaaaaaatagttgcactcaattaagtaagaacaagagtctaatttgaaggtccataagtgtattgattcttaaagcactagtgtagactttaagagtaaattgctaactccaacatgacctagctcgttccgctgagcaagtcagcttctagatatttggttataggttcaatttttccactgcacttttacaatcctttatattgccatcacttgtacatacgtagatcatagatttgacatgtgagtgacacaagggacggtatacagggctttgggaattttgtggtggcgtgtcagaatcttaccattttaagaaatgcattgctaattgactcaatctgtgatgtacctcatcaaaagcatgtagatatttagcatattattttgcgttagtcaatccaagaatattttacatgtgtgcaggaaagccatgatccattgtgaatgcaatcaatgtcagtaacgagaatgagtgattgtaagcttgaagagaaaagcatacttaagaggagcggaaagggaaagaaagtcaaccaaatgaaggattggtattgaagtaatctactagaaaaaactaactcaaggggggtagaggaagtacaaccaaacaatgtcagaatgcgcaacaacagcacggatgaagaggaaagaatacatgcaactcaagcggggcatgaagcgtgcaagaactgatggaaatgaagaaaaaggaagagctgatccaacttacatcagcaatatggagttgaaaaatacccttagctggaacatgacctggccaaaatgcatgtgccgactttgccaaggacccaacggaatttacaaaaacatcaagaatgtagtggaaccaaaatactgcaatattcaactaatgcaactcaaggaaccatcagttataaacagtgcaataatatacagccaactgaagaaagcaaggcgggcaaaagaattagcaaaaatagcaagaatgaagaggaaagaacagaacacactcaagaggagcagaaaagg

SEQ ID NO: 23271 - DNA, 1501 bp, Oryza sativa
aggcctgcattttctttttaattttgttctctgttactagtatgtagtaaaccctgccgttctattaatgtaaatgagggaaacggcttcgttcctctttgatcccaaaaaaaaactagtaaaaatttgatcaactgttgttgaatattctgctttaactatttgatcatctaagctcgtgtgttgagatgttagtaacaaatgctatagcaccgtctgccccctgcttgatctattctgattctaattccatatgcagctttctgcattgaccactcaagttgaagctctgcacaaggacaaggaaaacctaaggatcaatcttaataaagcagaggaggaggtaagatagtgaaacactcttgtccttgcattcatttctgcatcattaagaaacctgtgccgcctggctgatggctagaaaattttcttgtgttcaattgaaggtcaagctgctattcgaggaaaacaagattcttgacgaagagaacaaaaaactgttggctctgttggagaaagagcgacagcaccggtctgagagaaagcattcctccagtgcgtccaccaccaaggtataaactggcaaggaaaatttgtctcttgttgaaaatgttggttggaaagaagtttgatgtcatcatgtatatgtttgttgcagcacaagcgcaaatcatcaagtttgaaggatacgagcccagtgggtcggaccatcgatttcaatggtgcagattcatcatcgaggcacccgctttcaccattgccaccaaactccccagactacagggcgcacaagaaatgaaaatgaaagcgaccatcatccgctgcttatggcaggcgtgctgctcatctgatcctgctaatataaaaacttgctgctgggttctactccagtggatagaacgaagaaccccccaaggcatgacaaagcctacctgaatgctactcgttctggttgtagagtcatcctttggtcagaaaacaacttttaacttactgtaccttcctaaggcaagtactagtaatagctttttcttggcctgtgactggtctctctgttcattttcatgaatgtaacggcttactcttcttcttattattaattcttggtagagtattagtattatggagctacgtatgtgatgtgctggtctctcctctgacctctaatctgcttgtcatgtatgaaatgaatgcctcatctcgatcatctggttatcaatcaattgatgaaagcatttatctatttgtagatctcatttgtagttgcattgcaacatgttgatgataatccagcccagaaattgatcaaagtactcaatctgctgctgttttttaacatactgtatgtcatcagtagctgctgcgagtatactgagagcctcatatcatctagtcatccggcactgcacgaatcttagagctctactactcttcttcttccgcagcggcagccgcctccgcctccggccccgcgctcgctggctagggttagggtttagcc

SEQ ID NO: 23272 - DNA, 418 bp, Oryza sativa
tcgcccgcctttccatacccattccttctgtatttcattcttgattttggggggaagatgggataaacaattggttatccagtagataacttcgttgatcgattgacgtcgatttttatttttattgctaatggagaagaagctaggtgatattaacttgtttgtttctagcaacatgagggtacaagatctctttcagttttgacacaaccaaatgagcatccaaagtaacactactgtacttagtatcgcgatgttcttcaaaatgctgtgttaatgaaaatgaaatagtgtgctgacagttgattcatgcagaacttgacagtggtagagaactttattcccatccaacgttcgggggaagccgtagccgtgtgtcgcgttcatctttcatggaaaaatcccaaagaaagcgagg

SEQ ID NO: 23273 - DNA, 1501 bp, Oryza sativa
gaaaatatttgaagtgttgagaaaaaaagaaaaagaaactagttagtactcatcttgcatgcatgcagtagcaaggagcccgattgtttctcttcaaatcgggctaccgagcaagaggattcttggaagatatacatggagtaacgagcagcagcgccctacactggagaagcttgatagagttctggtcaaaacttgagggcttcatggatgttgtaaaagaaagctggcaacaagaagtggatgccaccgacccttacttaattctgcatgtgaagctcgctaggctatgtaagaaactatcatcctggggtcagaaaagaatcagcaaatacaggcttcagctgcagatcgccaatgaaattatcctaagatttgatgttgcccaagagtcacggttactatctgatgacgaacgacatcttcgtgcagcctgcaaaggacgatgtctggctttggcgtcgttagaaagaattcggctgaggcaaagggctaagattaggaatttgagggaaggtgatgctggcacggctttcttccacatgaagataaaatcaaggcgaaggaaattactgatcccacggttggaacatgagggcagaatagcttcaacacaacatgacatgcaaaacctagacagagaatactttgaatcagtgatgagtgcggaggacagtgctacaagaaggctgctgtttgaacaaattgggctggctgctgctgatttgactgagcttgatgttcctttcactgaagaggaaatctgggcagccatccgctgcttaccgaacgaaaaatcacccggcccagacggttatacaggattgttctatcaaaagtgttgggacatcatcaaacccgagctcctcaacgcactggcaaagttttgcaccggcaatagtcagaatctagaaaaattgaacacggcaatagtcacgctcattcccaagaaggaatcgccaactctactcaaagactacaggccgattagcttggtgcatagtttctctaagctggctgcgaagattatggcacagcgactagcgacgaagctggatgttctaattccttattctcaaaccgcctccatcaaagggcgctgcattcatgagaactttgtttatgtcaaggggctcgttcagcaattccataggcaaaagaaggcaatggtactgttgaagcttgacatttccaaagcatttgacactgtatcgtggggttttctgctgtctatgatggagttcaggggatttggcccaaattggagaccgtggatctcggctattttcctcactgaacaaacaagcatcttgataaatggggcactcaccgacccaatcaagccagcaaggggaccgaggcagggagaatcgagcgaaactagctggtttgctgtcaccactaaatgcaagaaggcatttgcctcccatctcagtgtacgctgatgatgccgttctgttcttcaagccaacggctgctgaagcaagcgcgatcaagggac

SEQ ID NO: 23274 - DNA, 1501 bp, Oryza sativa
catctgctcgacggacagatttgcggaatggaccttgacgaactcccagatgccagggttcatcctgacagcgaatgcgacgaatggggggagcactgcagcctcctgcatggcccatggatgatgttggattgacagagagatgcgcatgtacctaggaaagtaagtaattctcctacctgtgtggaggatatgacgtagccaaggaagccctggaggagctggtccttgtcggccttatcatcgacggatttgtcgagctcgtccaagagctgctgcctcttcatgagcctcttaccctggacacgtacctctggaagcacctcttcatctggtaccggctctgccgcagtgcctccggcatcatgtcggcaatgctgtccgatctcctcaacccgacggccattatgcccccctctgcagctgcagctgtagctcttctctacttgaggagggaggaatgccctacctagctttcttatttgcttgctgttatatgatactactgtctttgttgttgtatggatccagcaagcctcctcaatttatactagatgatcaagaggaaggaaggagggagagagaagaaagatgacttccaagaagcaggcaggcatcatttcttatatgtacctacaccaccttctgcggcagcatggattgcttgagcgattgatggagaacaaattaaagtgaacaagttatggtatcaaggacgagaccggcaagagtccaggcaagcaaggcatttctttccatcgtcatcatcgcattgtgagattcttcatttgtattccttccctacatttcattttatccgctaccactaactagctctccaaggaaacgaaatgcttaattgattcattgcccacatattctacttgttcactggggcctccacatctcatctcccaagacttattgcatagagaggtttgcctgcaatggagaaaactggccagcactacagtattacattacagtaattcttctggactatattttttttaaccttagctaatgaggttgacacatgtcagaacgaagtacgaaatatcgatatcttaaacagattgatttttttatctcataaaatactgcgtgcatatgctcgtaatcagaccaacctctggggctctgtaattttgttgccgccgacactgtttttctattctacaagtacaagcagagctagaaggttgtacttgtccattggtcaactcatgcatcggtctggaatgtataatggtcggtattagcaagattgtattaaacttttcaaattatggccataaaaaatttcccgaaagcttcgtttaatataaaaaattggtatatgtggattcaccatagtattatcaacttacaatttataaatttatccgaatatagtgatggttggaattttaaaaatttggttgaatcttatcctaaacgttgatttttgtttttaccgcaggagtagtgcgatatgcagttgaaatccaatcacaatgcg

SEQ ID NO: 23275 - DNA, 1501 bp, Oryza sativa
caacgcactggcaaagttttgcaccggcaatagtcagaatctagaaaaattgaacacggcaatagtcacgctcattcccaagaaggaatcgccaactctactcaaagactacaggccgattagcttggtgcatagtttctctaagctggctgcgaagattatggcacagcgactagcgacgaagctggatgttctaattccttattctcaaaccgcctccatcaaagggcgctgcattcatgagaactttgtttatgtcaaggggctcgttcagcaattccataggcaaaagaaggcaatggtactgttgaagcttgacatttccaaagcatttgacactgtatcgtggggttttctgctgtctatgatggagttcaggggatttggcccaaattggagaccgtggatctcggctattttcctcactgaacaaacaagcatcttgataaatggggcactcaccgacccaatcaagccagcaaggggaccgaggcagggagaatcgagcgaaactagctggtttgctgtcaccactaaatgcaagaaggcatttgcctcccatctcagtgtacgctgatgatgccgttctgttcttcaagccaacggctgctgaagcaagcgcgatcaagggactgttgacgttgttcggcgaggcaacaggcctcaaaacaaatttctgcaagagtgcgatcaccccgattcagtgcagtgatcaacaacgggcaatggttgagtccattctctcctgcagagtagaagatttccccatcacctacttgggcctcccgctaggaacaagacagccaacaaaagccgaagttcagccgatccttgacaaattagctaagaaagttgccgactggaaacctaagatgctctcgatcgatggcaggctatgcttgatcaagtcagtgctcatggctcttcccgtccacttcatgtcggtgctgcaattgccgagatgggcagtcaaggacatagagcgcaaatgacgcggtttcctttggaaggggcaagaggaggtgagcggcgggcattgtctagtctcatggcggaaggtgtgctctccagtggcgaaaggcggtctcggagtgaaggacctgaacttctttggtcaggctttaagattaaaatggctggcgaaatcgctggagcaaagggagagaccctggacgatggcatctttcaggcctggttgtgatgtggaggccatatttcgctcggtgacagagtacatcataggcaatggtgaagacaccgatttctggacagcaaactggactgggaagggatgctttgcatggcggtggccgatcctgcactcttatgcaggccgtgtcaggctttcggttgccaaagctctcaccaacaatcgctgggtccgcacactgcagggggcgctgtccaacgaggcgatgggcgagttcttccagctttgggacgaaattcatgatgtgttgttgctcccctcgacggatgaaatcaggtggaaactggcgaa

SEQ ID NO: 23276 - DNA, 1501 bp, Oryza sativa
ctcaagcttggtggagtgggaggagaggtcgttgtaggcggagaccatggtctccttctcctcgatgcagcggcgcaggcccgcggcgttcatggtggactccgcctgtgcaccagatccagcagagcaagagcagttgcagttaggggaaagggaaagggaaagcagattggtattggtattggtactagattagagattagttaccttgagctgttcgatgcggcgtgcggctgcgcggaggtcctcctcgaggacgaagacgtggtcctggaggcggcggcgatggtcctcggaggcgagcagcttgaggcggagggagcggtcggagacggggaggccgagcgagtcgtggatggagtcgcggatgtagtcatcggcgccgccggggagaggggtagaagaagcatcctcctctcgctccatggatgatcgccttcttctcttctcttcttccggcggcggcgggggcggcggcgccgacgaggagaggagaggagaggaggcggcggatgagggtgagggttggttgatcgatctggaatttcttggggaagagaatgtgggatccggatggattttgaactgaacccgctggataaggccggggtgaccgttgctgctattattgggccgggccttctctttcgatcttttccttccctatttcggcctattgcaggttctctttatttagacttaactttattgacttagacttttaataagtcagcttattagtttatatgatttatatatataaaccgatggatttaatgttttaagtttagtggtgaagtcacatctctacttcacataagaaaaaaaaaatctccaaactagtttttggcttgatgtgttgagcggcttatggcttcaaaataagccaaaaaaaaaaaactgtttgattaggcttagactttttggctcgtaaactatttactgggctcattttaattctgcagttgctttcataggcacgcgcattgtgattggatttcaactgcatatcgcactactcctgcggtaaaaacaaaaatcaacgtttaggataagattcaaccaaatttttaaaattccaaccatcactatattcggataaatttataaattgtaagttgataatactatggtgaatccacatataccaattttttatattaaacgaagctttcgggaaattttttatggccataatttgaaaagtttaatacaatcttgctaataccgaccattatacattccagaccgatgcatgagttgaccaatggacaagtacaaccttctagctctgcttgtacttgtagaatagaaaaacagtgtcggcggcaacaaaattacagagccccagaggttggtctgattacgagcatatgcacgcagtattttatgagataaaaaaatcaatctgtttaagatatcgatatttcgtacttcgttctgacatgtgtcaacctcattagctaaggttaaaaaaaatatagtccagaagaattactgt

SEQ ID NO: 23277 - DNA, 1501 bp, Oryza sativa
tataaatcatataagccaataagctgacttaaaaatctaggccaataagcctaagccttaaacaaagagggactaaatatcctaaccaagttttcacccatgagtgggccaaaccaatccttaaaaagaaatctttaaaggaaagctctatccccatccataaaaaaaaaataaatccaaatctgaaacaactttctgccatcctgccttcccagatcacaaattcacaatcctaaacaacatccggtacaatctttttttctcagcccaccgaactactagtatactccacccgaacagtgaaatcccagcgaaaatagccacagtagattcaaaattcaaattcgatccacagaaatcgagagatcaaaatcttggtgggaagcctgtataggacaggacaggaggagggaagttgaaaaagcgcggaccgggagagtggtcgtggttttttttttttttttttcaatcgcggttgggtgaagaaacctttttcccggcgtctcctcgcctttttttttcccacccattcgctcacgcatctcatttttaccccctccgccgctttcccccgcaaaaaccccccatcgccgccgtcgccgccgccgccgtcgtcggtcgccggagagtagcggagggtgtgctcctccggggcgggccgcgcgagggctggccggggcgccccggcgcggcgcggttttttcccgaggtaatcggcccacagcttcggtgtctccggctataggctctggtggtgttgcttggtgtgatggcgtggtgttgcgatcgtggtcggtttagctgcagcgtccgtggatgtgtgtgtgttcgtgtctgcgttagctctggtgtggtgaagctgtgtgggggtattttggaggataaatgtgtggtcgttttggtgggggctggggattcgtcggatcgctagattgttctcctctggttcgtgttgtatttttttttattttggggtgttccgtggtagtgctgggttcccaatttggcgccgcgtgcttcgttcctggcttggagtgcctgcaatgctaactctgtttgagagaatcacaggaacattttatttagcaaagtatttttttttaaatttttgattcttgtgtccgcgtttggactgttatttagggtttagtgatgtgcaagctcagttttgggttgtgttggggtcgttgtaacttggtgggttgaagctgttcttttctggttgcctctgtgtgctttttagtcatgcttatgtgattatgtcctctgccgctgcacacattcttgagtaatttatggttcattaatccttcaatcgaagcctactattatgtactccttttactactactgcctcttggcctgattgactgtgtaaacttgcatttttgtttccctcaatttcaatatctgtattctctatgtgcagaaaaagaaaagagttcattaacaagaatggcacagtttatgtgtctgtagctgcaattgatagtgaacacaa

SEQ ID NO: 23278 - DNA, 258 bp, Oryza sativa
atcctattaatgtttagactgttggttctaatggtactgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 23279 - DNA, 1501 bp, Oryza sativa
  unsure (1)..(1501): unsure at all n locations
atagttatagtttttatctttggtggacttggtggtctccctgcatatggacgtcgtattgcgttcctaccgttcccccccccccaatctcttctcgtaactttgatctctcttattgatgaactcttgaagggaacggaaatcgaaaatccaagaggtattgtaactttatatgtggctattttctacaacttgttagccaatttctttgctagttgtagtatgtttttacgcctatcatgtatttgatttgcatagaagctgtttatgtctatctgtgtaggtatatcacaaacgaaaactacattttcttcaattaagtggagtcattttttatcttcatgagaagtacaaaagtgaccaaggatcacgtgaaattaattatcttaatatgaataggaagtgcaaggaagattgcgacatggtagaggcctattattcatgtgctaaccttagcatagttgcatgttatatacttttcctgataaaacatatctctcaaccaaataaagattcatggaatgcttttactctattcggtaactatcttcgtctatattacaatgtgttgtgttgttctgtaaagatttctatagatgctttatatttatccatgttattaattattatgtacatgcaaaaactacattgcacaaatttagaccataatcttcatatgttttactagcatgctaatttgtatgactccaatatttagaaaaaaatcatgacctacatttgttttatccatggagatgagaataggttatgtcatacttcgataatttgatcaatatggtgattaaatttcccttcctgctatattgtaagtcatttgaaaagggttaatcaatcttatgtgatatatgtgtgtcacgatttttccttcttactagcatataataaccttttcaggtgccccttactaattctatccatcataatcatttgaataattatttggtattctcctgcatcctaggagatggagggcttgaatattgaagggattcccccagtgcctattgatccaaactctgttgatgtattgtcaagctcaaatattgatccaaactctgnttggacatatttggtcaaagncttncaaatattttgatccaaactctattngatgtattgtcaagctcaaatgaatcaaagcctactatttcatttgatttgccatcaagtttctcggttggtcatactagacattcaagtgaagatttaagttcccttacaattaataatttacgcataaatcatagagaggacaattaccaaagccagtttgaagagaagcggatacatagccatggtcacacaagacgttttagtgaagatttaagttctttgaagattaatgatctatgtgcaaataaggaagaggagaattatgacaaccagcttgagaggaaggaaatatatcgccataactcagctggaaacattttcagggctgcagagattgctgaacgcttcattcaaaccattgataaga

SEQ ID NO: 23280 - DNA, 227 bp, Oryza sativa
cactactgatcgaacacaatttctcagcaaagtttggaaaatccattcgctatccttttagaaacaacgcgtcgagacttcataagatgcgtgcttaatttttcctgcacctaattaacagaagcactttaagcttgtgtgctacttatccatcttccattctcgcttgctgctgctgctgcaagaacacagtgctagctagctagacacttcttgctcggtaacaa

SEQ ID NO: 23281 - DNA, 1501 bp, Oryza sativa
gcgccagccgtcgaagccgacgtcggacttgagccaattgagccagtcggacagctctgtctgcacacgcgtgttgaggtggtcgatgtcgggcgccgcgccgaagtctgcgccggtgtcgcggtgaccgcggccgttggagtactgcgtgtcgtcgctgcagatcatgtcggggccccagtcgaggcggctgtccggcgtgccaccctcgaaaatgcagtagatgccacggctatccttgtaatccgcgcaccggtggttgatgacgatgtcggcgacgcacttgatgcctttgctgtggaaggcggcgatcagcgacctgagctctgcccccgtgccgtacttggaagcgtccaggtcgtagagccggcccggcatgtatccctgcggggcgacggagtgcgacggcggtgggagccagacgtgcgtgacaccggtcgcggcgatgtcgtcgacgtggccatggaggaagttgtaccacccgccctgcttcttccacgactcccagttgaacccctacaccaagaacagtcatgtcaaacgcaagtcatttttttttatgtaatgtgacattgtactacaggatgcttacctggaagaggacctgggcttgggccaagtgagagctcagacagagcaaggcgataaggaggaggctgctcattgaggctatgcgctttgccattgctgcttctttcgagtagctgagttgtgtggagtggcatgccggtgcatgtgaatttataggtgcagcacggcagccacttggccaatggatggatcgttgttggataagttcggttgcccccaacgagagaagaggagaaacggcagcgctgctatgtgggctatctcatttataagcagataaaaagggcgcgtgagatatgtatgcgtcgtgctatgcagccttggatggcgtgcgatgcaggcgcagggacgccgcgaacagagcgcggccgccgtatgggtggtccgttattgcgcgcctttctgatgcgtatgcgcgccgcgcggcttcggtttgtaacttccgtgctggctgcccatggtcttttgaggtttgatcgcatcagcttcagaagctttcggctctggctgctgcgccctaacacaaattggctaccatttatcctctttctttctttattcttttttccggtttgtgtgtatgatttattcaggttatggtatcctgcgattctgcactggttagtttccaggccgtttgactacctacggagtcctgttttaccgcttgagggacgcgcgattgaaaatggggttaattgcatccatgccactgcaaatgtggcaaattaataaaacgctattactattcgtgatatcggctaggtgccactaaaattttggtaaattggatccataccaccccgtcgcatgttccgtccttcccccgttaatttcctaactacgtgccgtctttctacttcgccgttgaaagcaccgccgaactcgacgaccagcgcctctcggggga

SEQ ID NO: 23282 - DNA, 1501 bp, Oryza sativa
tatcagaaacactgacatgacaccttatttaatgcttatttggaatgcaggatagaaaaaaatgtagaaatagaaatcacagaaatatgataggattgtatgtgtgaaacacatgattgaataacataagaatttcttattcttcgtgcataggtagcgaatagtattcctgtgacaatcgggtagccaatcttttaaaacgaatgcaactacggtagctaattcaaagaaatcatcaatcctccattgttttccttcacatttgcttcattccgaatgagcccgaatgaaactccagtggcctaaagacggattgtgataaaagatcaattttagggcacacaatgagacaaaaacgtcttttgcccacggatacggatggggctggtggtccccaggccaccaggcggcgcgcagcgagcgagaaagcagcgccccgctcccagttttggcttacgaaacgagtcccatcaaaacactcagctggagccgcggttcaccgtccgcgcctccgtggctatcacggcatcgcgggcgcttctctccagaatccaccgcgcggcgtcgcggaaacccacccgtctcgcgcgctacggcttagccgcgacggtgaccgcggccggtttgccatccctagacggctcgcgacgctgcgtggtgggcggctggtggcacgttgcgatcacagtgggaaaggcagttgggccacttggccgtggcgagtaaactaatcaagctgcttctgtaaactatcaagctgcttctcttctcccgctctcgcttggtcctcggaaacgagttgaccgtcgtgtacccgtgtgcagtgtgctgggtgcttgctcgcctgctgttttccacatcgccgtcgccacgggtgatttccctcgtacggtgctgttccacgagcgaaaactagctgagttccaccacctctcgatgtgacgttgactagtcaggtgaaaagcggattcaccctcccgagtcacgacttgtcaaaatacgtacacgcctaagttattaactcgcgtggagactcactggaacgcatgtgtaactgcttccaccgttgcatcgtttgcaaattaactcagcttcaagtcatcgcagacattttgcgcaaatattaattggaaataatctattccatcaatatacaaaattcttgttactttctactctgtacaaaaaaatatgtataagacggtactcctaaaaaacgtgctctgcacaaacaatgaagtatagctaattagctatacaatgaaacgaataaatgaatggccttccagtaatctaatccaacggttgagatctaataacactagctcaaaaactagacgctgcaccggaaaatggcgggaaccaggtgtccgcttcatccagcttcatcaggtcctgcaagccatcccagagctggttgctgccggcttcgtccgcgcccatctgccaatccaccggcgtcgtcgtctcctcggcatccgcgctgcacggcgacagagtc

SEQ ID NO: 23283 - DNA, 1501 bp, Oryza sativa
tcaatgaggaggtgctgtaccaccgttggatgatgccagatcaacagtcaggatttggtactgcacaacctcaaggacagtaaaaaacctctttataataagacaaaatttgctacaggacatcaaaaaacgtataattagttggaggacaccgtaaaaacgtgaatttgctatagggcatcgtaaaaaactggtaattggctgctggacacccacaatattattttattattttttagaggaaaaggagagagaacagttgtgtaaatacggttctaccctttgaatttttttcttttgagcgggaggcgactggcgcggggcggtgcggcacgacagccgggcgcagtagcacaggcgtcgggcatgggttagcctagcgtggcggcagctgcaagccgacgtctggtacaccgcaccggcgccggatcagcgaggcctcacatcaccactccgacgccgccctacctccaactgcaacttccaactccatcgcagccctccacacgctctccctcctctccggcgcgctcctgcagcgggtgatgtcgcgaatggccatgccgcacggagtcagatcaactcaattcgcatcgaaaaatcggggaggaacctggcctgccgtgcttctttccttgatgccgtctctgtgagctcgcataaccgccactcggcccgtctgggaagaaggagagggagaggagacttctctgtgggaactgcattggagtcatttgagccaagggtaaacttgtctttaatcattgtctctctctccttttcctccaaaaataataaaataatgctgcgagtgtccagcagtcaattaccagttttttatgatgccctatagtaaattcacgtttttacgatgtcctccagctaattacatgtttttttggatgtctgtagcaaattttgccttataataacgttcttttagtcggtggtactactcagtaccaatgcaggttgaggtgccattttgcgctgcttgggtggaaagcgtttggatacgggagtgaccgagtcaggctgggatctattcgttgcgtctcgtgctctccgtaggggcgtggacgtggtggatgtttgtgccttgcttgcatgccctgatctagctgaatctttgcagagtttttttattgttctagatggttggtgtatactcactccctattttgagtttttttatgtaacatttgaccattcgtcttattcaattttttttctaaatataaaaaacgaaaagttgtacttgaagtactgtagataataaaataagtcacaaataaaataaataataattttaaaattttttgaataagacgagtggtcaaacgttataagtaaaaactcaaaatcacttatattatgggacagaggagtatatgatatatatgttcacggtcgtgggacgtgcttggatcaacgtttgctgccattagtcagttcgtggcagacttagctctcttttctctcggggaaaaaaaaaaactag

SEQ ID NO: 23284 - DNA, 280 bp, Oryza sativa
cccccatagttcattttctaggagtagatctgctagctccactccaaaaaatggaggatctggaccgtttggcacagccccggctccaggtaagttggagttgggagctagagctgtgccaaacagggccctgcctaagagacagagcggctgtatgcctatatcagtgtaggataacaattgaagcgaagttgttacttatcgtacgtgcatacacatttgtgtttacagttatcctcactgaactctaagatggcagcatttatggatatgtggttgc

SEQ ID NO: 23285 - DNA, 1501 bp, Oryza sativa
cctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgct

SEQ ID NO: 23286 - DNA, 220 bp, Oryza sativa
tttcctctgacttctctcaattagatcaaacagtaccatgactcgtgtgcttctcacaaccattgttcctaaaatatccatcttttaatccaccttgagcttagatgcttctcataatcagtgccccatgaaaaccatgtaacctaccgagactggctaactgatatgtttagttttgattgaatacccttttaattgtgtgatattttggtactgcaga

SEQ ID NO: 23287 - DNA, 1501 bp, Oryza sativa
ctgacggagatgtctacgtcgccatgatcgatgacaaggtgatcacaaagattgggactcggtatgatgtgggcaacttgatcccgtcagacttccatgtcgttgctcacggcaacaattactgcgtctgggaaaagagtggtcttagagttccagcagggcggcgccactaggccaaatatttctttcaggactattttgtgcctgaaataagaagtttaaatgatgtcttaaataacaagaaagtgattgattgattgtatgacagacaaatatttttgtcaggactattttatgcttggaaaagaaatttaaatgatatcctaaatacctggaatatgatagtatgccatttcattcaaacaaattattaaaatttgctctgaccgtctgacgtgtcaagggttcaatgtggagtattattcttgcctcagccctcaggacttttgccccactagctgtgaagtgattttttttttgtttaaattcgcttggtgttagtagtttaccacaacaatctggaaattaccttacctcagcgcagtatgaaaatgtttgtcttctatctatactcttctaaatgaaggcaattgtggtggtggtggtgaaaactcaaaaatattagcagaaaacaacatgttcatcatactgcagatggagcaattgaataatgggtgcgttttctactctaattccatggatcacagtgaaaatagttgggattgactgcacatagcaaaaccgacaaaaatcgcttatcagatcgagagggaaatctgtccaagcgagttgcaaattccttaccgaaccgaaggaagaatcaccgaatcggcccggatggagatctccgctccgcgccgccgccgaaccagtagaggggagaggacggaggagaggagaggacttcgacgcggcgtgcttcggcgccgccggagaagatcgacggtatggcacctagcggcggcggcgccgcggaaaggggattcgtcgccgcggccgaggagagggcaatctggtaattagcgcgagttgacatctccaagagtccagaaacgccgcttcggccttcggataagccacgtcatcaaacaacctgacccggtttgaccttttccggtagactattctacccttggtttgctgccgctgcctctgctggctgctggcgcctccccgctgacctcacgccttaagtcagcatccacacgtcacctcggccccacggcacagcacacactgcccaaatcccctcgacaccacacgttttccacagggctaagcctgaaagaggaaagatcaacgacgacgtggagcatgtcctggcgccgttctgtcgccgtgttactttcgatgttggtctccccctatataagtgcacccgctctcccggcttcagctaacgacctcaagcacactactagctccggctcacttagctccctactgatcactggaacactcatgaccaagaaggtgataccggccatggcggcggcgaggc

SEQ ID NO: 23288 - DNA, 814 bp, Oryza sativa
tggaaagagaactttcacaccttatctcttagcttgcaggaatcagacttgttatcatcactccttctccagtcttcttgtgcttccttaagaaagttcacagcaatgggatggtcagattatggtttgcagatgaacgaacaaacgcaaaattagcttcaaaaaattgatgtttaggtaaatctagttagcctgctagtgaatttacagtcttgtgacgtgttcatgatgttcacacctgatatctgatccattccaactcttgtaacggtgcaagtcccaactctagagacaaggaatcgggatcccatgcttcctgctcctgtaattcaataaaaccatgtgatcctcagtaataaaaccacgtgatctaaatcctgaagtagtactttcaaacattttcacagtactaggcatgtgctaaaaagttgcccgtttcgatcacaaaaatccaatattaagatcacaatagtaaaccggtaacaagatcaaaactcacaggcagcaaagctatcagaagtctctccagtacaaggtgcaggcagcaaagctattagaagtctagattaggacgctaagttgtctgtttgggttgctgaaaacatagagaaatcgaccagaaaccaacacgcgagtagcggtaacagatgatcacttttctacattatctttttcttacttatctgaagtaccaagtccagaagcaagaggggaaaaaagatgcaattagtcaagctcaggtccatgtagccatgcaaagcaagttcgatgaaatagaaagagaactttcacaccttatctttttgcttgcagg

SEQ ID NO: 23289 - DNA, 1501 bp, Oryza sativa
tttcccactgtgatcgcaacgtgccaccagccgcccaccacgcagcgtcgcgagccgtctagggatggcaaaccggccgcggtcaccgtcgcggctaagccgtagcgcgcgagacgggtgggtttccgcgacgccgcgcggtggattctggagagaagcgcccgcgatgccgtgatagccacggaggcgcggacggtgaaccgcggctccagctgagtgttttgatgggactcgtttcgtaagccaaaactgggagcggggcgctgctttctcgctcgctgcgcgccgcctggtggcctggggaccaccagccccatccgtatccgtgggcaaaagacgtttttgtctcattgtgtgccctaaaattgatcttttatcacaatccgtctttaggccactggagtttcattcgggctcattcggaatgaagcaaatgtgaaggaaaacaatggaggattgatgatttctttgaattagctaccgtagttgcattcgttttaaaagattggctacccgattgtcacaggaatactattcgctacctatgcacgaagaataagaaattcttatgttattcaatcatgtgtttcacacatacaatcctatcatatttctgtgatttctatttctacatttttttctatcctgcattccaaataagcattaaataaggtgtcatgtcagtgtttctgataatgttgcaacaaattaataaagtgagagatgaaatgggttttaactagacgaaatcttgtctacactgtttttaatatactccagtttgtatcttgcatatactacccatgaaacaacaaacatgaaactatgcattatgtgagctatttcaatcatcaattaaataccttattacttatgtggtatcttggaaacataaaaatgatatctctaattaggaatagccttagatccgatcttatttgcttccattccatcttgattccttaatgaccacccctatatgcccatagtttcatgtcatctagattccctaaggcataggctaggaaaagggatcgaatgcaatgttctttgactcaggaacgtcgtccccatcccagcaacaaggagacattttcatccgtaaaatcttgcaatacgttcatcattcttgttctcttgaccccatctacccgagaactttgtgactatgacgactattaattgaaacaatgatacctccataccaccaaatcaagcaacaaatattgtattagtaatcgctcttgtttgctattgggcatgtgttgtttgtttggtgctatggcttttgtaaacacaaggttaaaattaggccaaacaagtccctgcttttgcggaatagcactactccgcgtcctaattatagttatagtttttatctttggtggacttggtggtctccctgcatatggacgtcgtattgcgttcctaccgttcccccccccccaatctcttctcgtaactttgatctctcttattgatgaactcttgaagggaacgg

SEQ ID NO: 23290 - DNA, 1501 bp, Oryza sativa
  unsure (1)..(1501): unsure at all n locations
gtctagcattaggaatgccttgacagctgaatccaaattaagcatgctaattgcagatgctagcaacaatgatgaaagtttattttaacaatcaaggatagtaaatcaaatatcttgtgtggaatgaactactgataaaattgtatacagtgcctcagttatgtagctcctgaaatgctgcagatgaataatgggataacggaacctagaattcaatgctttagaaatgttcaggaatagctgaaaaagagtgttgtttactgttggaatgttttcctctatgctactgagttcagttacctgagcttttctaagtacattggaactgatctaatatgactaaaattgccatgatatgctaccgaagtcaacagtaaagatatgatactatcatcgaacaaaataatccctgaaaaaatctaataacaagcaacgctagttcttcaatctgacctgatagataatacccctgatagaaattggcatagcatgtgcaggtacgtgtgtgttgggcacttaacgttattcctttgtccaacagatgagaactagatatttagatagttagctgctgccaaaatttccaggacttttgacatggaaaagtaaatagatttagatnnnnnnnnnnnnnnnnnnnnnnnnggatttctgccatagtaaagtaagtagcttgagacaattagatattccaatcgagctcgtgagattaacttttgttgataactgagatctttctaaataccatgctaatttattttgattcctttctactgccttaactcttcattactcctggcaaacttttacctgttgatttgctgttatgacacttggatgggtgttctacttattctgtaggttatgttcggaaaatcacatttcgccaggacattgaaaacatggatgagttagacaatgggaaaccaccatagtttgatggccctgttcgcttggcagctgtcatttattaactgctgctggatagattgtgttcacaacttggacgatttaaccagtgattctttctgttacagtcaggcacggtacatgatgaggtgccatttttaagtgttgtaaaccattatctgctaataattgtactcctttgttcttatcattatagttgataaagaaaaggaaagaaattatttcaagtcagctttggttctgttctacacttctacatctctttctctttccttatcccaagcggctatactagattcttactttgcatgttgtctggcccatcttttgcccttctttctggtttgaggtagcctattctgcaagttctggaggaatcacatattctgaaactttctgcagctgtcaggcatatattctatatatgcaccttagccatgtttaggacaaggaacctatgaacttccatgacgggcaatcaggagctcatttaggcgtatcaatcatccgtagctgcagcaaatcaaatccaaaatgtctcatctgagccttttgaccttcaagtacaatc

SEQ ID NO: 23291 - DNA, 748 bp, Oryza sativa
cccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcatgacgccactcataaaacctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggtcagcgagcgtaattaacgcacacacgatacgatctatctcgactgccacaaccgcatatctaccttatgcgccgcaagcgggcgaatggaatttagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgcccctaactctctctttgctgcgcctcaccttcgccacacacactcgttctcaaccctctctttctccgacgaca

SEQ ID NO: 23292 - DNA, 1501 bp, Oryza sativa
ttataacttccacatgttgctttcatacagaaagatagccgcgtctgcggttgacgtagctataacagcggctgcacaccttgctaggttagaggcgcgctatggtcctacagatctgccttgtgagaatgtactaaagcagtgtaactctctatggttcacctttgttagggaggaccattttttctgcggtgcgcataggtcgtaggattgttcctctgtagtatcggggtagttaaagagtattcttaatggtgatcgttgttttttcgtactttaattattgccctctgtttctggtcctatatgtaaactgccaacttgatctattgatttggttttgttcagcttttgttcccatctttgcagctgcttactgttttcgccttttttaaaacctgctattatctatgttactcactgtgcatgttcaattgtgttctattttgtgatgcgctgtgcagagtggctccctgtatgtgtccccattttctttgcaatgtctggtaaagcaaaatcgtgtgtccaacgggcgcgtgagagtcgattaaggcgtcatgcttcattaggccagggtgtgttattcgcgccacacatttgtacatgttgtttttattatttagctcagctaactaagacagcaaattggcttccttaggatttctgcaagctccggtatttggttcagtaggttctgttcctttgcgcctcagctcagatgctgtgcacactggaccaagtagcatacatgcagatgtcgcgcaaggaagcgttccatcaggtccttcccagcaagccacatcccatcgttctaatgccaataggcaactgcccattgaaatcaacacaatcagtggaaacccaataggcaatgtgaaaagtaagtacatcactaatatagcctataagctgacttggttgcttcattcgagaaaagaacgaaccattgtttcgattcatttcttagtataactactttcccttagggaagaggacattactagacataccgcgaagtgctgctacgagcaatagggagagacgacatatgaagagatctgcccaccgaacagactactctctgatgaatgttcttgatggtattttcagatccaaaaaaaatacaaagaaaaaatttgtttcctactgcttatagcctcatttctattcgttgtataggcccaaaacctactcttgaggacatcttacctttgcctaaggattatattgcatccttaaaaggtttgtttttgttcatcctttagccagcgttcctttaatctatattccagtcttcccttatgctttaattctacagcgctataccctgaacgatcctactatggcgggccatcccatgaatgcccatactgtggagctgtattttcgttccaagagagggtcaaaaaagggaccgtgctgtcacagcgaaagatcatttacaacctgtgttgtagaagtggtaagattagccttccagagctgaaaaaaccacctgatt

SEQ ID NO: 23293 - DNA, 240 bp, Oryza sativa
ctgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcaga

SEQ ID NO: 23294 - DNA, 243 bp, Oryza sativa
tcctgcagcccgccgatcagctgtaggaatttggactggagtggatgggtacgacttatctgatggtgaaattttcctttttctaaagaagatgggtagcgtacatggtgatggtacaaaaaattacccaaaaaaattatgccttctgaaaaggatccttgaaaacctccatggaaatacgatggatgctgctgcttcatacctcggacaaccaaggggagaggagtagcatgctagcagcca

SEQ ID NO: 23295 - DNA, 1501 bp, Oryza sativa
aacgagctggccaagctcgagatgctcgtcctcatccaccacctggtcactggctacaggtgcgtgcccctccacacagattcgccatatattctccccttgtcgttgtggaccacaccgtgccatggctgctgccactccattggccccttcctcccagctgccagattccgcatacacataccacagctgctagtacacgcatgctccaacctgtggggtcattcactgctcagatcgcacagcgcctactcagcatcctagtaccacatatgagcagtcacatgcatgtcattggagacgagttggttcctcaaatttcgttgtggaacggtgtgctgattgacgtctgcgttcttgatttgcaggtgggagattgttggttccagcgacgaggttgagtacagcccattccctgtgcccaagcatggccttctcgcgaaattatggagggatgatagtgtcagtgtggaaacagatggttgccagaacggtgataatgacgacaatggcgtagcaatggtttgattaggcgtttaatgtagataagctagctagggagatatttttctttctttcattgcccttctatttcctcaagggaagtccggggagaaaaaatggagttttcttcttttttaacttgatcataagaaggtaatgatgatgagaatgggttctcggaggaaaaacaaatgataatgtgtaatatcattgacattgacccaaattaaatggcttcagcagttaatgctgctgcatttcggctccctttcattacaccaaggcaccaacgcgtgttgccatatgcgttttccccgtacacggtacacctgggtgcagacccccgggttggccccggtttcaggccgggcttaaaaaaaaaactgatgcgagagccggcctgaactcatatatagtaggctcacacaatgagttcttgccataatcctcccgatcggtcagacaaagcagctcgcaccgtcgcacgcaccgcgcgcaaggcgcagagacgcgcagcgcacgagatgcaacggattaacaggcgaaggggatcgaacgagcccgtccgtccgttggctggttcccaactccctcgcgtcgcgtcccccaccaacgccacgatcgagcccaagacgctgacggtggcagcctggctcgcgctcgatcgatcagcgcccacgcgccacgcgccccgcggaacgcgcgatccgccaccaaccaaaagatcaccgatccccacaggcccggccccagttcggacggtacgtacacgtacgtttattacgacgctgcttgccactgctgtcgagtgagttggcgcccggcacaaggccacacaagccggccgttggagtccagctcacgacgcgtgagcgcgtgaccgaccgagattgtacggctctgtacgcactacctgttccgatcgaagtatcataccatcggccgcacacgtcggacgcccgcacgggcccggcacggcaggcagcgagcgcgaggt

SEQ ID NO: 23296 - DNA, 1501 bp, Oryza sativa
tataactaaaaaaaaattatgtatcggttccctaggcatccctggatacttgtagcttcgtccatggctgagggaatggaagaatgtaactactattgtattattgtattctagcagaggcggagacagcgtgggggtggaggtgtttttagacccccgtaccctctaatagaccattagagccctcataataccccccctaaaattctaatccatatatttataaatgaggggctaatataaactttgtttgaggttgttagaaggcccaaaacgttaagaaggcccaaaaattcctaacctaatcctaaatctctcttagttgctgttggtcattttggtttagccccgctatatttttatcctggctccgccactgtattctagtagtcctagtatgtcctatctctatgtatacttttagatgatgtggcacatacttaaagtataagtaggagtaaactatactgtattaaactacattttaatatgtacagaacgacgataaaactggataagttgaacttatcttgctgcatgtacgtttcatccccaaaaaacacatgataagaacataataaatgcaatgcaatgctattcttacgaccagattggccaatacacgattgaaactaatcagcacagggtagcaaatcaacagggtatagtggtatactgaacttatcttgctgcatgtacgtttcaccctcttaagaaaatcttgataagaaataaataccacgatatatatatgctatcattagaaatccacaggataagttgaaacttccttgatgtatgtacatttaggcgctgcttctttcagcttaggattattataatccaaattattaggagtaaactgaaagaaacaaacaacttattgaagtagcttattataatctggagcctagcttaggccctctttatttaggcttaggtttattagcctagacttttaagtcagcttatatgatttataagccggtggatttaatgtcctaagtttagtagttgagtcatacatctaactcacataagccaaaaaagcttctccaacctagcttttggcttaatagtgttagagtggcttatggcttcaaaaaaaccaaacggaaaagctgcttgcttgtttaggctcagacttttcgacttataagttggcttataagcctaaacaaagagggcttattataatatgataagctcatttaggtgagctttttccagattattgggtaaaaaattacccgtcataccacaccactttctctttagacttgtaaacccaataatttaggatgtaataatctaggaaagaaacaactaaccgtttattctactacagattataacaatctagcttatggtaatctgactcaataatctagattataataatcctaagctgggaaaaacaggccttactccctcccctccctagctcgcggacaccatatgagcttccaaactggcctctcactttctctctcgcgctctg

SEQ ID NO: 23297 - DNA, 1501 bp, Oryza sativa
ctgatgggatcagccaggcccgggtggccgtttgaaagctgttggccggatgccaaccttgatcaattcaaaagactgataccttgcacatactccgatcggacgagacgcactgtcttatccgtgtcgtttgagaagcactcacttagttgtttcagaaaagagtttaaataaaatcaattgcaaaaacaacagcctttccttgaagcctgcattaaacacttaatccccatggcttgctgagtactcccgtactcacccttgctctatataaataattcccccccccagttgctgaagaagatgaagcggatcccgctgacgaggagttcttccaggagcaagtcggctacgatgagttttagggtttctgcctagttcccaagtcgcgcctgtgatgtttggtccaagtcttggcttccgctttcccttttgtaatgtagttgtgagctcgggatctgtccgcagcccaacatgactgtactcctactctataataaagagacctctgttgctgtgatatactgtcttcctgtgataccagcactgtttcctgggactggtatcgattaacaggttaatttggagcgtcacgggctagttccgctcggggctagttcatggcgtgacagtaaatttctttgtgtgggaactaaacaaggccttaagtttgtgtgttctttgaaacacttttccaactttacctgctcgttttccgtacgcatgtttggaaactattaaacggtgtattttttgcaaaaagtttttatagaaaagctacttcgaaaaatcgtattaacatatatttttaaattttttaaactaatacttaattaattatatgctaataattcattctgatttacaccatggtacccaagcggctagctagctactgtgttctttccaggcttgtgtactagactagctagctgcgtgtaccgatccctgaatcattcggagtaaatgcaggtggggatcgaggtcgagaagcggtgaatggcggacgtctagctagccacgcggacaacgagaacacgtacacagtagtctgcctacatgctgaggacgtacgcacaggcacagcttgccctctccctcaatgtttcgcccgcacctacgtatcgtatactccctccatactcgtaaagaaaatcgtttaaaacaatatttaaattaaaccttaaaaatataaatcataaataaatctcaaattattgagtttaaaaatataaaaagtatatgtatagatttgtcttgaaaaatacttttataaaaatatacatatatcactttttaataaatatttttatagaaataagaagtaaagttatgttttggagaccgtatcgttctcctaaatgactttctttattgagtatggagggagtaatcaaacaatacggacatatatactacggtggcggcctgtcgttggggcggttgggttcaccattcagcctgatctcgccgccgcccgccggcgatcaactgcatgcaa

SEQ ID NO: 23298 - DNA, 1501 bp, Oryza sativa
tcgatctcccacttcgccgcccatggccatgaccagcgtgccgagccgcctacagctcctcctccatgttacgccaccacactggccaatgctaagcggcgcacggtgagggttgggtcatgggcaccgccgccgccgccgccaatggtcgctgcgctgacagcctacgtactctctgtctacctcctcggatcatctactccaatggcaatttgtgtgatttttttggatttgcgtgaatttctggatttgtgcggttttggatctcttttgaaatttcggtcatattggataccgataacgaattagttaattcgatcttttactttttagattaccgaaatttctcaaaagattgagaacaaagattggatagttggtctgaccgaatgtcccaccctaaccaccacattgttggcgcttcacaaaattttgaagatttcaattttcgttcccccaaaattatacattcttttagaaaaaaaaagcttcgggacttttgcatgaattttctaaaatttctcctttttccccctaggcatgtatattcctgcttcaacagtgcttgacattttgcgcggttgacatttttcaaatcccagaaaacatatatcaactgctaggcaagtgtcacacagagatcgtagctagggaaggattctaacaaatagtcggtgagtaactagctagcgagaacctagaaaagctgaagatgttggggctactaaattagcgggtgtttagatacaggggtgtaaagttttgacgtgtcacatcgggtgttatatagggtgtcgcatggtgtgttcgggtactaataagaaaactaattacagaatccgtcagtaaacaacgagacgaatttattaatcctaactaatccgtcattagcaaaagttaatgtagcaccacattgtcaaatcatgaagcaattgggcttaaaatattcgtctcgcaaattagtcgcaatctatgcaattagttatatttttagtctatatttaacttcatgcaggtgttcaaatgttcgatgtgatatagtgtaaatgtagcgcccgttccgtcgtggcgcctagcgggaaattgtatttcctaaaaaccctaattgcgaaaattgtttcttcgcttgctgtcagtctccgtgcctttccggatctcaatccccgatctatcgtcaagatcaatcccgaatccaaatccttcccaaatcaaatccctccgcaaaagtctattttgcctccctcgggttcgatgggccgaattcctctcggcccatctctccctccctccccatctctccctctctccctcgctctgcccgcgcgtgcgcgagagccgcgccgagcgccccccctcgctctccctctccccgcctccatccctggcgagctccccgcccgcgaaatcggcccccgcgcgccgttgttcgcgcgcgcgcgcccgcgtggtcgccgcccgtgccgcgcctgtgccgtctgcgccgcccggccccgttgcccta

SEQ ID NO: 23299 - DNA, 297 bp, Oryza sativa
cctgcagccctgtctggcatagtttgcaagtagtcaatggacttgggttacactatgcctgaactgaacttgtagctatgaaatctgaattctttccagccagaacgagcataactataaaatagaaattgtttgttcttgtgtgaataaaattgctgttattcaagacggcagtgcgagcttctcaatgttgaaactaaacatttgactgttattagcttctgcaccaattagttataccagttcactgaacttcttctctcaactgccacagacgaatgtaggatggtacaaaca

SEQ ID NO: 23300 - DNA, 1107 bp, Oryza sativa
atcactgaacacacacttactcctacatgccatgaaataaataggaaattgattaattaaccaaaattagagcttgtggctgtcaattgtacatatgtgtgaaaactgtgaaactgagctcagcgaccgcgtgggaattgggaatgataggatctgcgacgcgccggcgacacagtgcaactagcgagctagcctggcagctgggaggaaaccacgacttagtgggagtgaattttaatccctcgaagagatattcctgtgtttttttcctttcaaattcgatacaaatagttaaaaaaaattataaaaaattgataatataaagtatatagtaaaatcgataggtaataaaaattaagtttaaatactcggctttagtgaaaaattcagatgtgatccgtataatactattcatatgctgatatttttatatctcgatatatgagttgagtttgaacttaatattttgtggggttatatagatatgttgtataagtgttattaaatttttccacaattttttatactccctccattccattatataaggcgcaactattttttttaaatgtttcataatataattaaggaatacatgaatacatgccattaactagcattttctttcgaatcctccatactcaatatatttaattctattggttgcatgagtgatccaaactatgagatgataataattatttcttggtctttagattaagagtggttgagccttttactccctccgtactcataaaggaagtcgttttggacagcgacacggtctctaaaatacaactttgacttcttatttctataaaaatatttattgaaaagtgatatatgtatacttttatgaaagtatttttcaagacaaatctattcatataatttttaaattttcaaactcaacaatttaagagttattcatgatttatatttccaaggtttgacttaaacattgtcctaaacgactatctttattaatacggtgggagtattttggaatggaggaagtaactatttaaataatttttaagcaaatgagggatatcccatcgagtgatcaaaatagtttcccgaactttggtagaccaaccacccaca

SEQ ID NO: 23301 - DNA, 1501 bp, Oryza sativa
aagtgatatatgtatatttttataaaagtatttttcaagacaaatctatacatatactttttatatttttaaactcaataatttgagatttatttatgatttatatttttaaggtttaatttaaatattgttttaaacgattttctttacgagtatggagggagtatacgatacgtaggtgcgggcgaaacattgagggagagggcaagctgtgcctgtgcgtacgtcctcagcatgtaggcagactactgtgtacgtgttctcgttgtccgcgtggctagctagacgtccgccattcaccgcttctcgacctcgatccccacctgcatttactccgaatgattcagggatcggtacacgcagctagctagtctagtacacaagcctggaaagaacacagtagctagctagccgcttgggtaccatggtgtaaatcagaatgaattattagcatataattaattaagtattagtttaaaaaatttaaaaatatatgttaatacgatttttcgaagtagcttttctataaaaactttttgcaaaaaatacaccgtttaatagtttccaaacatgcgtacggaaaacgagcaggtaaagttggaaaagtgtttcaaagaacacacaaacttaaggccttgtttagttcccacacaaagaaatttactgtcacgccatgaactagccccgagcggaactagcccgtgacgctccaaattaacctgttaatcgataccagtcccaggaaacagtgctggtatcacaggaagacagtatatcacagcaacagaggtctctttattatagagtaggagtacagtcatgttgggctgcggacagatcccgagctcacaactacattacaaaagggaaagcggaagccaagacttggaccaaacatcacaggcgcgacttgggaactaggcagaaaccctaaaactcatcgtagccgacttgctcctggaagaactcctcgtcagcgggatccgcttcatcttcttcagcaactgggggggggaattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggataagacagtgcgtctcgtccgatcggagtatgtgcaaggtatcagtcttttgaattgatcaaggttggcatccggccaacagctttcaaacggccacccgggcctggctgatcccatcagccgcagattttccaaacatcgaacccaatccacaacagcaaatttcacaaagcagtagtcaaacaaaactacgctaggaatcacctcacatccgcccatgaccgtgggcacgactgttcgaacagtttaataacctctgcagagggggtacactttacccacacaacattactgacccgaatcacccagcccgtgcagaacggcca

SEQ ID NO: 23302 - DNA, 866 bp, Oryza sativa
tttactattcaacttactaaattttttagtaaatacgtagaaatataagaaatgcttaaagtacgtctaattaatattaatataattcacactaaaatcaattatatttatttttttaaaaaaaatatgaatgttaaacttagccaaaaatcaacaatgccatctactatcttcattctaaaatatatatgaatctagatccaaagaaaacattttataatattatgaatctgaaaaaaaaagacatagccagaattgtagtattagaatatatttcatccgattttagatttttatatctaagacgaaggtagtatggccgtgtttagttccccatccaaatttttttgatgtatgtgtacacacatttaaacatagactaataacaaaacaaattacagattccgcttgtaaactgcgagacaaatctattaagcctaattaatctatcattagcaaatgcttactgtagtgtcacattgccaaatcatggtgtaattaggctcaaaagattggtatcataatttacaagcaaactgtgcaattggtttttcgtctacacttaatgctccatgcatgtgtccaaacatttgatgtgacggaaaagttggaagtttgaagtgaactaaacacaacctatattcaaataagggttaattggatacatgccattaaaatttttatggttttgaaattaccactagtattcatgtatttggaaatatgccattataatttcacacatattcaaaagataccactacttaccccttggatgcatttccagataaaaatggaccaaactacccattatcccctcgactaactacttcccctaactccttcctcctctcttccttctcagg

SEQ ID NO: 23303 - DNA, 152 bp, Oryza sativa
ttcagatatagttcaagcagtgacgagccatgagcaacttcataagctaaaactacaaggaagagtacatcgcaatctcctgctagaagatccacatttcagttgcatcaaaagcatcacattatctggctcgtggattgttttgagcccga

SEQ ID NO: 23304 - DNA, 328 bp, Oryza sativa
gtaaccgtggatatcttgatccccaaacttttaaaaccaatgcaaaatgactccctcagtggttttgaaggtgtttttcattgacctagtccaaccacgtaagttaacatataaagtccacatgtcagtgactcctttccttccttacttcactctttcccatatttcctttgcacggtggtttacttttgtggttggttactagcgatattatgagcattatctcattctcctgagtagactactttttttctatatctaatccttttaagaagtaatcgaacgggtggagaaagaccatcaagttcttcgatatgatatggttttt

SEQ ID NO: 23305 - DNA, 457 bp, Oryza sativa
cccaaagtgaacttattccggaaaggaaacaatggcccaagccaatggttcccttgctttctaagaagtccgtttgaacgtgaaatttttgaaggattttgtacgattcgaactatttttatataaaataatcgtaaggatctctgcgtttcaattatcaaagaacctcccaatttcatttttcgaatcgaactatttgaaatctccccaaatctgtaagctcgaagggaggcctcaccgcctcaatcctcatccgggtctaactcgaacggtctgctccaatcgaccgttcctcctacaaaacggtggccgaattgatcacgaggggaattcgttcccgggctcgatccgattccttcttccaactccaaaccaacatacccttcctcgccgcggcgcgggatcccctcctcctccgtaccaaaccctaggcctagctggttccctcgggtctcca

SEQ ID NO: 23306 - DNA, 1501 bp, Oryza sativa
agggagtaaataaatatttatgattggggtttactccctccgtccaaaaaaaacccaattctagagataaatctggacacttagaattggactttttttttttgggacgaagggtgtaagtaacaacaccagtctctcttgcacatattgcatcaccacaaaaaataactaaatattttcccccattgatttagtgctctatgaagcacaagtggttccaataatcaactgatcatccgacagtaacacgacccacaccctgactttaagcaaaacatatgcatacttgttcaatggctgcatcttccaccaggggcgaagccaggataaatggtcgacggggtcaatactaatttagtgtatgatacattgttagatcttctaaaatagcgggggggtttttttttcaagaatcgctccataatactttgcttgcctatttatctctactacataaaaacagaatttatcatccaccctgaaagaaaaaatacggggaaaaaccagacccaacagaaaactaaataacggggaaagtaatttcatccctcgaggggatatccctcgtttcgttcatctcatctaaatagctagattaatacgaaatatatcactccacaaatatgcaagttaaaatttaacttctacaaattgaaacaaaaataacaaatataaatgcgaatgtacgataactattttcagtttatttttttattgtaacttgtagaagtcaaatttgattttgcatgtttgtagagtgatatattccttatcaacctatgttgtcaatttttttataactatttagatgacatgcaaacaatgaggggatatcccctcgagggatgaaaatccatatcctaaataatgctacgagcaaccattggcccataggagattgttgcaacgcacggacatgtctataaattatactacctccgtttcagggtataagactttctagcattgcccatattcatatagatattaatgaatctacatattatgtatagattcattaatatctatataaatgtgatcaattctagaaagtcttataacctgaaacggaggaagtattaaaaaccggacataattaatatgtaaacaaagtagacattaaatgcacaaatactcactgctaagattaccaaaatgtatattgggcctttgggctgacgtataatcattagcgctagctaattcctatttgttgcttgctaatctcaaacgtgtcgtttcaagttgctaattaatcaggctataacaaatcatggttaccggggtctagtgtttttatcgaccggggtcatacacggtaaaattaagtggagtaagaaacgtacacaagaaatcgtcggggtcagtggaccccgatagatggctatagcttcgcccctgtcttccactaaagttcaaacctgcagttccaagatgctcactccattagcggccactagccagtggcttcttaataactcttgaaagatcaactccaaag

SEQ ID NO: 23307 - DNA, 974 bp, Oryza sativa
ttgaaccaaaatgataaattgatgtgcctcaatctagttcttaatgcaagtatgctattaaatatatcctaatgatcaggcaatatattcaaagccacaaactattttcctacaatcattcctggtgaacaatgcacaattggacaaatgagtgaaaactagacaagccatatgccatgactcatggctaatttccaatcactaattatagccagagatttataacacaacaaatatagtggcatatgacatatatttttatctcccacaaatcacatcattatattataccaatctgaaccttaaatttctttcgaaagatatacagatgccgtaagctacaattagaacatatggtcccattagttgactatatactgatagtatgtgacacgatgtattagaaaaaattgcgaataaaaatattgtgtaaaactatgtttttaacgatttaaaagtaaataaaatttttttaataaaacattaaaatcaatataaaatttaaatttaatgtaaccaaccaaccctgctaattgagcaattgtatacgaaaagcacccgcagacatccctccacgaaacatcctgtctttctctaatctctacacacctggaaagcactcccccatccacctttccccccgaattaattaaacaactcgcaaaaatttatttatacttttcgccccaatccaaatcaccaaacccccatcaaagccaaaaccaaaacaaacaccctaaaaaaaaaaacaattttccttcccccatcctatacaggcgacgcgagcaaccacgcggtcgcagaagaaagagagagagagagatggcggcatgagcacctcctcctgcatcgccacctcccccgatcccccgcaaaccctagcgaccgcgccccccaccgccacctcccctgcggcggcgccctggtgaggagggaggaggaggagggggaggtggggaggggggaggcgacga

SEQ ID NO: 23308 - DNA, 198 bp, Oryza sativa
ctgtttggttggttaccacactttgccacgccacactttagtcatgctacagttttttaggcatgtgtttggttcgctgccgcaattgtgttatgccacactttcttaactttgggacccacatgtcatgctctcaaatttagagctaagtatgccacacttgtggctaactatttctaagccacatttgtgccacca

SEQ ID NO: 23309 - DNA, 1501 bp, Oryza sativa
ccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtatgtgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaat

SEQ ID NO: 23310 - DNA, 383 bp, Oryza sativa
ctctttggtactccctccgtcttaaaatatagcaatctagtactggattagacacaacctagtacacgaatctagacctccctatccaaattcatagtacttggtttctatattttgggatggagggagtacatttatagtgtaaatatgtctttgcttcaacaaagaaaattgcacggtacttaaagtaagtattgagttaaatggttggacaagaaacctctagtattactatggactttacaatatttgtaatgttctttgtggatcatagaggcacacctcttagatgatatcaggttatggttaactatggtgttagaagattatatattatggtggcctcttttatcgtttacttcactgttattatttttattccc

SEQ ID NO: 23311 - DNA, 562 bp, Oryza sativa
acttaaccaaatagggatcttataacctaaaacttgtctaatctgttggcattactgtccctctggcgcaggagcagcaatacccacagtactctgttatgccacatacataataagattgttcactttcgaattttttttctgttttaatatttcttaactaatcgtactgaatgaaacacaaggatgagaaatttcatagcatggggccctggaggcctcgaccatggtcatctcatattcccggttacccctctctatattctctaattagaacaagtctaatttgcctcctcacagttgctagttgtctccctcatcctaaaattggatatgtctccccatcttcaaaaaccagtgcaagttgactgtggttgacttgctaagtcagcaggtgggggtccacatgttagggatcagaggaaggacttctctcctcctcttctttgctcttcttcctcgcgcgagtgtgaccagatgaagccagttgtagccgaatgaggatgtagcgatggcgggcggggtggatggtcaccacagggctggaaactatagttggcca

SEQ ID NO: 23312 - DNA, 1501 bp, Oryza sativa
cttcacggttgggatcatgtttgccgtcgaactcgaatgctgtgcgggatctttccttaattggcgccagtcggcatttgatgaagtgccgagtgatttgctctccctgtaagccttgttctttaagatttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatttccttggcagggagaacgccgtgcgccaccatctccttaagattctcctccgttacgtcggatgtcgcccattggctttcgaagctttctccctcttccgccatcggtttcactcaaatgtgctgatttgattcgagggatggcttgggagaggtgagggattgaggcggtggatcacgagaaggattttgatgcacttttcggaggtggatttggtcggagttgtgaaccctagttcgcaggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgataaaatcctttttatgcggtcatataattctttggaattattgcaatgcaaattaaaaaggtgcccgacagaaaggcgttatgctgtttttgcaagcttttttaggctacaaaaactgtttgggttaactaggaatgacttgtttttattatagtcatttccttggcgtcttatatgcctgtttttatggtaaatagtcatggcctaggctatttgacttatttattaccataatctttataatacttgatgagtaatctttagagtttttattcggatgcctgtcaagtgtgttcattcgtgaaccttttagagtgtaaaccactcggatttcttttattgtggctaaaaagcagtcggctagcatg

SEQ ID NO: 23313 - DNA, 156 bp, Oryza sativa
tatgccacgtaggatagatacacaacgaatccatacctctcacagtgcagggtacgatccccaaaccaaccaccccaacctattctctctcccgctttcccctttctctccttttccctttccctctcctactttcactcccaccgacccgacaga

SEQ ID NO: 23314 - DNA, 926 bp, Oryza sativa
ggattgatttttcggtagattggatcaacgctctgataccatgtgagttttctctattggatggaaactctcgcactcacgctgtgcggagcgttcgtgttaattagatcggaacagccccgattgtggctatacatgtgcgccaggaagttgcccaacaacctgggagcgatcaccagggagctacctaacaacctggaagagattacatcgcatgcaaaacaagattaactagataataggaactctatctctaactgcagatcatgatcgcacgtggttgcatgtgattgacgtggaggataggatagacttcagaagtagtgtaacacatccggcggcatggaggtggccaccacggcgttcaccagccttgttgtcgctgtgttgtccgacgatggccaccacgggtcggacctaagctgtgccaggtgtggagtggttggagaaaaaggatagagagaggagaagggcactgcaagtaggccctacattttttcttatttttcccatcacttacatgtgggccgaacttctattttgtgattgggctaccacgtcaacacatgcggaccaagtcaacacgtcacgtcagtgaaaactgctgatgcgggagtccaattatacatgttttaggccctgtttctttcagcttgggattattataatctagattattgagtcagattagtataagctagattgttataatctgtagtagaataagtggttagttgtttcttttctagattattagagcctagattattaggtttgcaagtctaaagagggagtggggtggcatggtggataatttttcatccaataatctggaaaaagctcacctaaatgagcttatcagattataataagctgggctccagattataataagctactttaataagttgtctgtttctttcagc

SEQ ID NO: 23315 - DNA, 1501 bp, Oryza sativa
cgttttgtggctacacggtggtggtggtgccgtgtggctggaggctgggcgggtttttggtagcggctaaccgggtatcggttgcaaaagaagggttacacataggttgattttttgttccaaacttaaaggctggttagctcgattaagagcatcttaataatattattgtaatctagattatttagctatatcactataagctggattataataagcataacctttatgtctcttaattagtagctatttgttagctgttagctatccaataatttttaaaaaatcatctttaaagtggattatcagattatagtagtatggcttatagattgtaataatctatcataataagctatctatttgtttcagtttactcataataatcctaaactaaatcaaacagggtcttagcaggtttttaacttattattgtttaactcgataggtttggagtaaagttgtggaacagtgtaaaatcctgttccatctttattttctgaaagcattttagcttgctctactttcttttcgagtggattgcagctttagaagaggggggcaaacttaaaagaactctaaacatttaatcatgtaaaaagataataaacatagatgcttaggttaaaataacacaatatgtattctatgctatatcatgaaaatatgaaaaccagactaaaaatattaatgttttcacttaaactaatgttgattgattaaacatgcacactattaatgttgacaaataaaattgtgagaccgactatattggatttgtttgtatgcatgtacgattttagtgtttatataaaccaaattaatagtgaattttacatacgtattacttcctcctccgtttcatattataaaactttctagccttgcccacattcgtatatatggtaataaatcaacacacacatatatattaatatgaaatagagggattattttatatcgtaatttttatatttgaatttggttggataggttccaccataaaaaaaaccaaccagttaagctattgcttaattcatgattgatcgaatatataaggagtataattatatcaatgcatatataagttaatggttgttcgatatgtctaacgcaattgtgctttcaaagtctactttatacacaatactgccatggcttcctcttcctttgataatataatatatagataaatctctaagataatttgcacacaatattgataatttcttttcacattgtaactatgaagataatctctctaaaataacttgcacacaatattagtataaatatagagataattcatatcttatacattataccacttagttttctatctattactctatcttataaatacgtagatgattatttagaatggagggagtagaagctaagagttgtgtattaaatttaatttgttggctcgtgttaaattacatgaaaatcccgtttgtgaagataaaacctttttactgtttttgcatttagaaattta

SEQ ID NO: 23316 - DNA, 156 bp, Oryza sativa
attgttctgttttggtactgataggagcagtcaaaagtttcttttctagctcattctgtaagctgagtctaattgattctttaagacatcgatcagatgaccattttaaaccagttgccttttacggttttgcattgattatacatttatactagt

SEQ ID NO: 23317 - DNA, 195 bp, Oryza sativa
cccggtgatcctcggtctcatggggtaactgggtgatgcaattcattactggttgggagttggtagtagtcgatacgcgcaatacacgagccgcacggactgaaaactgatgcagttcttgaattcgcaagaattgaaacagaaaccgagactgctttgttgctgtcgccgaaatgttgcattggattctgcagg

SEQ ID NO: 23318 - DNA, 473 bp, Oryza sativa
tcctgcagccctgacatcttgatggtattgccaagcggccaggcatattggaccaagtctattagcactattttttttctcattctacagtagaatacactcgcagcttacgcaagaatcaaacacatacagcacagctcaaacaaaaattcagaaagcttaataacttgagagaagctaagtccaaagaaaatcttagctatcaaatagtacatactcaataaacagaaccatgtaggagttgtactacctccgtcccaaaaatataagggaaagctatgcatttacattgccaaaatcccttacattttgggacagaggttagtatcgtttttgtaagtgtagtcataacattatattatgattagcaacatttctatggtacaaacaggcatacaaaccaatgtcatggcatggcttattagatgaattagttaacagcattcaaatgggaataagaatgaaatccaaaa

SEQ ID NO: 23319 - DNA, 525 bp, Oryza sativa
catctcctgcgcgcgggaggccgcgtggtgcgagcgagccgcggggacgtggtccatgggagattgtgaaccagttctgtgcgaggacggctgcacctgcagctgcacgggtcatacgactcacgagcgcgagcgggggccgcctggccccagtggccccgcacgcgtcttgcttactcggaacggctttaaatacacgtcgcgctcgacgtcgacgtcgacaccgaaatcggacggacgccttcgccacaaagcaaacccgatctaatcaaccgtgacatcccctcgcctcgggtccttcgttccctcgcattttcccttccattttcacactttcacacacccgcgccacacgagggggtacataagaccgagctcgaagtctcaggagagcgtggaagaggaggcagttgctcgtttttgtgtgtgagagaggggagaggccggcggcgatggggaggacgctggacgtgttgctggggcggacgacgaagcagacggcgaggctcaagtcgatgctggggc

SEQ ID NO: 23320 - DNA, 252 bp, Oryza sativa
atccacttgggtggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaa

SEQ ID NO: 23321 - DNA, 1501 bp, Oryza sativa
ctctcaatttatctttctcaatctctctcaaagctttcaatctttcatcactaacctcatctattccgtccatcattaagttgtgataatctactgccgacaaattattttgtctggccaatctaagggcgtccagattcacctcaacatgcaaaatggcctcttgcccatatactaattcaaatggtgttacctttgttgcaccatgcttagatatacgatgagcccacagtgcctcagacaaaacctcgtgccatcttttaggatgttcctctattttcttttttatcagcctaattaaagttttattgcttgactcggtctgtccattggcctgagcatagtatggtgatgaacaaagcaacttaattttaaagattccgtaaattcacgaacttgatgtgacataaatgatgatccttgatcagttgtcaaggtttgtggtatgccgaatctatgaataatatgctctaaaataaaatcaatcacttctttatgggtcatattttttagaggaacagcctctgtccactttgtaaaataatctgtagctactaaaacaaatcgatgacctttggaagaacaaggatttatcggggcggatgaaatctaaagcccatccacgaaacggccatggtttaataataggatgtaacatagcagcagacggctaattggatatcaccaaatttttgacatgactcacaccctttataatatgtaaagcaatcttctaacatagtgggccaataaaaaccagctctccttaataaccatttcattttatgagccgactgatgtgtaccacatataccttcatgtacttcacccatagcaaccttgcttggtctaaacttagacattttaaaagcaacccatctacagatcggcggatacaaatctccattaagtaatatatattttagggcttgacgccgaagttttctttcgacagtctgactagggttctcaggtaactggttaaaggttttctccaatcatcaggatggaccacataaatcttaacatgctctagcatcggtctttcaatcataaacaatttacctctactgactcgataacgggatgcttgttgcgctagattattagctagaacattctcttccctagaaatgtgtttaataacaaaatcatctaaatttgctatgatctccaaacatttctccaaatacatattcagtgatccatcaaagcattgataattcctagaaacttgttgcacaactaataaggaatcaccataggcctctatattctttacatccagggattctaaaatttgcaatcctcgcaaaagaggtcgtactgggcttgattattggtgcaaaaatattctaaatggacggatgtctcaaaaatattgcgtttggtgaaattaaaacaacaccaacaccgtgttcctctctacaagctgagccatcaaagtaaagtttccatgggcatacagacgagtaactaaccctcttcatatcatcattaa

SEQ ID NO: 23322 - DNA, 539 bp, Oryza sativa
tttcagtctggtcgaggatggctgccagcgcagcgttgctctgcccattgttccttgtgttcccgacatgttcacaggcgcaggaagatgctctgataccaagttgtcacggcccggctgtcaggagctgggaattgaaatggatgaatggtctctgagttaactgaatatctgaagtctgaagattctgaagaaaatgcattggaaggatgattatgagaaaagaacggtcaggattaatcgcgaatcggaatgaagatctgagagtccgttcttgtcgggggaccactgttgaattctagttgtcattttactctgcttttgagctggcagtagtgcatcctatgatgtggtcctgtctcacttttgtttcaattgtaatcgcttcttaatcgagctagttagcctggaaattataagagaaacctcatatttatcttgttttaggagtagcatagcatagaaccttaaattagtcttgcagcgaccacttgagaaatttcccgattcggggttctattcttcatttcggtgaaaga

SEQ ID NO: 23323 - DNA, 332 bp, Oryza sativa
agaaaaatcgaggtagttccaactatgaaataaccgagatagcagtcatgtctttctatttattaataaatttcctgtgatggctttcagattttattgtaccttacataaagttcattgttagcaacctagcatcaaagcttaccgctgtctcagaaaagcatttggtgggaaatcctttttgcacccactagaaattagaaaatacaccattttagtgcttatgttcgtttgttaatgacttgtttcaagtgtatctaatggtttagtgtggatttttttctccttctttatggctcttgttgatatttgttcattgttttggggaacca

SEQ ID NO: 23324 - DNA, 1501 bp, Oryza sativa
tgtgtggaatatcattgtggttattaagctttgaaaatacatagtatattaagaccaaattaatttgctaaatatatcgttgcaggtctaaaatctaatacatcagatctttaatgctaacagccggatataaagaaagtagataaaactaattgaggaacggatgttgtgattaattgaaaagtagatgtaggtggaaaaaattgaatggtgaaagtttgtgattgaccgagaagagaataatggtggagttattatgttttatgacaaattttaaatattagaagttgctatattttaagaagtaccactcaacgatacatttaggagcgtcaagatagacattgtattataagctcctcaaccaaccaatgtaaaagttcgaattaaaggcttcttcacattgctaccacttttaagttttaaccctaataatttttgttctgtaagtatgaattaagagctcttcaccttgcttccacttttaagttttaatgctaataatttttggtgttatcgataacaaactaaacataatattgtatcatcactctaccaaaatttgacatttcaaaagtttcttctcacataaatactagtaattttttttggcacgaatactgtaatttttgataatgctgcaaactaaacatataatgctacaaactaaacatatctaacattgccaaaatttagtaatactaaaatatgccaaaatttatgaatactaacttttggtttggtttattttcgtgacaaactcaaccctgaattccttaacttcacgttgcgcctaggactgacggttttcgttaaccgagggactgcactgcagtccccattaccgttcaccgttaacgggcccgcaattcaatcgatttgttggtcagcccatactgtgccatctcaacgcagcagctcagtagtcaaccaaatgtaactagtctcttcttaccggaatccccacaccttctcgccacggtccgacgcgcaagcgcggcggcgctcgctctcgcggttctcggtgacggcggcctcgtcccactcccgcccggggatgaacggcaccccgttgcgttgccatctctagtcgcgcatgaccacccgcgccggcgcacctctcgccgtcttcctcgtctcgtccctcaagtcggccgccgcacgcctcagccacggcgagcagctccacgcgctcgctgccaagtcgggcctgctcacctccaatcttttcgtccgcaactccctcctcgccttctactcccgcgtcgcccccagcctcgcctaccacctgttcgatgaaatacccccgctcctccgcgacgccaccgcccacaacattctcctctccgcgctcgcccgcgcgggccgcctcgaacgcgcgcagtgcctgctcgcggagatgcctcagagggacgcggtctcgttcaccactgtcatttccgccctctcgcgctccggtcatcctagcgcgccctggccgtcttccgcgatatgctcaccg

SEQ ID NO: 23325 - DNA, 1501 bp, Oryza sativa
tacaagaaactcaattgtcaggtaatatctcattatataatgcatttgttatccaatcttgtatatgctttcttttattctaatacaaagttttgaacttgctgctggtgctactcaaaagcaaataaaatatccaaactattgtcaacaagacagagatgatattttcaattattatggaattttttgcaatttgaaatcttggccggtaagtgttcccttacaacagtcactgtgtaacctttattgtcaaattgatattgcaactgtatatgttcttatcctctccttgttcatatttgtcggacatcgtttaaaatgtttgtcatggtataataacaaaaaataaaagtgattcagtcataaatattatgactgaaagcaatgcacttatttgcagcctagtaaaagagtggagctataacaagtaaggggaaatagaaaaatggaagttcatatgggacacgtgatagagatgattggaatccagaataaacagaatttagaggatgctatattttggatgtaatcttaatattatcatatattaacatggattcactctggaggagaaattaagacatctcattggcacattcatgtgtataggcacgaaattgaactaaaatcatgcccatacatgtggataggcacggtttttgcccatccaaatcctggccttatggaactgacaagtcctgtaaaatgtcatatgcgaatcttgaccttgtggaactggatgtcctgtaaatttttagatgttacatttccaagaagaatatgttctgtagacaaaaattgtttttctaataactagcattatgcctgtgtgttgcaacaggaggaccattatgaaattttctgagatatttagaaattattttgatgtatttcttatagacatttaatgtgtatggatttttagaaacaaaaactattttgaatgaaagtctataagatcttttaggctgaatctggatgttcccatccatccctcaaacccacctgacgccctcttccccagggacctagcccaccttattttccaccagaataagttcactcaggtccctcaatttgtcattgagtctgaaattcatccctgaaccgaaatacagatactatgtgtccctcaactcccaaaaccatttcaaatagggttaaaatgaggggctctggtgtgtgtgcggccagcaggggtgaggggccggttgggaattgagcagcaaaaagtagctgccccaatgttaatgctgcagtgcaaggtgtaccttccccacctcttttctctgtagcaaccttcatttgctgagagccaggcacattaagcagcacacatcctgaagcgcatccaacggtgcagattatgggtgcagatgctccagagttccaaacggcattttcatatattctggtcatccccttgcaaacaattgtgatatgtaatagtcaatttttttcaagaattcctttccgatctgaaataataaaatcataaaca

SEQ ID NO: 23326 - DNA, 488 bp, Oryza sativa
gttagggacatcaggtggtcggttttacctggccatatggtgacaccgtctgctgccgagcggcaacagcagtgttgtcatgccacctggcaaatcaggtatattctattatttttaaaaaaaatagtatatttatgcaaaaaaagggtgaacattgaaatttagttctaaccttacctgtccattctaatggccaatatgcagccgatgttttttggatgggaattttgacagttaggctaatcacaggaccaattaattattttatgatttcactgtttccccagatgtgttcagaggaatctcatggaaccaccatttggctgtgccttcttgtgtaatgccaaatatacacgtgtatggattctccaaagcagaagatcctgaatatgacttccatgaggtaagcagcgagtattaccaaaattttttttctttaagttagaactgttgtatacatagttctgtttatcgattgacacacaccc

SEQ ID NO: 23327 - DNA, 497 bp, Oryza sativa
atatgcgtgtatctgatctgtacttcaagtcctagagggcagactacctgttagcttcgtacgttgtttcgggccatttatttccctccggaagaatattctttatgagtttcaataactcacaaaatgccttgtcagtcacaccatttttttgccttccattgaagaattccagcgtattacctaactttttatgccctgttcacagcctgggtacaagaacattttgtggtccgttaacatacgctcaaatttcgtgacctccttttcactttcgtagtccttctttgcgtcgtacaacatccgacaaaaatcatctgcactgtcattttctgcaacaggcccgcctgtcgcgcctgttgtattttcttcaaattcaccgaattgagcctaatctggaatgttgttatctttttcttcattttcaaccattggaaactgtcaaggttacgggtagggtataccctctacccttcgatatacgtcacgtatcgata

SEQ ID NO: 23328 - DNA, 425 bp, Oryza sativa
gcagatggcttcgccatagcaagttcaacttcaaggagacccaagacgccatcttagccgatcaagcccaggggccactgggccagcgttccccagtcggcccactagaagcccatgtacctcaattacactatatacccatgtaaatgtccctttcataagggcaatcatataaattcccctgtaaaacctaaccctaataggggaacctgtaatgggattataaatagacccctagggtcatgtaaaaggggggatcctaagaaaaattctcaatttaatacactttaagcggttgtcatttcgacaatagctggcgccaaccgtggggacctccgagcgaaaccactgagagcgaatgccaccgaagaaggtcgcaaaggagaatgttgcaaggcgtaaggagagtgaagcaggagtggaga

SEQ ID NO: 23329 - DNA, 741 bp, Oryza sativa
ggcttcgccagggagtcaaggcccgcaattggagttcagcaatgccactcaagcaccaaccatcggaccacaggcacggacaccaggcttgggaaggaatcaggcgccaaaccaggtcgccatggcatggacctagccttggttcgacccatccagggcggctcatcaggcatcaccgttagcggccaggcagccgaacactgtggccaaaccgcacgtgcaagccatgacttcgcccttcgccatgccatatccaaacaggcctctacagcaagttgccgtgagcaaggcggggggcgaaagggggctgccgctgagtgggggaatcaagattcatccaatcccatcccagttcaagttcccacccattccgcgatactcgggcgaaacggacccaaaagagttcctgtccatctatgagtccgcgatcgaagccgctcatggcgacgaaaataccaaggcaaaggtaatacatcttgctctagactgcctcgcccgttcttggtacttcaatttaccagctaatagcatttactcatgggagcaattgcgcgatgtctttgtccataaatttcgacgcacctatgagtagccgaagacagagcaacatctactcggcattcgccagcggccgagggattcgataaaggagtacatgtgtcgcttctcgcaagcccgatgccaagttcaggacataactgaggcgtctatcatcaatgccgcttcggccgggctgctcga

SEQ ID NO: 23330 - DNA, 1005 bp, Oryza sativa
ctagaggtaaaacttgctgtggcggcttgtgttctcgggattagtgcttccatctttatgatactctaatcttgtttatgtaattcgtcgggttatcatatattctatataatctttgataatatcgttatctaaccttcaatcggctaacatctatcattggaaggcagccgattaggttaaatatctatgttggcttagatcgtacaggatattcaccactctatgaaacatccaactgcttgattgtctagatattgtccttcttttcatacttatagctgcatcagttgagtttgacgttataagtcgtgattagaatctcaacctctagcctgcttttggttgccgattagggtagtatcggggtttcacccgatcttacctgatttagccttatatttcatatgcttaattgacatgctagatctgccttttatattatgatcttagtacaacaaagtatgttaggcttccgttttgatatattttgcttgctttaatatcttaatatagagtggtatcggagtattagccgatacatgctagatctatctgatctgctatgctatgagcatctataatctcgttgttaatatatatttcaatctaagtgatttatactgtctcggtatggcgactgatctatcccaaccacttgatttaagtatatatcgatataaggattattagttgttaatatctacagccgatcaagtagatttagtcttttgttacttatttatatctgccgatcgattcaaacatgacatcggctcagagataaatgatgtcatcggcaactagccgatcggctatcatttataaatttaaccgcggtttctttgtctttatttcttgttgattgcaggatcaaatgaacttggcacgctcacgaacctaaaggcaagattttggacctgcactggagttaagcagatctcccaggcctcctgttttacgcatcaacacgcttttggcacgcccggtggaagacggtaaaca

SEQ ID NO: 23331 - DNA, 779 bp, Oryza sativa
tatctgtgttttcactgtaaagagaaaaaccttaattatttattgcgcaataaatcatcccagctgacatcatccaatgggggggggacatgcgggacccacgggtcagcgacacaacaggaggaggaggtggcctggcgggtgggccccaccaggcggtggttcaaaggggaggaggaaggcgccagcctggctcggctcgacttcaagccgaccggctaagcatggcgagcggcggcggcatgcggtcgccggcgacggcaaccggcggcgcgggaggcggcggcggacagcgcggaaggcagcggcgtcggccgaaggtgacggcggtgcacgcgcggagaacggcggtgcacacgggggaaagggaaagagggaggagaggggaacctcaccggcgggtatggcggccggagcggaaggcgaaggcagcggtgatgatcggcgacgcgaagggacggacgggcggcgacggcaccctaggagagagaggagaggggttagggcttgggaggaaacccgcggcgaccaaaaatggccagccagagatggagagaatggaggggaagctctggaggagtgcccggaagtttggcgctcatctgacttctacctcggtacactctgctccgggttcagagaacttcttctataaagtaagcattcgtgttcctttcttatgttatttaattactttgtctaagtaagatagattttcatctttgcgggttcattgtttagtattcatactaagtgctctagtactaggactctggata

SEQ ID NO: 23332 - DNA, 1501 bp, Oryza sativa
taaataaaatttaatttcataatttgaataaacaaatactttgagtttctcaaatttcttttctgtttttaaaaataaaggaataaacatacacaagtaatgagtaaagataaaaacaagtagtcacagaagtagcttatcccttttcccttcaaaaaacctcactcactcatgtttctttagcaacactccaaatacatggtagcaaaattccaaacatatatggtagctacatatgtctgtatactattattaaagcctatttacaaagctttgaaaaggtactttatatgtgaattgttgattaacatgtttgtaagacacaaacaaattctgttgaaaaaagtttcttgatccacctcgataaataactatactacaaattaagttttatgaagtgccaaacttttatggtatagccttatcatcataacttctttccacgtatttcttaaagcattggcaaaagatagccttttgaatatatctacaacgtcatcttagtatctaccatgtattcttccaaaatattagttgaacaattgtccaaataaatgtcatgcctcatgatttatagcttatctagcctccattaggtagtttttgcaaaggccaaaatattacttacctcgcacgacttttagtatgtataaatagtgttcctcagcaaccacgataccatcaccctcaacaatatcatagtagcactgtagtgccaacaatggcagcatacaagatcttggccctctttgcgttacttgctctttctgcaagcgccgctactacaatcaccaccatgccatatctccaaccaacaatagcaatgggcaatatggatccgtgtaggcagtacatgatgcaaacgacgggcacagatagctacgcaacaatgttcatgccacaaccaattgctctcctgcaacaatagtgttgcatgcagctacaaggcatgatgccacagtgccagtgtgggtatggtactagttgccagatgatacagaacatgcaatatgctatttgtggtggacttggccaacaacaaatgatgatgaagatggcgatgcaacttccaaacatgtgtagcatggcccctgcctacttccagctctctccctatggttgttgttaaccaaaccttggttacatgtactccaacagtaaattgttgcatactatcgtgtgcgactggctagaataagaatcatgaaataaagtttcgatttatgttcaatatttacacttgtattcccacgtgggagtgtgacccatcactggatcaaacaacgttgctgcctaagcctaaccgactaacagtggcctgttagttgggccgggatggtgtactgtcaccgacttgcgggatgttgttttatgggccatcatcctcccgctccaagcccatgagtgattatgcgaagcccattaactgatccacgtggcccgagatacttttacttagcctcgatggggtgcgactcgatcactcaagcagtccagccca

SEQ ID NO: 23333 - DNA, 1247 bp, Oryza sativa
  unsure (1)..(1247): unsure at all n locations
cgacctgcaggcatgcaagcttnnnnacttgggtcatgcttatcagagaaggccaacgtggttttgcccctgctcatctagttatcatgttaatttagtcaaaactcactcgtccttgaaccttatctactcaagcaatcacaatacacaaggaccatgtgaaataattctttgaaacattaaccccacctttatatataagaatctagaggtctagaacacgttgaactcatgcaattttgtgagctgtcgtatcacttccataatgagattgtaattgaacaaaacatgtttatcctatctaagatgaaatgtttgcaatctagacatcatttttggtgtctccattactaatcacatcaagagtgacaggcattctaaatttcaccaccccaccattccaatttgacatgtgatgatccaaaagaagaattggtcatccctacacgactttacttactagttaaaaatatagttatattttcagtttaaagactccatatttcctgtagtgtctggaataattaaataaaatttaatttcataatttgaataaacaaatactttgagtttctcaaatttcttttctgtttttaaaaataaaggaataaacatacacaagtaatgagtaaagataaaaacaagtagtcacagaagtagcttatcccttttcccttcaaaaaacctcactcactcatgtttctttagcaacactccaaatacatggtagcaaaattccaaacatatatggtagctacatatgtctgtatactattattaaagcctatttacaaagctttgaaaaggtactttatatgtgaattgttgattaacatgtttgtaagacacaaacaaattctgttgaaaaaagtttcttgatccacctcgataaataactatactacaaattaagttttatgaagtgccaaacttttatggtatagccttatcatcataacttctttccacgtatttcttaaagcattggcaaaagatagccttttgaatatatctacaacgtcatcttagtatctaccatgtattcttccaaaatattagttgaacaattgtccaaataaatgtcatgcctcatgatttatagcttatctagcctccattaggtagtttttgcaaaggccaaaatattacttacctcgcacgacttttagtatgtataaatagtgttcctcagcaaccacgataccatcaccctcaacaatatcatagtagcactgtagtgccaacaa

SEQ ID NO: 23334 - DNA, 1501 bp, Oryza sativa
ttaaaggcattagatcataaagtgataacaaaatgtccttaccctgtttgtttttataatacatatagtttcctcaaatttcttgtgaaatataagaacacatgcaaatttattgatcctatcactgtgtatctctcctgtatagcagggatacttttctcctctctctcttggttcctcactttcatgcctttaatccttgtggccactaaaaatacgaattattgtttataatggagggaacactcaccaagaccaactgcctgaaacttgtgattctgggagatgtttctatgagtcaactgtgtcaaagcaaaataaagaccagcaacatctataaacccaataaagattttcatcaattcctgcaaagggagataacatgcaaattagataaacgccaacatgttaaacacaattaggttttgctaaagaaaacagaaaatgcacctgataaggatcaaagctatcattctcaggtactttgagcaatgtcgctaagcaaacaagctgtcagttaaatttgtcaaggttagtataatctcctttatttgaatgaagaaataacagtgataagaacatatatttaagaagcatgtgaaacaattaaaacagaaagtaggtaaaattacaagaacattttaaaaaaaatgcaaagtcgaaaagaatcaggatgacaaacttggatgagtttaaaattaaatccatataataaaaactgcatagatgggaagataactggtccataccatgcaaaatgatatatatgcaattgatacctttgtttaactaattaaggaatatcacaacaacaatcaaagatgaacatatatgcaataagtgttccatgacccttaaaactggtatgttacagaaatataccactattccacataagaaaatggtatctaatggctatgccaaacatgtgaaactttctgaatcaagaaaagtagatcacaagcgcacatgatcaaacaactaggaacacatcatttgagcctagcaagcttggcacttaccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatat

SEQ ID NO: 23335 - DNA, 169 bp, Oryza sativa
gaaagtaggctcccgcgcgagctccggctccgggtcgctgtcgctgaaggtggagagggaggcgttggaggaagcggtggcgaaggagaacgagccgaaggaggagggggaggggagcagcatgaggaggaggaggcagagaagggcagaggcgaggaggaggaagcca

SEQ ID NO: 23336 - DNA, 385 bp, Oryza sativa
taactatgaagaaaaaagggggaagcaccatttgaatttttttaaaattcatttaatttaatggcaatttaaaatttaaaactgtacaaaaccatatccattccacccagtgcggcccaactgctgcccgaggcccacactgaattcctccctcactttcctcgcatcgcaacgtgcggagatgcagcaacgtctcgacgagtcgacggcgccgcgacggggagcggccgtcttcgcatctctcccccattcaaattccaatactccaaagcaccgttaatactactacttctctcacgaatccccaatccctaaaatccccgtacgccgcccgcttctctcctccgattcctccgccgccttcgcgccgccgccctcgcctctc

SEQ ID NO: 23337 - DNA, 1501 bp, Oryza sativa
attttggatgggcggttagatcaaatgctaaacgacacacactttgtggtacaattgattacctggcacctgaaatgatagagaaaaaggctcatgaccatgctgttgacaactggactttaggaatcttgtgctatgagttcttatatgggtcaccaccttttgaagcagcagaacaggatgatacattgaggaggtaagacctactgtgttgaatgttttgtccaatcttaatttgttacatgttttcactctccttaatatgaattctgagcaggatagttaaagtggatttgtcgttcccctcaactccttatgtttctgcaaaagttaaggtttttctttgcaaggtaaaatttggggtattgattacccctattgtatatgttacactaaaatgggttgaacttttgagttttgagcttcgagttcgtatgcagcttttggtgaaggattcaaacaagagactttctcttgatgacataatgaaacatccatggattgtgaagaatgcagacccatcagggagttgtagtgaccaaaaggctcgcacataatacctttaagaaacaaggtacattgggaggcataacgtgctaatgaaatacacaccttaccttcccagtgatcaccctagtatgctgagctaaacattaaactttatacacatttggtcaggctacattaaaacgattctgttctgttctcattatggactataataatttgcttcatttgtttgtgaagcattttaggcctactttggattgtaggaattctagatgatattcggaggtttcatttcctgtattattgagttactgttcacccctttggattggaggaagaaggcataggaaatttggaggaatttttcctttgcctttgatttcgtaggtagtccaagcaaatcaatgcatgttactccaaatgatcatagttttaaacacatactaaggaaaataatacacattttatgcttatttaggaagagtcctgtgttttactctatttatgtgttccaaacgatatgtatcatattttcctatgtttttcaatcctatattttgcgtatgcaatcctatcgtattactacatttttttctattcctgtttttccaattcctgcactgcgaatgagcccttgactaccaatagtgtccttcagctttcccaaaccttgtctgagactctactttggaagtggcaggttaagggcttgtcctgtaagatttaggtgctgtgagaagttttgaaattagaccaaagtgtagtctgatgcagcatacgaggagttagtttttccaccttgtgcccgttctgaatttggactcaaatccttgtggctttccctgctctcttatttgtatttattttttggctcttttatgcaggttactccgtgtcattgagggacctggtgaaggctggtgtagtattttggcgaatgcgttgtttgccagtggcccgtatttttttagctaattaagtaattatggat

SEQ ID NO: 23338 - DNA, 1030 bp, Oryza sativa
gtgattgaccaaattacaaaactgatctaggggctgcaattctctcgtaaaattataactactcccccttctctagttgttggtgaatcaaattgcttgttgctgtttcatttgaatgctaaactagatcaatagaatcccatgtttagcttgtatgctgccaaccaattaccatgtattggaacagggcttccaagtattagatcgttttatgctgaaggctataacataaagtgcaatatttctatgtatgagcaataccatatgaatctcttcacgtactaatacatgcaaaaccatttggtaaagtgagttgtatagatgcaatgatggactgcttttttcaattgatgctatgtaatttatcttaaatgtgacattctggctgcttgagctggaatttagcttaacgacaaaatataagattggatggcagttggaacagaacacaaacattttctttaccatattatttggacactaccggttgttctgcgtggaatggaagggtcatggtctcatagatggcataactaggcatgcagatgtgtttttgtggttaataccaagtgtaaagcctgtaaattctgttagtaagagagtgcagtgctttaatgtgcatttggaattctagaaatattattagcagcagaatgcagttgtgtaaatggcattttaataacatgctattctatttgatagatagttgtaccatgcaatttagagaaaggctatcaacatgtaaataacaaggcagatgttgcaactctgttggcaaagtttctcgtttaagaactttggtagagatattttagatatttgatttagggttatgctattgatctttctttgtttgcaatatagtaatgtatacaatggttctctgtacgtaacagtcaccaactaaaaattacttaaaagagggtatctgttttccatatcctgtaatcggggcaagttttatgtaactaaaagggtacttttgttttttaaagaccggtcatctgtttcacgcaatctttgttttagc

SEQ ID NO: 23339 - DNA, 1501 bp, Oryza sativa
tgattgttgtacaatcatatcaagattattaagcttgcagtctacttggactcaacgaattaacagggtttctccatttgtgacagcaagagctacccaaagaggaaattgcaaggatggtgaaggactccgagggagatccgaggtacctgatcaatagcatccatcaccgttcagatctaagaaagaagatggctgagaaatctcataattcactatcatcaaactccctggggcaagctgcgaagccaaggcctttccctgtgcctgacggattgccgaaaacacaggaagagcttgctgaagaacaggaggccctaatgccggagtcctcctatacgaggctactgagaagaatggggagatttcctgattggtatacgcctcgcccagatcatgaaaccgactgaatcaagtcaccaagcatccatataccgctccttgtgaaaattttgtattggttgccggataattatgatgcctgaagttctgtggtttgggtaatgcactaaggttcagcagcgtggtagctatccaggttagattgctgttgcttgctttactgaatgtataatggcgtgtgttttatgctgttcaggtcttcccctcaggattcagatagctccttccctgtaaactcaagcaatgtcccatgagatagcttgcacaaatttgtctttctgtatatatatgttctggaatagagtttctgaatctgtttcctggagttaatgatcaatcacctgttggatggatgatgaggatttcgatggttgtatcccagttgaacagagtatgcttgcagcacagttttgagttcagagaaaaatacagcgcaggccatgcctaaattgcaggcgatttcacttgtttcatcttggccacggaagaagagaattcagagagcaatcccgttctctcttttgcaggcgattctcgtttgcgtcatttttcaccgacgggcgatgacgtcagcagcgagaaactcttgacccataaatacccccgcgttatgcgcgaaaccccgtagcgcccaccgccaagaccgcccgcaattcggcgcaaccgctaggggcaaatccgtccatccatttgccccgccacgcgccgggaactcttcgtcttcctcgagacaacctcccgccatgtcgcgcttcagggtcgtggaggatgaagctgaggcggacctgcaggccttggcgaggcgcttcagcttctcgtcatcctcctccccctcgccctcgccctcgccgccttcgtcgtcgcggaagccgccccttccccctcgccggtcgccccagaagcggccggggctccccacaatcccggagaatggcccaccggcggggatggcgacggcgacggcgacgccgaagcgcacgcggacaccaacctctacgtgcgccccgccgccgccgcctcacgcgaggcacgctccgatgacgggtcagacgcggtggtggctctcggtcgtctcgcccgccgcgcgggcgcggccaga

SEQ ID NO: 23340 - DNA, 545 bp, Oryza sativa
aggtgcaactggggggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaacggcgaaaataaagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaacagagggatggaaattagacttttcctcgggcggctagggcgcggtccaaggtaaa

SEQ ID NO: 23341 - DNA, 493 bp, Oryza sativa
aattggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcctatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgttggtaaagtgtaccccctctgcagaggttaacaaactgttcgaacagccgtgcccacggtca

SEQ ID NO: 23342 - DNA, 1501 bp, Oryza sativa
tcttttaattttcttgacccgattattcagaaacggagttcatccacattcagaccagagcagcacacaagtcttcagaggagacgcaaacatgacacggacgcagcaaggacatttttggccgatcgtttttgagcattttgacttcctgggagcagtgcaaaaatgctgtgtgatcgagcggttccacgtgtgagaagctgtgtgtacgaagacagtgacatggacgcttcaggggagcaggggacttgttcgtatttttttgcttctgtgtttatttctgatggagaaatttggcccgtttggagtccgaaactgtgtacggatcgtttaaacgaagcttctatctatatggaggttgtctagaatttgtgtgtacttgattatggctaatcattacttatcatgcacttgactctatttgctttttggaacttattattgtttgtagtttagattatacttcatccgtcctaaaatataagggattttgggtggatgtgatatatcctaatagatttctagtattatgatatgtcacatctatctcaaatcctttatattttttttgacggaggattagttttatattacctatttttttagaaacatattctagcggccagagccttgttatcttaaaaacacgtcaacaatcagatatcataaatcctgataacgaattttactgcttctgcactttcaatgtacatgttttatcaattttcctaactatatatttataaaatctattaataatataacagtatggaaatacctttcatggcaaatctacccacgtcgtgttataatttcaaatcctaatatttatatattaattaatcatttaaagttttaaggtttaatcacacgcattctagcacgaacgtctatttgagaattgggtagtacccaacatcacctcacccccactcttattaactaaactatgacttatgagaaaatataccagcccccatatcattttcacatgtaaaagaactatatttatacatattaatgagttaaaatgttatattgtgcctatcttaaaacatcatcttgtagtactcgataacggaggaagccaacagataacggccctgtgttcgctgagctagttcccatccggaatagtgcgcatggaaaacgaaacgattcattagcgcgtgattaattaatattagctattttttaaaaaaaaatggaacaatatgtttttttaaacaactttcgtatagaaactttttataaaaaacacaccgtttagcagtttgaaaagcgtgcacgtggaaaacgagggagatgagttggaaacgtgggataagaacacaactaggctgtgtttagttccacgccaaaattgaaagtttgactataattgaaagtttaaagaaaaaagttagaagtttatgtgtgtaaaaaaggatgcgatggaaaagttggaagtttgtaaaaaaaggaaaaagtacgaattaccccccccccccccgaactatcg

SEQ ID NO: 23343 - DNA, 555 bp, Oryza sativa
tccagcgcctcccgcagcttgctctcctgcagccgccgcccgcttccccccgccgcccctcccgccgccggcggccgcggcggccggttcttgagcagcgtggcgcagttcgccagcggcttccatagcgacagatgcatcacctcccctcccctcgtaaaccatccgattccccctcctcctcctcctcctcgggatcaaaccaaaccaaaccaaaccgcgatcgaattccgccgcaaagcaagaatcccccccgcgactcaggggatcggcgaacgcgaacgatcgggttcgggatgcgcgctccctcgtacggaatctggaattctggatcaagaacggagcagagaaggggagaggagaggagaggagtgagaggaagagaagaagaggagaggagaggagttaattggaacacaccaactcgcctgcacggaattaaaagcaaggggtccatttgggcatttaatgtcgattccaataaattttgttgaaattttcttttctttttctttcatatctctatttcaatttttttacttggttcatttatta

SEQ ID NO: 23344 - DNA, 435 bp, Oryza sativa
aagtttgaagaattattttggaactaaacccgacctctgtaagttgagttttatttatggaggaatatgcgtgatatgggctggaatgtgaaattgggaaaggttagggggtgttctgcatgggcgtgagaagcggtagatcgacatcgctagcccgctcccaaggtccgcgagtttctcgcgggtggacggacgagacggacgcgacgtgaggaatcggcaacgcatcgcgcccacccaccccacgcgccgcgcggtctcgcttcgcctccgcgcgcgcgagagagagagagagacgaacaaatcctgcggtccagctcgcagattcccacctccccgtctatatatcgccgcgcagcttccagatccccctcacccaccaccaccaccgcctttctcctcctcctccgctccaatccgcgacccttcctccag

SEQ ID NO: 23345 - DNA, 1501 bp, Oryza sativa
gcacaacgcacatgtgtccgatgccaccgccgaaccagcacggcatatcgatacacatacacgcaaccggcccatctacggcccatcacagaatacaacccaattcaaagaatcaccgacgaagtatctaatagacttaaggatcacgacatttctcccctccttaagtatcagcttgtccccaagctggtgatgacggaaaacgtgcttgaagttgacgaagattttcccaagtcgccagagaagcaggaagccccgacaattgcaccaaaccatatggaacagctaacttgccacgtttaatcaattgtctccgtagaactgcttcaggttggacagtatcaggattatcaaagcaatttaagggtaaatcattacttacaggtatgttgggtttcagcaccttcttcagcaacgacacatgcacaacaggatgaactgcactgcccgtgggtaattccaatctatatgccactgcaccaactcgagccagcaccttgtatggtccaaaatatcgaaaacagagtttctgacaagagtgtcgagctactgacatctgaacatagggctgaagtttcaaaaagaccatatcaccaacttcaaactgacgctctgagcgatgtttatctgcttgtgctttcattcgttgctgtgctcttagaagttgctgttggaggatgtcattgagatggactctgttttgaagccaaacttggataccaggtactgtgctttctccaagattcactagaccaaactgatttggttgcttggcaaacattacttcatatggagatttgcccaaagcactgtggaagatgtattataccaatgctgagcctggactaaccagtctgcccattttgtgggacaagcatgaattgtacacctcagatatgactccaaacactggttaagtctctctgtttgcccatctgtttgggggtgataggatgaactcatgttcagcttcacatcggccaaccaaaatagctcctgccaaagtgcaccggtgaacactctatctctatctgaaattataacttgaggcattccaaacacatcgtaaatatggtgaatgaaagcttttgctactgtgagagctgtaaatgggtgagtcaaagggataaacttggcaaacttggtgaatttatctaccacaacaagtatagtatcatatcctccagatttgggcaagccttccacaaagtccatgctaactgtgtggcaagcctgcaagggaacaggtagtggttgaagtgtacctggtgtcttgcaatgttcagttttagcctgctggcagattgatcaggtttgcacatactcaatgacatatttcttcatttttggccacatgaacaggtgcttgatccttttgtaggtagcctgtatgccagagtgacctccaatcccactactgtgcaatgataacaatactgcctgtttggcctcatgatagttgcctagccaaaattttcccttaaacctaatcaccccatcc

SEQ ID NO: 23346 - DNA, 1501 bp, Oryza sativa
gaaacatggcttaattctctgcagcaattcacatattgtcgaaacaagatttcggcaatattaaaagggggtggctatcaagctggaaaagtagatgagtttggagacaaggaatttcatataggttcaggccttcttattcaagaagtaatacgctactcctgtccggggattgatccgccgagtctgttattgatcgtatgatctgggagaaaaatcatgtcccaaagggacccggacccctccttatataaaggaaggggtccgtattacaaaatacagtccatatccctaacggaatatgagattacagataaaatacaatcgtaaccgactatgatcctgggtattttctcgacatacaagtttagaaaccaacccgagtcctcatacagatattctatctaaatttggtaccctgtacccagctagattataactgccgtgtagatatggggtatccataatctccacagtagcccccgagacctttgcagtcgacgaaatagccttctcagaacaaaaaacaataatccgagtgcttcaattcctcctgctttagcctgtcgagtactaaaatcaaagactgtaaagggcgaaaataaaacatggcgcatcgagcaaatgtacctaattaggtgtagcccccgactatgtggttagttaaaaactaaacatatagtcaagaaccaaatggttttacaaccaaacatcatatagcaaagcacgcgtggtatccagtaagacacccagccgactacttcttagctttaatatatcaaggaaaaatatgaaaaggcccgagtgataaacactcaaaaggtccacaaatagacatatttggcaggaatccgagtaaaagctctgaagacaatccaccaaatatgataaaaatcatggtaatcaacgagtctaatagcctaggctataactcctacaattaccaaaataagcttataacatgataaagagaatgactactaataaaccagtcatctcaaattaacccaaacagcttttgcaacctaaaaaagcttacaaaaatagtataacacttttctgttgggtaccttttatctgcatcgtagtaattccaaagaattatctaaccgcattaaaaaggattttagcagcatcgggtcacatcattgtgagcacaaattgacaaagcaaaaagcgcctaagtccctagggatcacaacgggccacgctggtaataatattgggctaaagtaccgtacaggcccaggcctgttagcactcccgataccctaacaaaacactgaagtccaagtgacacttcatcttccccgctgagactctcgccatttccccactccttgctacagttctaaaccgcaccgacgaagctagggttcatcaatccgctccaatccatcctcaaaaattccacgaaatttctccgcgcgtccaacgcaccgatttcccatcaccttccaaccatatctcggactaaattaaaccatctagttcacattca

SEQ ID NO: 23347 - DNA, 1501 bp, Oryza sativa
attggatcccagtttgtgaaattattttgatttaaattaatgcattatcgctttatttaaattcccgcattatcactgttttatttagccatgcctatttacctttgttatgaccttattattattgctattgttattattaccttgttcaccctagaataaacaaaaccccaactagtgggtactctatttatggttccactagtatgaatttaggtagatgcttcgctgattaattatgcaacattaggtggttttataactttagactttgggaattctcatatcattaggacagtatggaatggctggcttatgttggaattggacacacacctccccctcttttcaaaacccctaaaacggttttaggctgggcacaaggtgcgtggttgggttttgttagtcgtacctcgggtactataaggattaagctcgggcctctcttgcaaagcactaccgtacttccacatgtctagtgggtaaggcttagtttgtggctcagtctggttataaacaaaggtacacggatggagatggacgaagtcaggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggacggtactcttgtatatggctaggatgggttggaaactatgtcatgtcttccgtccgtatgccgtggtggtatgtggcacgtggttacacgtgaggaagacgtgtcttgtgggtaaagatgtacacctctgatcagagtataatctattcgaatagccgcgccctcggttatgggcaagcctagcaatgtacccaagttagtgttttaaattcttaaaacctgcttaacaactaaaatgtggaatggttggcctgggttggcttgggactagctgggacccagggtcgggttgccagttcggtctgaatcatcgtaggccttgggttaaggcaggttcgtgtgggttcacggccttgattaataatactgtatagcactaggatcatctttataaaatggctttgggcaactaagtgacttttaaatgctgtttactgcaaaacttaacccctatattattatccccttgtactcccttgcattaattatgcatctccggtgtgacttgctgagtactgtggttgtactcattcttgctcaatctttcccccttcagtaagagaagctttggagaagatgtcttaggtggagtcctggcttataccccagttgagcgcttgtgaagatggagccgtaggcccgctagtccgctgctgtttatttttgtttgtcaagcctgaagtgcctctgtaataatgtaaatattatcgatataataaagatgtgcgttttgtatcatgtttatttggtgtaccccggcttttccttggacagggattaatacactagcgtttgggaaaagg

SEQ ID NO: 23348 - DNA, 1501 bp, Oryza sativa
catccctccatcccctccgtcctcgctatatttagtccacgcaatcaccacaccagccaccgcctagacatcctcgctgcctccctgccaaaaatccccaaatcctcctcttctcgccgccgccgccgcgctgtcttcctcccgccacgccgcagcgccgccttcctcccgcgacgcccggccggcgccgtcttcgtcccgcggcgcccggacggcgccgtcttcgtcccgcgggtcccggccgtcgccgccgcgccgtcttcctcacgcggcgcccggcagtcgccgccacgccgtctccctccgcgacgcccgaccgtcgccgccggcaccgccttttgcggattcattcctttggcccgtcgctgccggagctcggtgactgtggcggctacgaagcacggcgccaccaccactatcccgatctgcctctctgtccccttacccaagttctcaagttaattcgtgaaatgataacaaagaatatagctcttgattcaaaaatcatttcgactattgccacttctttggttgcaagcaatgaaggcaaagcattgttgcaggtcttgcctgatttcagtgcagaaatatcgaaaagcgacatcaattcacccccggagttattgaaaatgttgcataatgtgtgtccccaaacaacttgaacctggcgttgctttgtgagtctcattcaggagctttgcttgcaggtagcactcagttcatatctgagatctaatacatgttcctttgttcatggtcggcctataatttgtgctctccattcccaaggcatactctatatcacgcgaatgtctatgaagtgttctacagcaaactcttaatctcacatagaacgatcagtttatactctattactttttttttggttgttagctgtagaaaatgaatcacattacctatttaaaatttttagccattggaccacttatatatacatttctttacagctatttgcattatgggttactgcatgctagaccagaggtcttaaaagccagcaatggcagaggttacagctgctgtacattggggggacatcaaggtattggcaccatacttgcttctttcatgttttgctgctaaaatagctccctaccatggccagcctattcgtaaatattcaatcaattttatcattgtcttattgtcttatgctctatttcgtcggctatgagagtatatttactgccgcttaatttatcaatctgttagtgcttctagccaaatattgcatatgtatatactttcctttagatatattgtatcctgtgtatatgtgtactaaagctatattgcattggattattattgtttcagcaaggccttgtcactcttcattgagctttcacacgatgtcatgctcttctgggccatcgacaactacatcacagcataaacgaaaggagcctttgccggactctccagcttcaggttagtgtgctagctataagctgcagacaatatattcatatatgttttc

SEQ ID NO: 23349 - DNA, 371 bp, Oryza sativa
tctctctctcttagccgcacagaaaagtgattagtatacgattaattaagcatttattattaaaaaaattaaaattttattttcaaagtactaattttttatatagaaaaatttcacactaaacacacggtctaatcgagaaagcagccaaaccaaccccactttataacagacccaaagctatttgttaagatcatttcttaattaaaatgtttaatttatccctatatttaagtagataatccgagacaatatcaattattatagtagattatttgtttcgcattctaaaagttatgtttcttataactattgtactccttctttataccatttgtcctaactttttttattaagtccatttcttaaga

SEQ ID NO: 23350 - DNA, 181 bp, Oryza sativa
agaagggagcatgttttgtgtgtgagatagagtgagagagtaggcgtgtagggagatagagggggaaccagtggctgtggacgctcgataatttcgttagcgtcgggtatttggcgtacagagagggatcctctgacgttactgttcactgtgactaacatgtggacccatcactcttagg

SEQ ID NO: 23351 - DNA, 255 bp, Oryza sativa
gcccacttatatagagagcgggcctgttaaaatgaactagatgtttagaaaagactcatgtgtcaataaagctagggggtgggtggtgcatcttttgtgtaattctccaagtgtacccgacggcaaaattttgaaaaaaaaaacctaattttaggcgggggggtaaagtggggaaccgtatatgaccttcttgaagggagctagggagtttgttttaaagaattcgatacacccccttaccggccattttgcagc

SEQ ID NO: 23352 - DNA, 706 bp, Oryza sativa
  unsure (1)..(706): unsure at all n locations
gtcgatcacatgtatgtaganctgttgtgatgantttttcgtctagacgtttgtgatgtgtcatttgtgaatgatttagataatatcactctcncccnnnccgcggttgagatcnaatacnctatgccgcagccgacantagaggatcccgcctcacagncaanacaaaancngacaaaccaacaccatctggacacaaaccatattttctttaccggaactatctgaaatgtgaccttacttgacattgcgcctgatgaaaacaataactgcggtaacctcgcatttcgtgtactacgccactaagtttacatgactttacagatattgttcccctaaaattgttaaagattacccttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatacaaaagatgtatgggagcatacctgtgatgaattgagcgaaccaacagggcttcgccgctccccttttgctgccctaccctctctctcttttgttttttttggatttttagtgaatataatgaaatttcacagaggagggactgggctttatagggggaga

SEQ ID NO: 23353 - DNA, 1501 bp, Oryza sativa
  unsure (1)..(1501): unsure at all n locations
tatcttctctcccttcctcatctctctctctcacttctctgcaagctcgcgggggcaaggcgggagggcggcgccgcaacggccgccggcggaggcggcgtgcgagcgcggcggcttctccgctttcttcacctcctcgtcccgctcgggcgacgtgggctgagcatctgcggcagcaatgcggtcgcggcgccggcgttgcctgcggacgacgacatcgactccgccgccccgcgcgaggaggaggaggaggagacgggcaccgcgcgcgccgccggcgcgtcgtcatcgggcgggtcggggagcaggagcgggagctacccgccgttcaagcgggggagggacgagcttgttgacagccttagcaagtttgccgacgaaacccggccgtcgaagcggccggcggcgaagcaccggactcgcgccaccgaggtccataacctgtcggagtgggtaaaacctcaagaacaccaaccaaccattgatggatagatggtgttgcctcatttgcaacaaggtgaatgttacttgattttttctgttcttgctgcagagaagaagggatcggatcaaggtaaaatattttttgcgaaaaattgtgggaaattttgttattctgtttctgaaagggtttttgtctagagcaattatatggtctatgaggtaccaaaaatttagtgtaaaatttggtacctcatagtacttgggtacctaagaggtactaaatttacaatagaaaaaatgatacctcatggtatcttcttaaggactgtaaaattgctcttttgtctatgggagatgaactggaggatccctttgcatagataatcaagacaacaggaaaatgcttcatatgatgctacatgtatggaaatgacatgcaccggcaatatatgaagaatatagtggctgtgtggattcagcttgagccggcatagcagcagctgcacaagaacatcataacagtgacagtttcactcttcttttagctgatgttacagttatatgatgcctgagggacctgcatctggtgagtccttacaagaaaaattctaggaaccaaatgacagttttggttgctatgttgatttttcaactggataagcataaccatcggttcttcaagattgcacatggcctgaagcagaaagaaccttcaagaacttaggtagactgaaccatgtgcggagcgcggtggcttctccgcgaacgcccggcaccccaccaccgtgttccaccgggcgtacgcgtcgccggctccgctgacagggctgacgcgttcgtcggcgcgcgcgacgacacgagcgcgcccacgtcggccgagcgggacgaggaggcggagaaagtggagaagccggcgtgctcgcgcgccgncttcgncggggggcgtcgcggggcanccctcttacctcggcccgggcagcttgccgttgcanagaagtgagagagagagagattaggaagggagaagaaaggggaaagaagaagaagaggatgacgt

SEQ ID NO: 23354 - DNA, 210 bp, Oryza sativa
  unsure (1)..(210): unsure at all n locations
gtgggtttgaatgcnattccactnaacaacaaaatataaaaatacaaatatgacaaaaccacttatttttagaagttttaaaaaatgacaaaaatacaaaattgacactggtctgaacagaaactatgctcatttctgatgatgaatgtaatgccacaaaattataaacaaaatcaatcaggactcacggagggagtcgctatcacgcta

SEQ ID NO: 23355 - DNA, 843 bp, Oryza sativa
tggtgggggaggggggcgcaatggcgtgaggtcgaagtcatcgtggtgcgacagatgcacgcatgctcactgctgccacggtttcgtcgttgacctctagcttcactaggcccccatgctatcctagagtgctaccgcctcgtcaaggtttgcctccacctagatttgactccgcaatttgcttctctcttatggcagcgccaactcacagaggctggagccgcaagggaagctcgtggaggacgcttgatggtaagcggttgaacttgtacgtgtaggacctgggggcatggttgtgcaactggcggtgaggtgggctcatggccaatggaggggaaggccacacaagaggaggcgagagaagagagagtatagaggaaaagagagtgtagagtttctggtatgacagtaaattgaacttttgtggtagttgagggggaaaaatattcaaacttaacccttttaacaatgagtagatttgcattggtcgttactgccagattttgttttaaagtagaagagataaagacgtacttatccttggatggtctgcgacttaattaggactctccaaacaagcaccaaaggggatattattcaaatgttgcatctgcacacatttatcgccttaccctagtggcctaatccacttctgctaccacaactatccattcatctaaaaaccaaattagaaaaaataaatacattctgacagaaaaggaatatatccaactaatgaatgacagttggaagataaataaaacgataattgagtagaaaattcttttagaaaacaattgagtagatagaatattaataactacccaatttggttcagccttc

SEQ ID NO: 23356 - DNA, 1501 bp, Oryza sativa
ctgtgccgtgccaagcaggggcatcgaccgtcatcttcctcctcgcgccactgccgttgtcttgcggtcttcgccccgcgcgtctctctctctcgccagcacagtcctcttggctcctcctgtacgccccacggccaccggcttgtcgtgatccttattagatacttcggtgattctttgaattgggttgtattctgtgatgggccgcagatgggccagttgcgtgtatgtgtatcgatgtgccgtgctggttcggcggtggcatcagacacatgtgcgttgtgctgccatttatatggcgagctgagctataaagcatttatcgaataagaaaaactcaaaccaacaacctctcatcgtctacctctgttctgctctactcctcctctcattcctcaatcgcgaacctgattccccttcaatctccgagcgtttcgccggaatccgagagttcgtgacatctggtatcagagctcaggttgggcgcatcctggcgaggaagaaatctcaagcaactcttactcagagaatgggggcggcggaagaagagatcgagacgttgggagagcgcgtcaccgagctcaccaccaacatcaacatcttgctgggaaccatgcaagggctcgagaagtggattccaagtgttgatgcagggatcaaggacctgcggagcacggtggaaggaattgccgctcgcgtgacggatcttgaagcaaggccccaggcgacatcagcaatggcgacgccaatgcccgatgggcaccgcggagaagaacatcaccatggttttgattctggagccaattcggttcaggatcgaaccctggtgaagggtaagccaatttttcgcaattcgccagttaattttgaaattggggagagttctgagcgtggggctccgggatctcagagtggtggacgagttggaaattctaggttgcctaaaactgatttcccaaaatttgatggtgataattgttgacagaaaacacgaggcttgggagatctgcttaactccagtgcaggtccaaaactcaccttcggatgtatgagcgtgccagttgatttgatcttgtaatcaacaagaaacaaagacaaagaaactgtggttaaatccaaaaacgatagccgattagctaggagccgatgacatatcatttatctttaggccgatgtcatatgtacatcgatcagcaagtattaataaacaaatcagaactaaatctactcgatcggctgtagatattaatggtatataatccttatatcgatatatacttaaatcaaatgattgggatagatcggtcaccttgccgagacagtataaatcacttagatcgaaatatatattaataatgagattatatatatattcatagcatagccgatcagatagatctagcatgtatcggctaatactccgataccactctatattaagatattaaagcaagtagaatatactaaaacagaagcctaatatatttagatgcaacaagat

SEQ ID NO: 23357 - DNA, 1501 bp, Oryza sativa
tgtgtttgaagccattgctgttcttctttcttcttcttctagagatacctcacgaacctcttccattgtctaatcgatcgggcgattgatttagggtttgagattagagagagtcgagtcgtcaccctgcctccctccttctctttctttatataagcgacactggtggggctcgagggcttatctcaatctaaaattcgaatctattttgtaccgatcacacaaaacagatttatctcttagtttgtttcttgttaggataagaaaaccggtgggattttaaccttctcctaactaaccggcattagccgataaaatcaactaacagtgggtgactgcattcaccatcgatgacgggagcagaggcgacggtggtatctggggatggcattggatattgattttgtttttttcaatgttgattatgtgattgtgttcttgggtgttggcgatcgggagctactcgagccgcttgatgcatccgctcgaatcaagccgatgcattgaactggccttttttttttatatgcatggaagctcaaaagtgacggttctaaaaactggcacttttgttctgcctcatcgtgccgtctgctgggcgtcggctgggaaatctagtatctatgtggtttccccagctggcacaatgttgctttttcttttttttttctttttttttttgtagtgacaataccaaacagatgattctagcttgctgccagacaagaggcccttccgatcacatgatggactcaggttgggatcgaggcttctcattttttagttgctttaatttgtctcttttggtgcctctaaaaatatttacgtactaccatgctcctttaactattgtgttacttttttttttcgtctttcagtgtacggcatccctaaaaagagtaaaaactaaggagtaaaaactattgttactaaggagtaaaaactattattgaaaatcctgtcgttaccctgcagccaaatattccagcaacgtgtagatgaaaatgccgtcaaagagcatcctgtgtaccattgatttgcttatttctgcatgccgaccaccacgtcaccacggtttagccaagtgaaaattaaatccttgtcaagacgtcagagcactgaaaatgatatcatttgtaaactgaacaaatgaatggagcacaatactctccgaagtttaacataacgtctccatgtatcctaaagactggggtatatgacatttgaatagaagataccccttttgaataattgttcaggaaatgtctacgaaacttcctcaataatgattcgcatttggtatttgatagtcctgaaaagcgccccctcactgtgtcatcttcctcctgtcaacactggctctaccgaactttgaagtagctagcactctcaactctcaggtcgaagcataactccatggctgaaggcgttgtaggagccctgattgggaagttgggttctgccttagcaaatgaggcagctagcttcgcctcatcaattg

SEQ ID NO: 23358 - DNA, 1501 bp, Oryza sativa
gcctcataataaatgaaaaataataaccgttaatatttaatatcctattggattaatcatgaaaatgatccaatggctcttgttttgtggatgatgtggctcaatgcatgtttaacttttatgtttagtttttttgccaactatataggatatatagattggtgagttctcgccattctgacatactgtgaggtgtcatattttgtacgataaactcggtttctcgataccttgtaaaattttagttttggttgtattgctacttaagacttaaggaccataaacttttctcgtatatatacacacacgcaagcatttaactcaggaaaagttgaacgatttgaagcagcggatgtacaataatttcaaattgttctgatttaagcaaataaagaaaccagggccggcaatcagtgttgcattagtctccgtcgaatgccgagtagatgatcgacgacttgtgaggccaggtgtctcgttgacacacgaagcaaggacaccctaatatcttagagaaatatattctgcaaactactccatccgtttctaaatatttgacaccattgaccttttagcacatatttgaccgttcgtcttattcaaaaatttttgtgaaatatgtaaaactatatgtatacatataagtatatttaacaatgaatcaaatgatatgaaaagtaattattatttgaattagacgaacggtcaaacatatttaaaaaagtcaatggcgtaaaatatttagaaacgggagagtatataatatgcgaatggggcaaaatatattattgcacgagataacgatatgtactaggccagatgttaactgcacataggatgatatttttaaactctcgacgatttcattcatgccagcgatcgaagtcgacctatattttaactaggctaatttaatcatgagaaaacctcacctaatatgattcaagttgcacaaaatcacagtgatattgggacgtgacatataacttgcgtattatggtcataaagttttacaagaccacaccattaatcattttgacatatttctatatcaaaatacaaaaggatagatataacatttatactatatatggataaacatgccataaatttgagatgtgattaattttataccttaaaatatagaaaaattatgaataatgcggttttgtaaaactttatgactataatatctatggttttgtaaaactttatgactataatatcttcaacattggtttgaagtttatgaattcatcaatataggaacattgggacaagctaaacctcaatgagagggtataatgccacatacacgcatgtattggacctagttgttgcatggattgtgtaagacaaaagcattgacccatctaaaggttatgcgaagttcgaactgatttgaacagaacaaacatcttcttcctaaagtcattctctttccttctctcccctagcccccttattccctgcagtgtgtaaatcccatatcttttttgag

SEQ ID NO: 23359 - DNA, 905 bp, Oryza sativa
agcaagatttagaagggctatttaatagcttggaggatccaaacaaggccatcggtacgatgctcgatgagcattgtgatcagggatggagctagaattttgagtcattggggtcagacctgtacaatatacaaacgttgtgtttggaaggtatttagtttgggagcattgtagtataaagtcacgtacactagattcaaaaaaattagcttagaactatgagtggtttaagattatttcagtgaggtttagtttaagattatttcagtgaggtttaaattactttatttaaaactatctaagaatttgtgagtgggagccattgaaaagttggggctaacaaacgcttaggctgtgttcgggaggtatgtttctcacctcctatgcatgcaaaagggagcaacgcattttcttataattaattaagtatttactaatttttctaaaaaatgaattaatatgattttctaaagcaacttttgtattttttatttggcaaaatatacaccgtttagtagtttgaaaagcgtacgcacggaaaacgagtgagatgagtagggaaagttaggcaaagaactcagccttaattccttcggcaattttttgtttgctaatttaaaggcctaatgtgtagtagttgattactagcaaattaaactactaatctaattgcatggatcgatcggatagacacagtacatagctaaaattgctaacttgttaacagatcaaatatggtaaagctggctgggcaacgatccataacctacatgttagatattaattaatatgcgctgatacaccaatttaattgggactcgggagtagtgagtgcataaattttcaaagaactgagcaaactgttttaacgttttcctctgtgactgagatttctgttcggcagg

SEQ ID NO: 23360 - DNA, 1236 bp, Oryza sativa
tatcttgactgctattatttccagctaatctaatatgtcaagtttcagatgtgaacaaattaattttagtttcgcagttgcttattatttggatggagtatttggtgaatctaaggtctgatttggaatgtacaaatttaggacaacttctgtggaaattgaactaatttacacgaaactcttgaaaaattcctaccttttctaaaggaggcctaaaaattttggactcaaccacctcctccccaaagagataacattaccttgatttttacaaccattgctttctcaaaatttcccagttttttatttcatattttactcccatgtttatatttctgggtcatgtgcagcccattagggctgaaagcagcaggcgacctccctagggccagcagcactgcaggttaacagtaccattgtggttatcattcatgcgtggttactgtttacagtcggtgttcaaattaaaggtagaaatgagatcgattagttagctacttcctctgttccgtattataagtcattttaggtttgtcctaagtcaaacttctttaagtttggtcaagtactaatattttcaacacagaacagatgtactacaataatatattcaatggttgattcaatttgaggttgtagatgttgctacatttttctataaaattcgttaaacttgaagaagtttgacttaggacgaacccaatatggaatggagggagtgtttccttaaacttagcgatatgtgccttaagagtcaagttatcccatctgtatgaagataggggttatatcctctttctcccttgcccttgtggtgcactgcctcaatggcattttcatgatacttgggtccagggacaccttacttggactgagggttctagtcccagcatgctcattatattatatataaacgttgtacaagtagcaacgatcatgaatacacaacataactttatatatggttgtaagtaaagcatgcaataaacttgtaaccattatctgttaagtttcgttgtaaataattggactggtgcatgagaagttccaccattagaattgaatatatatcatttcacatttagtttcagggtcaggcactatgtacccaactacccattttatagttcattatgttgagatttcagcagtatgccaagctaatctccaaatttattcagcaggtgaggtgaagaacacaattagatagcacttcccattgagaaagtatggcag

SEQ ID NO: 23361 - DNA, 1343 bp, Oryza sativa
attatacaaatacacttgttcaacttgctccaagacagttattgacatgatacatcagtgaacgttgttagatcaagaggtatctatttcttctctacagattatatgtgaagtggcatggacgtcatgcaaacttggtaatgactactaactgaaaagataagcatattcacacagctgtgctcctgctaccgctttcatggctcaagtttctgttttttggtttgctgttacttcacactgtgcaaagtgcaaaagcaggaattgtttcaattcttaggaattgtttcaattcttctgttcagatatgcctgatcattgtgcaaactactattttgtcctgtgtttttgcggtgagcatttgtaagcatcttgtgttgtcctcttattttcagccaaacaaaacggatttgaggttttgtaagtatattgtgttggcctcttattttcagccaaacaaaacgggtattaagtccagatccagcaagctgggccatatgggggacacgtagacttattgggctaccgggctcttttgaaatgacaaaacgggcttttaaaaaattacctaacccaacaaaatgatcggagacaagtacaccacgcacatcatgctctacgcgcacgtgaggacaggcaggggatgagcgacacgtgggggtatcctgcggtagaaaattcggctgcaaactaaaattttttcagctggctgtcagctactccctccgctcaaaaagagacaacctaagtggagatttgacctcacctaaaacaacgaatctggacataaggttatctttggggggggggacggagggagtagacagtcccgaaattttcccctttttttctctgaaagaaaaaaagacggaaatttattcacattgcatgggagtaacaatgggcctgttcggctggctggtacagccactatacgcagccgttactactgcagctatagactcaacttactgtttgtaaagtaaagttaaatgcagccgaacaggcgcaatgtcgatagcaccgtaaaaacaacagtctgaaagactgaaacgcagactgtttctatggaaggttctggagatttcagaaagactcaagcaaaaatgaattttattttcataaattgacgaaatttaagtgaaaaagtaccggacgaagccgtgccaagccacagtgttcaaaacaagttgagctacgcaacaaaaacgagcgctcaaaagatctctctctgctctagaacgtttcaccaaagccattcgcatttggccacgtggtcgttttctcatctcaagataagccttcttctactacctaagcttcgagttctcttctccctcttc

SEQ ID NO: 23362 - DNA, 970 bp, Oryza sativa
ttgggcgacttgaatgctttgatatcgagctcgtacccgtttagatataaattttgctttccaactaatagaaggaaaaaataagagagataatggagtgaaaagagaagaacataataggatggtacggagtacgtacatatacaaacgtccatacaaatagggtgggttcagtttagaggtagattgggtttttttttcattctaatctaacggtttaaagaatggatccatcaatttaaatgaaaatcgatggttatatagttttcttccacgtgacagcttaggaccgtttgtagggtgccacataacggtctaggagcgtttgtagaaagtttaataaactttttaatatataatagattgcaatagaaattaattggagacaaacagttcaattcaatatctcatacattatacattcatacataagtggatgaattgaatgctttgtaaacaagcattgatgttacatcagtgtgacgttcagacttcagaatcgatcatacggctgctgcagctggccgactccaacaagggtcttcttcctcctctggttctctctgttccatgtgagaacttctcccatgagacctccgagcaaaccgtcgccaccttcgtcttccaatcatggagaggattccattttgctaatccaagaagatccaataactctcatacattcgcatcaaccaacgtcacaatttagcttcttcttcctctttttcttggtctgttcttgtgctggctagctccgatgtgagtcagtatagatcaccatgtcaccaacaccacagcagcatcatccaaaagcttctttgatgatctttgcacgcgcagcaattgcagttgactccgatcaaacgatctttgcgccaatccatgctgatcagtgatcacgcacggactcgctggtgaagcacgccgcgccgatcgtcctcgagcttttcccagacggggaacgggacca

SEQ ID NO: 23363 - DNA, 163 bp, Oryza sativa
  unsure (1)..(163): unsure at all n locations
ggacaagccgttgcacgcagaccagcggtcgcgcggcaccgtcgattactacgcgtggagcaagagcgcttcttcggcgggcttcgccgcngccatgacaaggctcggnaaggtcggcgtcaagacgncggccaccggcggcgagatacgccgcgactgcaga

SEQ ID NO: 23364 - DNA, 1501 bp, Oryza sativa
gcgtattagtttttgacaatattcaatattaaagtgtgaccattattttttataaatagaacactgacaactatcatattaacttcatgtaaaatcttctaaatatgaatccattgacaccacttgtatcacactaaacatatatattgtttgtttatttattagtcaaagtttacaagtgttgacttttacaattactacatgcatggtttatattttccaaaggagggagtaaattatcggatagtcaaactattttagttgatcaaagatgaaatattcaccaaaatagagtgggacaaattataaaaagcattgaatcatttttattaaaaaaagaatccagtgtgtaaattgcaacattaaaaaaaaacttactaaaacattcaaataacaccacatgcaacatttgcaaaatgacatgctaaaacatgtgaaaaatacttattgaaatatatccaaataataccatgtataatgtttaaaaaatccattgcacttacaaaagcgtaatgatccaaattagcattctctccaagcaaatcgctcagctcgaaccaacccaatcgtccacactccatacatggcgtctcctcctgtggtttggctgttgttttcctctctgcccctaccacactttcgcgtgttaggaacccgttggttgcagcggggcatgctaacgtgctgtgagagatcaggggtgctggatggtgatggtgtaggagtcggtacatgggaggacggtgttaggaacctaagcacttcatggggtagttgacactgaggatctgacaaacttcctgtatggcaattgcaagcaggtgctgcctggaacttccattgtgacgatgaaagcggaggcagggtagtatggagacaccgtgccattgccactgtgttggatgaatgagccgggtgagaggttggtggtggcacacgagaggaacaagcgaaagagaagtgtataaaaaaatagttaatccctaccggttcaaaacggtatcatcgatcggtttttaaccggcagtgacacgagcgtatcactatcggttcgttcaaccaaccggtagtgatacaagatgcataaatagatcaattttattgggttcaatcctcacggtggtccatgccatgaaccagcagtgaaacatcacagccaattcatgccatgggtcagcagtgatgctaagcatctctactggttcatggcagtttggacaggaaaattcattcaacccctatggacggatagggatggagaatcactgctagctcaagccaaagtggcagtaacaataagccaattaatatgtgaactcatcaaagtattattagaaccgtatcaatatatgcgtataattatgggcattaggatttaaaactagtcagtatccacaacgactcaatcactatactaaaagtgattctctaatttccaacattcagttatgagtttgctcagaaagtcgcaaagcttaattagttccggacaatcgtgtgc

SEQ ID NO: 23365 - DNA, 1501 bp, Oryza sativa
gcatggtgtataggagtatagttgcagagctgtcgacggttggcgggacttctagaaaataaaaaaaaagaattccaaagatagttatattcgatttttagaatgccaatgacaataaatagtaggcggcggatgtgccgtagaggagtataggggcatcgtttaacaagacttctaaacattataaaaaatgaaacccacgagacaataaactctaaatactacaaggtccaatttttaaaggttcggaacttctaaaaagtaaaaaaaaaaacccaatgataatcatatttgattttaaaatctcaatgacaataaagaagggagacaacaggcgagccataaaggagtacaatggcaaagcggctgacggtttggcgggacttatagaaagtaaaaaataaacccgaacgataattatgttcgatttttaaaatcccaatgacaataaagagaaaagagagtggacgggccgtagaggagtataatggcagtgtttgacggtacttctaaaaattataaaaacaaaacccaacgagacaataaactctaaaaactataagatccaatttttaaaggcttaataaagaaggatatgacagaagtaagggatagcagttggtgtgacattaaaaactatataattagaaatacgtggatgataaggtttgatcttttaaagtcttaagacaacgagatagctatttaataaattttaagtaaaatcataccgaaaaatatatgattttgtttgtgttttagtcgcgcaattgcgcaggccacccagctagttagtaaagaagagggagattggctttgttgtgtacgttgcatcaagctttgcacgtgaaaccacaaggatggacgagacttaattttgttttgctcgatatgaattgaatgcccggagtatgaatccaaaaaacctagcaagaatcttatcaggggagaggagaaaatgtagaagctggttcagtgtaggtagctagtgcgtgcccccttgccaaaagcccaaaacttctctcaatggtttgtgcgtgttctctctaaatattttatcctcttacatcggtgccctagctaatataagttaaccatattgacgggctttgccccccttgtcaaaaacccaaaacttctctcaacattttgtgcgtgctctcttaaatgttttatcctcttacattggtgccctagctaatgcaagttgatcatattggcgggctttgtgggggagggcgttccattctcttttaccgtctctccttcaatcctaaagacgtggatatatagttgagtgctgctcggctgttagggtttgtttttgaacggttcggttgtaacttatttgttggtccagtggtggttaatcacacttagcggtgaccggtccggtgttagccttctcccaagttctgtgtaggtacttgatatcggtgcgtagaggtagattatttttaggaaaaagtacgaattacctcccccgaactatcgcggttgt

SEQ ID NO: 23366 - DNA, 764 bp, Oryza sativa
agtcagaagttcttaatttttcttctgtataagagagggcgtcgtgaccaataattaatttttgatgtacactcctataaatatgtttcagaaatgctagaagtattgcgaggactggattagtagtttttattgtcggaaaatgataataaccacccgtgccatttcagcctcgtgatgcatgaactgattgacagatcgatcgattagtcccaaaagcaagaaagcgattctgtctcaatttaatcgcgacataacctctctggctagctaaagctacaaagcttactaggacaatcaggcaggtaggcacacgctaaactcaaatgacccattatggtacgtacaactgaaaacgggctgggggaggacgaatatatgaacggtcctttaatttgcgccatctgatcgacgatcaatcagttgggttacggcctgtcgcgataatgctgccactgagtgcatgaaatccaattaagcgctgacaaagaaagaactcacgccatcgtgtatccaggccctacaccaattaatttagcactgctttgcaagaaactccatgagagaacttccagtgctcaccaaattatcatgtgtagactgaagcaagggcatgcaaacagcccacctgcagctgcctagctacattataatttataagaatttctcatttcaaatgttgcaattctgttaggaaaaagtacgaattaccacccaccaccgaactatcgtggtcgaccgaattaccctaataaacttgaaaa

SEQ ID NO: 23367 - DNA, 1501 bp, Oryza sativa
tgaggttcaaagaataaaaaaaatcaaattcatggcaaccctgtaaggaatatttctgcaatagagaatttctgttttggtaggaacattgtcataagaaatacaacacatactgatggggcaaaagatgtgactagatcacgatatgtacaagtagcacttaataagtgaaaatctagatggcctcgagtttaatgtttgaaaggttattgctcaatgaatcaacatcttcatcattaggaaattcttcattggcatgtgaaactggatcttcttgaacgtgaggaaactcatcctgcaattctgcttccagcttcatgaattcttcctcgatattttcttcagaatccattgactggagtattactgatcctgaaaaatatttgaaatcagaattttgaaaagaacaaacaaacatccacaaatccttttacaaacagagggaaacaaattgatgctgtagatgagaagacatatatagcaaaaggtttagttctgtagcaccagaaggaatgcacgtcaggaaaataccaccaaaagaacaacggaaacttgcccttttagtaccctgtaccccctttgcaaacataccactctaaactgcagtctttctacaatagcactcctagactcctccattatgctccatctatcactttattaccatggttgatctaattgctgcagcaccagttgaattggtagaagggcatgtataccgcatccaattaacagattactagcagtgaccaccacagcaaccagcacatctccaccacctgcaccttcttcaacctctggttctgcctcatccagcagcttgggtaaggccagtttgtgaggaggttagcactggaccagctgcggactgcagccatgttggcatatttagcatagccgtgtgtatgcacacaaacatgcatgttcttagatgtcctcttctttcttcactccatgtatagctgtggagtggatctggtgaggaacatgcagaagatggcagagaccatgcaagtggactccagcaatcattctgtcgacagcaacaagagtgcaaaacaagggattgagctggatttgagatcttgagcaaggacttgtgggttagttggatttgggaacttgagctgaatcaagtttggctaggttgattttggatatgtcaaaaaataggcgatctttcccaaatttctcttggtggctgggaataacagaagttttccatcttttccccattgcatcacagagccctaaatctaatacataggtcaaagaataccaaaaactgcatattgtttttccctaaagaaaatcatcaccacatgaaaaaaagaccaccttatcttgcatgtctaatataaacttgctggatgggaaactggaatttctttgtaaaagaacaacaaaaatgaaacctcacgtaaaggcagcatcaatttctcttgtgtgttgcaacaagggtcatcacctcctttaaggtgcttgtttaccttctttacgg

SEQ ID NO: 23368 - DNA, 1501 bp, Oryza sativa
aagttactttctttttatataagttacttctataatatatgtaaattacttttaggctttactaaatttacttttatatgtctaagaagtaacttagtgaaatctaaaagtaatttagacatatcataaaagtaatttgtgatttttcatcaaaatataatcatgtgagatcttgttgtaaagatttaattattacgaacacaacggtataatcggattagtaatttaaaagaaaattttatttgaagcatagataatagaaatatttcccctacttacttaatggattagtactatagtaaagtaagattcttccagctaacacatatatggattctggatgtccgtcgctatttatgactaaattgagagtgctctcgaattagattttgcgatttttcaagtacaagccaacgctcacacaaacaccatatatactcatgtccacacgattacacggagcgttcaaacacagggtctaaatacgattgaaggccaagccttacacatgctttgacccctgaacacatccaaacaaacaaattctaggaattaggagagaaaatgcaataattatataattcagaaaatgaactagaagtcaggagctaaaaaaacccagttttttcatattcttataaattggctaccaaccagtagcttctcataatgttaatcttcccctaaacaggcccagagatttgaatccattagatccgtgagaagctatcctaaccgaattatacccttttatttaagctatattgaattttaggaattcacaaaggtgatggccgggacaacactactacactaggcggacgtgccccacgagacacgatcagggggtgcgcgcattatttcgattatagaaggaaaaagagaaattctaaattttaccatcgacattatcggagccatcggaattataagtgaaacagcatatttgcaaacaaagaataatttgtgaataaaacttttatatacatgttcttagcgatataaaagcaaatgctgaaaaataaatttcgatgaaaaaaaccttaaaatcagctccaaatttaaggttaacaatttaaattttgcctgatgagcataagcataagcgaaaagataaagccatatgtcgttaatagatgtaaagttctaccgaatgccatcttacgggtaattttatcccttttcgttatcgccttcatttgcccactcatcgccgaggtgcccacccataagttaaaccatatatgagccgcgcctatgagtttgttaaagttttgtgagggcattttagacattttaaataaataaaatcggactaactgaatgggatggacgaaaacctgcatatgatggcatttataagacaaactcatttatgcactttactgatggcatttgttagaatttctcaaggaaaaaaaaaagaggattgattggcaagcagggtacgttgtacactgaacaagcagagcttatattggtacaaatatttttttttcaa

SEQ ID NO: 23369 - DNA, 1501 bp, Oryza sativa
catttgttagaatttctcaaggaaaaaaaaaagaggattgattggcaagcagggtacgttgtacactgaacaagcagagcttatattggtacaaatatttttttttcaattttttctggagaaatgctaacactgtgatatatatccacggattttcataatttactctatgcacatcaacctatttccctaatttctacaacaattcatcgatttattcatatttattgctcccacaaggggctgtacacttgctcatcaatggagccatctccatagtacaaatgctcgtcgtcgtacacgcaccagctcgccgccgccggcaacgccaactccggcggccagccgtacccgaacgccccgccgccgtagccgtcgaggtcgtcggaaaacatgtcctccagccgtctgatcccagctgctgctgcgccgtcgtcgtcgctcgccggcccggcggcggccatgctctcgtcgctgtccctcgtcgccgtcgccgccgccaccgccccggtggcgccgccaccgccgatctcggcctcgagcgaccggatcacgcggctcagctgatcggcgtcgccgtcgccgtcggtcgttgccgccggcgacggcgagtagtcgtcccccatctcctcctcgccatcaagaagctccatgaggagcaccactccgtcgtcgtcggacgtcgccggcgccgccacggccatctcctggtcgacgaggccgccggcgccggtgccgccatggtagtagtactggtactcgccggcgacaccgccgccgccctggctccgcatcatcttgtccatctgcgagcaatggatggagagatgatttcttggcttctcgcccttcttggttgccaaggtgcaatggggtttatatatatggttatcagctagcttaattagcttgcaattaattaactagtttaattagccacttggttagttaatacctccattcaattctacctcccacctgtcatgtgtaccctcttcatctctcataaaacataaatatagtagcagatacgatatattctagatcttcgaatctaaatataaatatgttcagattcgtagtactactatgcgtcacatctaattttatattcgtttttttattatgtagggagtatcatgattggtgtcatcgattagatcattagcaatttggtttttatttaatacaaatggattagtgatcataattggttttcgggtggacaattaacggccgtgcttaattatagtaggaacggtaggttttgggaggcaacaagagaggaggtgattggattgtgagttgatcatggagaggtgaggagacagctaacaggttgggcaggatcctgcattggcctacattattgccaaattatcctgctatccacgtcagtgtagcgtacgtccttgcctgtgtacttgattgtgaatctgcttatgacagttttctgcgaatatttttaggtacacttataggcaccatgatttgaaccgta

SEQ ID NO: 23370 - DNA, 155 bp, Oryza sativa
agaagaatgagaagagaatgaaaaagaaaaataaaagaagaaaaaaagaaaatgacatgtcacgtctatgtggcatgccacatcagcgccacgtaggatcctagaggggatgtgtcgatttgggacctaaatgatacactttgataagttctagg

SEQ ID NO: 23371 - DNA, 1501 bp, Oryza sativa
ctacaaaatatacactataccagtgaaagggcatgtagcctaatagttgcagtgacctaaataacacattaaggtcctgagttcaaatctacataagagcgaatttcagattggattatttaaaagctaagtttcatgtttgataggctaggtttctaaattaaaatggttgcatatatccgattgaatatagagactgggtaaaaaataatcttctctttaaaaaaaatacactatgattgaacatagagactgggtaaaaaatacccttcccttaaaaaaaataatacgctctaccgaacttccgtgtgtgcatgtccttaaatccaacgaacaaatgcatcgcgtcacattcattagaaaccgtccgatcaaagatgaacggctcaaattaacttgagtgcaccttaaaagtttccagtaaaagtaaaaaaaatatattatggacgagttcagtgcccagtgtgacgtcctgcagctcacagttttgcacccattttgtgatgtgttcgtcttaatgttgacacctgcgtgtggcgatatgtaccaggtcaggtctacccacagattgcgattgaacttatagttttcaaaaaaaaaaaaaaactgcacttataagcccctcgtcaccaaagcaaatcatggaggtacacgttacagaacgagtatgcaatgggttttcaaactctgtgctagtcaatcatgcatggctatattcttcaacggaagctacttcaatttcttttgtgaaggtacaatataatggaagctgctttctggaatgcagaacagatgaatttataaatgtttgttttaagggtggaattcagaaatgctgttccatcgatccaaagttgagagaaacaaaatatcatcattttgtttttgttacggaattacagtagtagtatgatcaatattcagagggacagatctcacaaaaaaatttccaaaaaaaaaaaagaatcctacaaaaaaaataatgtttgtacaccgaagaagtgtatcatacccggatctcagttcatcagagacattcagatccgtaggaatgttgattcacaaaaaaacaaaagagattaagatctgtaggaatgttcatctgatcagagctggattagtatatgcagaaatgcagagagtatatataatagagcagaaagccaggacccacagttttgcccatctcgaaatcaggttttgagcttagctgtgcgtgattaatcatggccattaactaccagttgcagattgaccagttaaacctcagttaaacaaatgatcatttgcattatcaccttctgagtctactcacaacgaggcaaaaccctaattaaacaaatggatcagaagctctcagagcgaggacgacacacgcccttactcttctatataaacgccactcacccatcgcttgcaaaaccacctcgagctcaaacacaatttattacatttcaagcttgtttaagctcaagtagtgaagagaaaaacatcgacagga

SEQ ID NO: 23372 - DNA, 331 bp, Oryza sativa
ggtgaatttaaagcaagaacgatcttttggatcgcacggctacatacggcagataattgatgtgctataggggagattgatatcagaaaaaaaaagttcttctcaatacttttatttttttaataacaaatttacttagctagtggcattttcatagatctagatcacatagccttggaaaataactttggtcaaaataggcatgcatatggcctggttgcacacatcttagatgtaattggttctgtaactagggggaaacatgcagcaaccaatgccatgtttcctcgcatgttgcatctgcatataaaaccatgcaaaattggcaaca

SEQ ID NO: 23373 - DNA, 183 bp, Oryza sativa
  unsure (1)..(183): unsure at all n locations
cgacctagntnnnnnttaccccnnntnnntcgntnnnnnnangnnanngnnnngttaaggaaacggtcgggcgtgacgccactcctaagtcctggtgacaggtgggaccggtctccacaattgggcagaaacccaacggtcacaaaccacgcacatcggcaatggtaactcggctgtcaacaa

SEQ ID NO: 23374 - DNA, 922 bp, Oryza sativa
taacagtacctgggctagccgaggatggcgacggtggcagcttctcggccatgaggaagattaatttctgactcctaatgggtcccaccgggcgtgccaaaagtgtgttgacagaaaacacgaggcctgggagatctgcttaactccagtgcaggtccaaagctcgccttcagatgtatgagcgtgccagttgatttgatcctgcaatcaacaagagatagaacaaagaaaccgcaattaatcctataaatgatagccgatcgactagatgccgatgacatatcatttatttcaagccgatgtcatgcgtacatcgatcggcaaatatcaataagcaattcagaactaaatctactcgatcaactgtatacattaatgatatataatccttatatcggtatatacttaaatcaagtgattgggatatatcggtcaccttgccgagatagtataaatcacttagatcgaaatatatattaatagtaggattatatacattcataacatagctgatcaggtagatctagcatgtatcggctaatactccgataccactctatactaagatattaaagcaagtagaatataccaaacataagcttaatatacttagatgcaataaaatcttaacataaagggcagatttaacgtgtcaatcaagcatatagaataaaagtagttaaatcaggtaagatcggctgaaactccgatactacccttatcggcaaccagaaagcaggctaaagattgcaattctaagcacgacttaatagatcaaactcaactgatgcagcattaagtatgaaaagaagaacaatatctagacaatcaagccgctggaagtttcatagagtggtagatatatcacataatctaagttaacgtcattgtctaacctaatcggctgccttccattagcaga

SEQ ID NO: 23375 - DNA, 569 bp, Oryza sativa
ccattaatcgagggccccaataattaaaggcattcggattagagaagcggacctgatgaaaaaagaaaggccatttgcaaggtttctattggaagggggtcacgggaaaaagcaggtttgacaaacaaggcattttctgtgggtcccacttcatggcccaaccttccctggtgactgcaatgattaatctcaatgcttaactttgcttaacttgcattcggtcgcttgtgttccaagttttacactcttttcttttctttctttgagagaatcaaagttgttagttgtactgtacactctgggaaacccaaattgcaattttgattcataagttcagccacatttgtttgaatcagaagaattttagagaaattttatcagaattgattgagcttttctacaaaaaaaagtcttataaaattcctgcatcccaaaatgttactcctcctagttaaaaatatttggcgtcgggagaaatcaactagacctgaaaggagttttctgaaatgaaaatatttttgttagctcatgctgttccgttttaataacctaaaattttcatttcaagc

SEQ ID NO: 23376 - DNA, 1501 bp, Oryza sativa
atcggatatggttgggattacctcaataacgaacgagaacacttgtaaattaagcgttgtgctccaccatcaactgtttattgtaaaaatgccatgcagttgtgctagcaccatggccccatgagaagttattggtggtgaagttggtatctaatagccggactatgtgtcgacatatgagcaccgacaaatgtgagaaatcacttgtccaagatggaccaaggctctgggtgcacttgtcttgtccaatagtgctcggaaaaagatgaacacatataacatatatataggtttaggcctcccgaaggtgacaaccggcttacacctgttcttgttcaccatatgcaaagttcgtacaaagtatgcgaagctctcgagctagctaaggttgtgttcgggagtgaccctccctggcacggaaaaaacaagatgggagagttgggaacaactctaaacgcaccgtttatcagtttaaaaatcgtgcgcgtggaaaacgagatggaagaattgggaacattagttctaaacgaacacagcctaagaagcctagagttcttgttgattataccgtccaatcatttctaccaatccctaaatactttctcttatagggatggagccatgcatcgccaatttcattgctgcatgcacttgttaatttgttaagcccacctagcccgaactatctgggggtacgtggctccgccgatgtagactctttaacattgttttcggctgatgtggctactctcgtagatattatgtactcctatattgcaagccaggtgtactatcaaacttgcttttatacacgtcaccatctatatggaggcaatcatgtaagcattgatcagcaccgttgaaacagtggacgcaagttaatcaactgattaaactcagcgaattttataatctaagtcaagttttgaatttttcaaacatgtataaattaaaccaaaatctgttccaattaaaactgcccaagggtaaaatcgtttttaaagtttcatctttccattaaaaatatgatgtattaaactaatagcctatgtatcttttactagtaattaaacaactaaaaaaaattagagtaagactccgtcccgaaaagagagaatttctagcgagaagagtttgtcccgtaaaaagacgacttctaaaaaaacaagaagcattcaaccgctgctgattacgaagtgactgctcagtcggctcattagcatcgatgggtgagaaaaaaattaaagacaactgcattcacacttgctggatactagtactactccagagtagcttctttatgggacggagggatacacattagcgcttcaagattggtggtgcacgggggaaatgaaaaccaatactccgtacttcgtactggcagaatggaacacatcatctctcttataaggcatagcgtgtcctaccgctgagctatcaacacttctttttttagttacattgactatagtacagtatagtatagcgtaactacatc

SEQ ID NO: 23377 - DNA, 269 bp, Oryza sativa
agctccttccgcctcgctctctaactgacgaggtcaccgccacatgtcttgacctcctccttcatgccgtccctgcccaagtcaacaactttgacccctcattggcgtggctgatgacgcccagtgctgctgcttcgagacgcattggcgtcagcggtgcggcggctgtgggagaacgaggttgagctcgacgccacccgttgccgcgcggccgagctggaggagcggctccattagtggctaggccgtggtcggagggttagtggcca

SEQ ID NO: 23378 - DNA, 419 bp, Oryza sativa
tttaccttatgtacattgaagtttgtgaattatgtactccataaatgttacttgtgtggagtatttgatttaattagctgattttcccagccaagtttgacattttattttagttctgttttgcaaacaaaccaaagaagtccatatttgaggtgcttgatttcatattctattagcacaaattgatcttgagatctctgtccctatgttagacagaggatttgagagatcacctattcgttctaagcttttaaacttttggatccaccaaatgaagggcttgttttaactttttatgagaatttctatcatatttattatacttttatctatcaactgtaaatcacctgcagtcaaattttattgtacacaagcaaatagacataatgtgcgttgatgccccttattgcttttacagg

SEQ ID NO: 23379 - DNA, 1501 bp, Oryza sativa
tgcaacgtctcaaaaattatgtgtgaagttcaaatctaatttaatctgcttatcaattgaatgccatatttagctgttgctgaaggctaataatgttacagccacttgtgaaattttttatgttgagggttaacttcctattctatagaccatggtcagttcagatctttaaatcgtcagtgatatggttccatcctgattagtcattttcagtaacatcttcttttctctttatattctgtacttttgattggtcttatctaattctattccttgttgttatctggcttatatgatctgctctttgagcactcctgttcccatatcagcattttggaatcatttgtttgcgtacacggccataccttttgcatgccctttttggtatcatggttctgtttgtgaacttgatgacagcgtggttgatacgcttttgcctttcacagttacaatgataatttgttataattttagcttatactattttatctgataataaaattggtcaataagttgcttgtttttcatggctgacaaggtgtgtcaaaatttggacacagatatttgcaacaaggatattaccgtgcacatgattatgggtgtgatcgatatatctttagtctttgtcgaatttattgatttttacttggattcacgaaaataacatgttgaatgtgcacgccatggttgattactaacttactgccttctatttgtattggtccctttcagagtacaatttccacaaacagatgaagcagaatttgtgaaaggtgatagtgctgtcgacaacgaaatgattccaggggtgatttagaatctttgccagaccttatgaatgaagatttgggatatgatatgagaggtaaggaattgtttcttttttttttaaaaaaaaaggaggaattgtttgtttttaaagtgaaaaattccttaattgcgtgtcaatatttccttcatatcttgtgattgcttatcttagaggattatatggaaataatttagtgttcttatatgaaccagaaagagaaaatgattccaggaatttaccagattgagcatacctgaacctctgcaaattatagataatcacagtccaaataatttggccatgcagattaatggagcctctcctctctaagtgagctgtcaattaaatcaatgatcatgataaggttccaacaacgaattcttgatcatccagccacttgatcctttggtcattacatgttagtacctctggtagacccccattgaacaattcatgccacaccctgattaatcattgacagcgttgtctattctctctcggtctctccgtccacaaatataagggcttctagagagattaaaaatgaagcgaaaagactatgatgcctatggttaaataaggggtgattggtgttgaatagtcttatattggttgtgaaagggcaatggacctaatatataagtaggggagctcctcacctcaacggctagcttttgagatgggaaaggc

SEQ ID NO: 23380 - DNA, 1501 bp, Oryza sativa
tgttgctgtgacgctacatcgcttaactaatgcaatcagtgtgcttgaattcttcaaaaacatagcacaatttgtcaagatggcacatggtacatgccaatattatacatgaccaaagtcgcgtcaactccatggctgctttataattgtgtaattagagaatttcatcgctgcgaaattctcgtctcaatcatgggggacttgttctttcgtttgacctgtggccatgcgtttcgggttatggttgcttaattttgttttacccccacgaacatattaatcaacgtcgacatcagtgcccgaatctcggagcaaatccagcggtgaatatgtactcatccgggaaaaaataatcagttgactttaaatcctgatgagaattgccaatatatatacttgagcagctaagtcctcccatctattctctccatctcagaaattttattttttgcccatccacattgagtaaacaagcacaaaatcttttaaaaaagaaaacagagactttcagtttgaagtctgaacgcactcttctgatcaaagttacatattggacgctcatattctctctttcaatccttgtttaccctttatttatttttcatttaggatccccttgaggtaaagtggaaatgtgggctaaaagagtttaaggtttggtaaaaagtggtattcaaactgaaattaagacctgtttaattgtgagccataacttaccataatttgctacgtctaagattggataagtttgaccaacttagacagctaagcggttgtagactagtagccactgtaaattcctttccaataaaccgcacacattaataacttagaattaataacttagaaaagtgcgataagattcgcttaggtttgttaaggtgcggtaaagattttaaatatggaaattcaaataagtttgacaacttttattggcaaacgttatccctaaccctgaagaaacatacgaacaaaaagtggttatctatatagaagtacttaattagaggcaaagagttaaaaatacaatggttacttcttaatcttattgatgaacaaatatttaaaactgatatttcgagacaatgcacaactacttactgtcaaacggagtggtacctacctgctaagttcccattaaaattacaagagattcctgcacaagattattaaattgtaatataaatataaattcaaatgcaacggcaactgtatatatgtggtgcatatttgttacgaattatgcgtgtatttttttccgtaaaataagaaaaaaacaaagttactgcatgcttattgtggaaattttaaaattttgttacacataaatttggcaattatccaaatattcatttagattttttttttccaccgttaagagatggtatcttaactatatactccctccgtttcatattatatgccatttgacttttttttagtcaaaattctttaggtttgatcaattttatacgtaaacgacttttaatatttttgccca

SEQ ID NO: 23381 - DNA, 1356 bp, Oryza sativa
aatgacaataaaaagaagcaacgtgcagggtgtataggagtacagttgcagagccactggcggttggcgagacttttagaaaataaaaaaatgaattccaatgatggttatgttcaatttttagaatcccaatgacaataaagaataggcggcggatgagccgtagaggagtacagtagtatcgtttgacgagacttctaaagattatataaaaaaaccattgagacaataaactctaaaaactattttaaaggttcagaacttctaagaagtaaaaaaaaacaatgataattatgttcgattttaaaatctcaatgacgataaagaagggaggcagcgggcgagccaaggagtacaatagaaaagtcgctgacggtttggcgggacttatagaaagtaaaaaatgaactcgaacgataattattttcgatttgtaaaatctcaatgacaataaagagaaaaagacagtggacggatcgtagaggagtataatggccgcgtttggtgggacttctagaaattataaaaacgaaattcaacaagataataaactcaaaaaactataagatccaatttttaaaggtttcaaggagaatgaatagaaataatggtagaccgagcaagcaaataaaaaaaaggagtaaattgcatttagggccaccttttattaccaatgtttcactttggaccacccttttaatacattttttcattttgagctaggttactttacttttcttttactttggaccacccgcataaactttttatgaatacataaaagactttttcaactttaaacacatcagcaacccgtaacccgataatcttttccaacttacgcatgtaattctttacaatattatagagtaaatacagctaaagaaaatgacttggggtggtcaaggtaatcttacctggtccaaagtgaaaatatgagctagaggatagcccaaagtgaaactttggtaataaaaggtggaccaaagtgcaattaacttaaaaaaagatatgacagaagtaaggggtagcagctggtatgactttatataattagaaatacggagatagctatttaataaattttaagtaaaatcatactaaaaaatatatgattttgtttgggtgctagccgcgcaattgcgcaggccacccagctagtttcattaaccatagtctagatcagaagatcggcaccttttttttcatccgattcttcaatttcttcagtgctaagcataaacccataacacctcaaatctcataaatccttgcctaacattacgtgagagcatgagcgaaagacaacagcaactgaatctaatctctaatctaggtagaattaggcacggagga

SEQ ID NO: 23382 - DNA, 315 bp, Oryza sativa
aatgacaataaaaagaagcaacgtgcagggtgtataggagtacagttgcagagccactggcggttggcgagacttttagaaaataaaaaaatgaattccaatgatggttatgttcaatttttagaatcccaatgacaataaagaataggcggcggatgagccgtagaggagtacagtagtatcgtttgacgagacttctaaagattatataaaaaaaccattgagacaataaactctaaaaactattttaaaggttcagaacttctaagaagtaaaaaaaaacaatgataattatgttcgattttaaaatctcaa

SEQ ID NO: 23383 - DNA, 206 bp, Oryza sativa
agcataaagtgcttacttctttttctccccttcgcaaagaatggcttctcaagggcaacaattgaaccacccagctttagcatttggaccccagctttctttcactgccatgaaaagttttgtggaacctccacaacacaacttgagtcccaatttgcaagaaattccatagaattttcaaccttctttatccaaccatgtttagg

SEQ ID NO: 23384 - DNA, 1439 bp, Oryza sativa
  unsure (1)..(1439): unsure at all n locations
gctggcnnatgagacctgcataacctcatgctgcatgccgcagtagactctgaggatccccgcgtcggttggcttggcatggcaggtcgacaggtttgcagcctctatgggccatggggatgcgtcgatggcttcaccgggagcaagttgccatggcgcagctatcattggagtgtacttgcacagtgccgccgcgtccagatccacggagatgcaacgtgggcgatgtcccgagcagtagcatataaattcgtactgttcttcttatttcctctctcagttttaacgcaggttcacctgtacagtacgaatggccatggaagctgtactacgcggtaacagtaaaagcatttcacagtgagcaattcgctgatgtgcgtttcggagtttcagattctgaaattatgaatggggcgggcaagtatatggtggatgctgtagtattaatcgaactcgatctggagcagtgtactgtacttacgtagataatgaacttggattaatttacgccataaaattccacagaaataactcgcgaatgaagtactggtcctgctgcctgctgatgagcctgaatgccgcacgggcaacctccggaaaattaaaaattttcaggagcaaacattcaaatttcgctgagatcactagccagagcctcacgtgtcccgaacttggatgatccagtccagagcccccacctctttccgtgctgcctcgcaaagcatcgacgtgccacctaccccatccggaacagtaattcctcactgccatgtgggacccacgccgtgtcatgacagccatgtcagcgactgaactggtaatcacctcgcgtgtgcgtctgtgcgctcatccttttttttttcctcctcctcccacgagcattcattccctcgcaacgcgcgcacgaattttatttttatttgaaaaattcccgatattgcccttgagctgtcagcattagtaggctatttaatgacggacaaaacagtaatctcgcgtcctaacgttcttaaatgcgcattactagctcgaaacaggggtctctgctccccagcccatgctgctccctttgcccttttctttcgggaaaaaagggaaaaaaaatactccattcatctactgacacatgggcccacatccccacaactaaactgtcagtggctcagtgccacccgtagtgtactgccactccgcgacaacccgcacggcgtcgaactggttatcctcaccggcggagcagcgcagcggcgagtggccccacccttctcccgctgccactgccactgggccccaccgcccggaagatccggtcaccaccgcagagcgctagtctccaccgctattattaccccctaccgcttggttacaaatcacactcgtggttgtctcgtgtagtggaggtggagtacatctaaaatccctcgtcttgtcgctgctaa

SEQ ID NO: 23385 - DNA, 158 bp, Oryza sativa
  unsure (1)..(158): unsure at all n locations
caacaagcgtcgcaatatggtaatggattnggaaagggctaattctatagataaatcattactctaacctataancaaagtttaatataatctccaactcaacccaacccaacacccccccgggnatttgaattcgaatactacaaccccgcagccng

SEQ ID NO: 23386 - DNA, 179 bp, Oryza sativa
ttttgtccgacgtgccggctgagtcagcgtgagacccacgtaggacccacatgtcaggatgccacttcagcaggctggcctctcccttcctctcctttcctctcttctctctctttctctctctcactcctctctggacttggcaggccggtcgacggtggggaggaggtcgccgccga

SEQ ID NO: 23387 - DNA, 1501 bp, Oryza sativa
ccagtctagagccagcagttgtaggagcactcggggcaacaccgccgatggctgcggcggattaagcctcaccataaccgtggaggagcacggggggctggtcaatgtttggctgtgcaagtggagccgaacggtgttcatgggccatggcatgccggagatggcgaatgggtcaccattgcctggggattagcccggaaaagcgttgcaagctcgatgcccatggtgacggcggcttacgcacagttggagctcgttcgccgttgccaggcatccgggccatcgtgttgtggtcctgccatcgactgccaaatgatgccgctttagtgactccggcgattatgccgctcctccccgtccactccgtcccgttctagcgccgcctcctatgccgctgctgcttcatgtcgtccttggtagccgcggcccctatcctgagctcgggaggtctcttgagtggtgcgggcaacagatatgaccaaatgacaggctagacaatagtcgatagtgtagatcgatcaaggggaggaggataggctggagcggttgagagcgctacacgccggaccagagggagagtggaaggggacaattgtgagagtgactagcgggtctcacaccgacttttaccactagattgccgcatgggtaaaagtggtaaataataaagaaaccacctcttaacagtgaaaaaaaaatctaggaagaacatttggataattgctaagcctagtaaataattaaatttcccacttattataactattactttctccatttcttaataactgacaattttaattttcttatttaaagtttgatcattagttgctcttaaatcattacacaaggtgagttttgtgcttacgtttagggcatatacccaactttcataacatgccattatttctagtgttcataaacaataagggtagtcaaagtttgaaagtgaatagtattcttattactccctccatcccgtgcaaccataagtttccatgcctaacttggatcgttcgtcttatttaaaaaaaatttataattaatatttttgttgttatgagatgataaagcatgaataatactttacttgtgacttatgtttttaaattttttcaaaatttttagataagatggacggttaaactttggcgcggaaaaccatggctgcacttataatgggacgaagggagtataaatttaagggagtactgttaagtgaactgagtgtatgcagctcgttcatcggggtggaacatgtccagtgtccatccaaattcaaatcttaaacttgggtacgagttcaattttttttgactgatttacaactaattttctttcagcgatagacgatgtgcccataaacaagccgagtgtatgcattcacaaagataagtgtgcgtgacaacatattcatcgatatcaagacgttgcatcatgctcgtagaaacgagtgcgcgcatgtgtatataaacgtctagttcatatttcccccgttcca

SEQ ID NO: 23388 - DNA, 1501 bp, Oryza sativa
agtcgatttttcggctgttcgatcctatcaaaagggtcacgcagtacaaactaactaagtaaacataatggatcttatcacagtcgtccgttaagttcttcatgcagttaggagtataatccatagcattaagttggctaataattgaagattgagttttctttctttctactagaaaaaatacctgtgcgttgcaatgggtaaagactattttaatcatatttttgttaggttttttttatctaaaaagtatatgcgatttttattttgatagtattgatatctaatttggaaatcttattgagataatggccatatcctgtgcgttgttttcttatggtttggcaaaaattctgaagcaattaggagtccgactctcgtcttaagttaacatgcgagttttttaaaataattttttatacgactccttatatattttcaaaagtgaataaacttaaaaaccgacgcaaatataaacgatatatcaaagtatcagtggaaacatcttcaatttttataatagtagagataacgcttttgcttacttttctatttggttccaactaaaatctatatatagtgcaaggcttaaaatttatagtgtaaaatttgatttttttttccttttacaatgtaaagaacttattacaggattaacatctactcttgtacaacttctccctccatcctagaacctccatcctagaaggaggagtacaattctatagcgacgaccatataaaattcactcctataaaattactgggtgtctctatttaaaggtattggtatttctggtacttagtactctctccctcccaccttggtactctccttaagctagaattgttttttttgggaggggggacaaattttaaaaggtagaattacactgcttttgagacagattgagtagaacttatggcgtaaattatatgtttgaaaaaatgacttttttttacctggaaaaatgactgttttacaatgaaaaatatgggaacataaatctagctaatccatcaaaacaatatagtaaaaacttctattattgaaatcaggatttaaaaaaaattagatttttctacttgtgatttgaaaactacaaacactaataacataatgaatttaatagtctaaaccacaagaaactttgatcgtcggaaatcacatttccaactgcaaaaccccacatatcttggtttcagttttttgggggaaaaaataaaagctgatgtttatattcttgaatttagaaactttcaaataacaacaattaaaatttataagacaatacattggagttattgatttgagttgagcattaaatgttttttaaaatataatgagatacatttgatcccctctccaccaggagctagtaactatgtcaatttataacctaattgaaaaaaaatactttcaagtcaatatgcagtacaatttaaaattaaaatttattttttataacatgaaagatttttatttagttctttgttttccc

SEQ ID NO: 23389 - DNA, 1501 bp, Oryza sativa
gtggtatgatggtaaagtcatggttattactatatgattttacttattagttagggtttaaatcatgatatccactctaaatgctttacatacacggttatgtttttagtaggaatttaattgacaaggtttgagatttaccgttagtcttcgtatcttttgagtgtgtattaggaatatatttgcaggtgtgcacgtgtgtattggtgtgtaatcgaaaaaaaataatgcagaaatcgatgcatggtttacctttttgatttcgaagtatagtttcattatggaaatagcccaatctaaaattcgttcctataaagatttgaacacagaatcttgagtactacttaggtcattgcaatcactatactacatgtcctttaacattcatctttttatttaataacatgaaagtttacaatcacttgtactttgtaccggggctaacgatttgggtcgctacgcgggctacggacagaaaaggtggtaaaaaaattactaaacaaacatgtactattttctctcatgaggcgtaaaattaactcaattgagtaattcatgtgttcctaaattccttgattattgggactcaaccccgagtaaatatttttttcctttcattttattcctataccatagtaggatctttgtaggttcgagctgaatcaggtagcaggggcatgtctgagcggtattataacccagacattttttaagataaaaaaagatgattgcatcctcaacctctacttttaggatatacgtaaccataacatttgagcttacaaaatgattgtctaaataaaaatttaaaaagaaaatatcacggtcttattgacagaacccccatgagagaaaataagcaaaatggagtactccctccggtttcattttaattgacgttttggataataatacggtctacaaaatatatctttgaccatatttttctattataatatatataataaataaatgtatgtttacttatagtgctttgaaagataaatctatacatgttgttctagttactttaaactaaatatttttaaaagttattgatggttaaagttataaaaatttgacctcgactttatctaaaacatcaattaatatggaactggtggagggagtatgcatgcatcaagtacaaatttattatgcatgatgaagcgtattgggagcccgtcatccaaaatcgtgcacgaattaaacaagccagtaaagatatcacgagaacgttaattgtcatagcatcgcccagctttttttcatttttctctgtttgtttcgccgttagtgaacatgtaaatatttttcactctacttaatataacaccagctaagtctgcctagttttttttttttaaaaaaaatcagtttttcttttatcaaaacgaattgcacatcaatttataccaatcacaagttcattttaacaatttgcttacagcttatttgatatgtgagtaaaacttagatatcattaaaatcaaaatcaaat

SEQ ID NO: 23390 - DNA, 1501 bp, Oryza sativa
taacacatcacatttcatttaaggcatatctcttggggtgctcaggaaccagcaaccaagatgtttctaatgagaatgctgtacacattttctagacatcagattgtttgaagttggaacaaacatttgatctggacacccataccatgatggtcttacaacagcaaattacagaactgtttttaaatcttgtgttgggccacttggttttactgcttctgatgatgcaactatacattttcaggtagatattttcatacgaaagatgaattctatcccggccttcacagctaacctgacaatggaatccttcaacaaaagaagtatctgttgaagataaaagttcagtgagaattcatattgttggattttgtgagtatgctttcttcgagtcaccgaagattggaaaatgtatttcattttggaaacactctgggctcatgtctttccgatgcattatcacagcttctcgtagtaactggagatgtccaaattgttatgttgtggcagccctggaccgtggtcgagcaagctcctagatatagcaaggttccccccaccctttttcatatatactaaggtgcaattgatataccttgtggttttttatatgttttaacgatttgttcaaatgtcaaaagctgaggagcacggcgtgttactaattggacatgagtagagagttgatgccgggctgtcacatactcacatggattcacctctgttatgatttttgacaaagtatatatgaatgcgagcgttacttgtactgtggcctggactgaagcatgagcttttgtaaactgtagcgaactatcatatgtaactgagccatgtgaattgttaattaccgcaaaccagaattggttttcttaacatgctatcatcataacgtaatgcacgcaacgcgtagatcccagccgaaagcagttaacttaactttaccccgttcccctgcattttctgggctacaccgatccattcccctgcattttcggggctacaccgatccatgattggtacatagtacgccggtgaatccgacgtacaatcagcacacgtaaattcgttgtcatgcatggatgaactctcccaggtcaggtcccatgtctcacacgctcagcatgaggcgcctcacacgaaatggccgccccaaaccgaaccgaaccccgcgcggtgcaggcgcaggtggccgcggctggcagataaccagcgcgtttcgctcgcgcgccggcacataaatcgcgtcggcctccggctgcccgagagccgtacgtactacagaaatacaagtgctaacttagcttattagcggataatccccccagcgagcgagcgagcgaggctgctgctgcgaaatgatggtttgtgatttatcctgtcaattggttaagttgttgtgtttagttatttttgggtgaaataccgtatggatcagtggctaaagtgaatttcttgtagacactgtcgacgtcggagcggcagccgcagccggagaaga

SEQ ID NO: 23391 - DNA, 1501 bp, Oryza sativa
cagtaagatcgctgcagcacatattacaagatacatagatgtatgataggtgggaccaaatattaattgtgtactactccctctattccataatataatacacaaccacttttcttaaatgttccataatataatacatgcatgcaagcatgcaattaactatgacatcttttttcattaaattatcttttttaaatcatccactctcatattatctaattctattggatacatgcattatatttatgaggatgatctaaactacaagatgataatcattatttcttgttctttaggttaagggtggttgtgccttatattttataatagagaaagtatatgtttctaggtacctatgatatgaattggctattagattaattaaatataatttgaagccaatagttgtttatactattaaacttgctctaaacccggtccagaaaagacggcatgaaatccctatcctgacggatcattatccccgggctgacggccacgtgtccctccaaatttaggcgggcgaggtggagggagaggagaggaggcgaagcggccggaaggaaaggaaagccgaaagtttttgttgctctcgattcgattgactggacgcccggctacggcctcccgcggtccccgcctcgcgttttggggagggcagtttcgcccatccgcgtgccccttgcttggttgtgtttccgtgtttccgtatttgcccctcagcgtccgtttgattcctctatgctctgctgctctgctctgatctgctgggatctgccgttctgctctgctttgccgcagccagagcagggttagtactggagtggagtggcgtgcagtgtgctactgtactgacagccagtgctatgagtaccattcattttcgtgccgtttcgttcctattcataatttaaatatatactataatgtatattcctaatactccatcctttctaaaataactcaacctagatggggtataatgaatctggattaccctttatccagatttgttgtaataggatgtgccagatctatttaaaatctcttatattataggacggatggagtactagatatgtaaaacatgtttgaaagagtttaaaactatgagaatatactggttgataattagattttgagaatctaaagaagttaagttttcccggttctggcttgtaatttatttcctaggttatacaactatatatttttagaatttgggtcacaccttgaattgttaatggagttgaagactatgtggaaatttatagtagctgctaaaaactttcccaaacaggtccgcgatactaatctcatggcttcggctttcaaattctaatactatggtatgtcacattttgtattatatttttttttactaaggtagagtttgataattgtgctactccctatactagggatataatacctctatctcacaatataacaatctaaattatgacgagaaactatataatataacgaatatgtactccct

SEQ ID NO: 23392 - DNA, 1501 bp, Oryza sativa
atgttcatgagtttcttttgttaggattaggaaagctatatatactttttttttctttcaaaacatttacaaacggggatgtggtaccacggttccccttaccctttttttggggtggttaccgaccccccgcggtaaccgcgcaataaccgtgaaaaacattgtaaatttcggtttcaaaaatttgaattcaaaaaaaactgcggtattatagttttggtacggttaccgcgcggtttgaggcgattactgtagtatttgcgtggtaaccgcgagatgtttggccgaaagaagaacaaaatgaaaaaaaatgttaaaattaaattggagaaatacttaaatgtgtgtagagtttagggataataacagaaaattagagagatgagaataccatgagatattttctccacatgggccttaaagggccgcatgaccagtgcaaacttaggcccatttcattatttcattttcctatttcctaattgacttttaattttgctctcaaatttgaatttatcttactctttttcaataaatttattcaccatagtacactgcaaatcaagcactacgtccatgattattttttatttttttcgaaattttgaatttgctcaaaatttcattttgtatgggagtcacatttctttttctgaaactaacagcaacaacagtatgagatgcgatgggcttccaaagctgccgaatcataggccacagcccgtaactcgaatccagattctggcgcactaggcccagttcgtattatatttccagtagtaattagtcaatttctatccctcaattcacatccttggttgaatcacatccttcaaccgtaaaaccgggtataacccatcccccaactctcaaaaccgttgcaaattgactcctgaacggttttgaaggtagttttgtcccacatgacatatttgattctgagtcagcttatggggcccacatgtcagggatgaggataaaaatgaaaacaatgggttttagttcacgcgcaacaccaacggtctcatactcttatcaccctttcgctcccgtccccttccgcctctcccatcatcaccatccacatccttcgcgtcctcttgagtcttgatatataccttgccttctctgcccgccgatctgccttgcctcatggttcgtcgtgctcaggggcggaatcaggcatggggcagctagggcttgggccccatgcctagctccataatacccattataatcttaaaaaatgctatataatttatgaaaatatttgagatctcattagctcagtcttagacgtggaaattttctggctccgccactggtcgtgctgggcggcgcctggcggcaagggagtcgatcgggcgcgcagcagggtataagtagctatgaaagacgcgggcggcagagtgttcgtcagtcccgtgcgtcaacatcaagtcgttctcgtgctctcgctcgccttcctcacatttgttcgtcgcattgtggcagctccagc

SEQ ID NO: 23393 - DNA, 1501 bp, Oryza sativa
gcaggccaccgccgttgccaccggccgtcgacctgctcctctccacgggcctgaacctctgggaggctgacgagaagttcctcaccagcgtcgccgccccgacggccacgccttcccatttggtctcggcctccacggcgccgctggccaccggaggcgacgaggtgaggttgcagtatccattcaccatctctccaccctcctgtgtacaccaactcaccaagtgatgtgttgctgtgcgctagctagctagctagctgctgatatgggaggatttgggcgtggttcgtggagttgttcgccgcgggggccgggggtgtcacgtttggattttgcaagcgtgctgcgtgtgagaagtggagttgatgaggctggatgcgatcgagatggtgcgtgcgcgcgcggtggcgtcgggagcggcagtagtggaagacctgacgcaggggagcgtggtgaggcgagggagtaggaatcaagccgatcgatcaccgactgtttctgtctgcgagtggcggaaaacggtggccgtgacgagatcacgcgatcaaaccacggaacgcgaaatcatgagccgttgagtggtgggtgggtgggacagtgggacagtggaattgaagcgtccagttttgactgccacgccgcacggcaagcacggtttggctccaggaaaatgtgggttgtggaaatggatttgtagtcacgagagaacgggacgaaattccgtgcaggaaattatcggcccaacacaaatcgcatggaatgtttgcatcggtccatttgtccatgcatatatgttggggaagcagcgaagccttctaggcccgtgtacctgtggttgttccaagtacatgtcaagttatgtagcactactaactggtatagtattcgtacttctggctaatggcatgtatgtttaaatcttgcccatattttatttcggagttactaaaaatatggcgccacatgctatagtcgatttttttagccacttacacagtagttacacctcatttacaccccacttacatatgtaattagtatataattttcgaatttacatatgtaattttagtacttacatatgtaattttgagacttacattgtaaatacactaaaattacatatataatttagggacttacaatgtaaatacatgccgactattttttgatgaaaaatatagcgccataaatatagctatacccttttattttggattttccaggactaatccggcaatgctacgtatcaggccacagatgcgctgagtaattcatgtttcagtccatgtattcagatgttttattagttgaatcgaaatattgcaatgaatttttggtggtgtttcgtttattttcttcaatgtatttggatctgttgatgtttcaatacattttgaaaccgatgtttcatatgttgtagtaaaatgtttcaagagtgtttcggttctgtttcaccatttcaatagttgaaaacattcttttattaggtactgaaaca

SEQ ID NO: 23394 - DNA, 1241 bp, Oryza sativa
  unsure (1)..(1241): unsure at all n locations
cgtgtggcnatgatatttgatattcgagctcggnacccaaacccaaatccgtcctcatccaaacccaaatcaagttgcgggcccggtaatagttgcatgaatcatggagcgatctagtggctaggaattcagctgaaaaaacaaaaaaaaattcagcaggatactatatatattatggacgagttcggtgcccagtgtgacgtccttaagctcacagtttggcacccattttgtgcggtgttcgtcttaatgttggcacctgccgacctgcgtgtggcgatatgtaccaggtcaggtctacccacacattgcgattgaacttatagttttcaaaaaataaacaaaaactgcagttataagccccctcgtcaccaaagcaaatcatggaggcacacgttacagaacgagtatgcaacgggttttcaaactctgtgctagtcaatcatgggctcatggctatattcttcaacggaagctacttgaatttcttttgtgaaggtacaatataatggaagctgctttctggaatgcagaacagaggaatttagaaatgtttgttttaacggtggaattcagatatgctgttccatcgatccaaagttgagagaaacaaaatatcatcattttgtttttgttacggaattacagtactatgatcaatattcagagggacagatctcacaaaaaaatttccaaaaaaaaaagaatcctacaaaagaataatgtttgtacaccgaagaagtgtatcatacccggatctcagttcatcagagacattcagatctgtaggaatgttgattcccaaaaaacaaaagagataaagatctgtaggaatgttcatctgatcagagctggactagtatatgcagaaatgcagagagtacgataatagagcagaaagccaggacccacagttttgcccatctcgaaatcaggttttgagcttagctgtgtgtgattaatcatggccatcaactaccagttccaaattgaccagttaaacctcagttaaacaaatgatcatttgcattatcaccttctgagtctacgcacaacgaggcaaaaccctaaacaaatggatcagaagctctcagagcgaggacgacacacgccatcactctcctatataaacgccactcaccgatcgcttgcaaaaccacctcgagctcaaatacagtttatataacatttcaagcttgtttaagttcaagtagtgaaggaaaaaaaaaacagcgacagga

SEQ ID NO: 23395 - DNA, 1501 bp, Oryza sativa
agagcttgcatatatagctcttagtatattcttcagattttgtcattgatgttatgcgacttgtgcatttctttgactgatatcatgtagtaatcactaaacttcatgcctgactctaggttgtgagttgtgagacagcgagagttagtcggtgtagtttcatcaggaagggccgcttagacagtgagaactgagaactgagaaatacagcagtaggaaataaatacccgttctactctggtgtcagtcctagatataatttaccactgtgtttcatgcatgatccgattcttagttttctcgacaagaggtggtaaccacatgtaaatattgttgtttagcatagctcttgtgatcaaagaggatggaaaattcctggtagggtcagtaagggaaggaatcagcattgcgttcccattgttcatatatctgacaaatgataatgatgtcttggtgtccattgctactggacaaaatagtacaggttagctgagtcagaagggttcatgcagaaagtgtagaacttattgcagataaaaccctttgcaaatcatgtacagcagtagagcttcatactgtcaccggcttactgcgcagtccccaacgtttgatcatgtggtccataaggatcaatcgttcaaactgcatcagaattcagaacctaagcatgaagaaatactacctcgatctaccactagacagccatatatgacattgacaacggcaataaggaccgttgctttagaccaaaatagaatcagcagtgcatccacttcctggatgggttaaatgctgatacgaagtatgaacagacataacctaatcttaattaactgacaggctgaaaaaggtatcgggtatattcaatgaatctggtaaaatatctggctgatttattgcgttagtatcaagtgattagtactatgagatttggtattgctactcaagattctttgtttcttttttcatgaaagaggtcttgagaaaattcgtagtgtaagcatttgttttgctgaagagaacaaccaaaaccataagcccaggcaaaagtgtgttcatttaactcagtaaactagtctttcctgatccgaagtttggagcaaactttaatttttctaatacacttttgttttaaagagagaacaaaaaagctgatatttgctaaaggaacaagtatctaattactcttttattacttggtccccatgattattcagtaactggctttcagtataatgatacaacttttggtcttttcacacttcactttccttcaatcctattcaactatcactgcactgggagctaactacacatagacatagctttcattctttttctgaagtttaaataatgtttacttttctgaaaatttcaacgtattgatatcatcatcaaatccagtatgacatgccccaaactaacgtaagattcatacttttcaggtacacagtgctaacaagtaacaacacaatgttgcctcagcaacttcagatatatt

SEQ ID NO: 23396 - DNA, 1501 bp, Oryza sativa
aaatatttagtttaaagtaactagaacaacatgtatagatttatctttcaaagcactataagtaaacatacatttatttattatatatattataatagaaaaatatggtcaaagatatattttgtagaccgtattattatccaaaacgtcaattaaaatgaaaccggagggagtactccattttgcttattttctctcatgggggttctgtcaataagaccgtgatattttctttttaaatttttatttagacaatcattttgtaagctcaaatgttatggttacgtatatcctaaaagtagaggttgaggatgcaatcatctttttttatcttaaaaaatgtctgggttataataccgctcagacatgcccctgctacctgattcagctcgaacctacaaagatcctactatggtataggaataaaatgaaaggaaaaaaatatttactcggggttgagtcccaataatcaaggaatttaggaacacatgaattactcaattgagttaattttacgcctcatgagagaaaatagtacatgtttgtttagtaatttttttaccaccttttctgtccgtagcccgcgtagcgacccaaatcgttagccccggtacaaagtacaagtgattgtaaactttcatgttattaaataaaaagatgaatgttaaaggacatgtagtatagtgattgcaatgacctaagtagtactcaagattctgtgttcaaatctttataggaacgaattttagattgggctatttccataatgaaactatacttcgaaatcaaaaaggtaaaccatgcatcgatttctgcattattttttttcgattacacaccaatacacacgtgcacacctgcaaatatattcctaatacacactcaaaagatacgaagactaacggtaaatctcaaaccttgtcaattaaattcctactaaaaacataaccgtgtatgtaaagcatttagagtggatatcatgatttaaaccctaactaataagtaaaatcatatagtaataaccatgactttaccatcataccacaaatacttcttaggtttccacgatccaagcattccttgttatagtcaatcaagtacgcaaaatttatctccacggttgttgtcattgttaggttgtagtgttaaataggaggaattaagatgtataatcaattatctggagtgatgtcctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgac

SEQ ID NO: 23397 - DNA, 445 bp, Oryza sativa
ggcatgaagacgatgggcttcttttatgatttcaagcgcttttcttttgtgtgcgtgttctcttccggggtggtcagggaggcggcttatgtggccgtcgctgatgagagttctacggcagttggcttggtggatcaagtagtaagcttggcggcttccgtggcggctggtaaggcattcacactggttcttgctggatttttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 23398 - DNA, 1501 bp, Oryza sativa
ctaaataatccttttgattgattattgctgctcactagctttccatggagatggctgcttgattgattattgctgttcgaacacacggtaagccaccgtgccgtctgaaagagtccgttacatagaatgttaccgggagtctagatccgcacgggaaggttctcgtgtgtttaagcacacacggtagggattgtctatttatttgtcaggtgatttctaagaaaaaatcacccagattttttctacccttaaatttacatccaacggactacaaaagaaaataaaaatacatatttagttacataattacttttatcaaaattacaatgcacctacatgtcatatcaactgaatttacaaatataattttagttatatatgactgtaattttgtattttatttttattttagtttcaattgagagagaacgagagagaacagcgtgcatatcaattttttaaagcgcaaaaaaagaaattagcgctctaacccgtccgactgaatcctatgcggattcccatcgctatatgtgcacgaatcttggcacttatcgaacagcctaaaaaaggacaaatccgagagaaaaaatcacacgacaaatctatagcaaaatcgcacacggtatggtttgggttgggccaacccgtgcgcaaaatcgtgaaacaccgaaagtgcccatggaaaaccgatgaagctgccgtgtgtatgttactgtgcggttgtctattctcgggtgtttctggcgcacgggagctttcagtgttcgctagctttttgacctggattaacggccacacgtaaaatggaatgaaagattaatgattaattaagtactattaactattataaattttaaaaatgaatgtattgaatttttgaaaaacttatatataaaaagtttttctacaaaatacaccattcgacaattttaaaggtgtgtgccatgatagttaaaaaaaaccaaggctgagtttttttagctagctactctttggtttttttaaatatattttccgaacgactaaatagtgtatttgatgtaaaactttctatatataagttttagaaaatcaaatatatcaatttttaaaatttgtaataatcaatacttaattaatcattgctaataacttttccgtttggtttgagaaatggaacaaagtttgttgtcggtttcagttgtgcatgcccgactagagttgaatccagatccggtgcagtcataggacagactgcaagtttagcagttggaaccatttttcatcattggatcaaggcaatcaacggctgaaataaatgctacagttgttttaaacagtaattgctacagtacatgctacagaaactaactttgtacggtcatttgtgaacagtatcaaggaaagatctaggacgttaatttatattccaatgatgtccttaggactgcataagttgcagtggctatagccactgcatgtgatcccaatccacaacctctccatctccaacttaaacatt

SEQ ID NO: 23399 - DNA, 734 bp, Oryza sativa
cgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggt

SEQ ID NO: 23400 - DNA, 1501 bp, Oryza sativa
aggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgattaataatattgtatagctctaggatcgtatttacaaaatagcttgagcaactaagtgccttttaatgctgtttactgcaaaccctaaccccctatattatgactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtacctgccgtcaagcgcctgtggtcgtcaccctagtcttccgctgtttttcgtttgtcttcatgtgtgctgggccttcgccgcccatgtaataaattaattatttacgcttccgcttgttaaactctgtattgtatcaacttttggtgtaccttgcctcctgggacaaggaataatacacgcacgtaaggaacgcccgttgggttttttcggtcgtgacaagatgcaaagccgatatgcttgaacctgtcaaggctgaaatcaaacgtttgtatgatgctggttttattcgtccttgccgatatgctgaaagggtttctagtgtagttcctgttatcaagaaaaatggtaaggtgagggtttgcattgatttcagggatttgaataaagctaccctgaaggatgaatatccgatgccaatggcc

SEQ ID NO: 23401 - DNA, 1501 bp, Oryza sativa
cgatgaacatcgccgacccatacatcgttcccggattccccagccggccatcgcctctagctatagtgatgctgcgtcgtgagccacgacgacacgaactgctgctgctccctcttgaggcacaactcttgccccccccccccaaaaaaaaaaaatcgccaccaccaccaccactgttgccgccggggctcctcatctacatttgacgtgcgcgcgagagagtgggtgtgagagggaaagagataaggaggagagagatatgtcaggtgcccatcagttttttttaaaaaataattgttgactgggctgccacataggattaaaaccacttgcaaagttgcttggggggttttcatccgatataatagttgaggatgaaagatttctgtttttttggtttatataagggggtaattcgtactcacccaataattcatgtctaatttggacttttcccttttttttaatcgatgagtacacacaaaatgtgtaacgcgtgtaagagaatcaaagattctgcaacatagagtatgaaaaagagtacatttggtgttcagctgctctactgctttatcaaacgtatagagcctgagagaggcgtaggtagggcacgaggagtgaaatgacaatagttgctggatggaaaagacaacagttgctgcctcaagtaaagtacccaaaaaaaaaaagaagaaaaaactatagctaggtcctcaacagctcaactcatggtactataggcttcataggttctgtttctaggattatatttattaattatttatatttaggatatggctgtagctatcacagtcctaacagtaggttgtcctgcctttgtgtaacctttttaaattgttgcattaaatatttgtttgtactcacagacaaattaatgcaaatttacttatatactaaaagtctaaaatatgtacccctccgtcccaaaagaaacccgtatccagattcgtagttagggtttgtatttttgggacggagtagtacaaatagtcacaaatcacatggttgtaaaataatcatggatcactccaaggctttccaagctatactagctaacaaatttaccatagaaaatatatatctgattctgcaattgatcatacctgtgtggttcagtgcatcttctcaccccgcgctttgctgcgggattaacggatgagtatatgttaaatattgtcgaataataaaagttgaaatgttgagaaaataatgtgaggaagatgatttgacacatacttatcaatctctataatataatatctattatctatctatctttatctattatatactaaaagtctattaatcttcctacaaacgctctcaagtaaccacgtggcttcctaaaaacactctcaagccgccacgtggcactctaataaattagataaaatcctacaaattctaagaaaaaagcaaaacatctagcccttgattttacttaaattggtggacccgatatttcaagccattagattaa

SEQ ID NO: 23402 - DNA, 1501 bp, Oryza sativa
aagatgttagagaatcgaagactaaccaggaatccaagattagcacctgctggcctatgaaggaggaactgatcgatatctcggaattgactgccactgccatggttggctgcgccgtctggctggtcgtctgcgagggtcgaggagcctaggacgagctcactgggtggcgctagggttggataaagttatgctatctcttgggctagatggaaggggtgagttgggccttgtattaccttggactgtcccttcctcggttttctcggtggaccgatttattcttttgaagaaaccgacgcgatgactgaacaccgaactacgaaaaccgatggaaaaaccatagaccgcaataaccgccacttcggtgcggttcggttcggtgtccggttttcggtaatttcttgcccaaccctagtttcaagtaggccggaggaccatatttgaaccacaagacgaacttggagaacaaatttagataaaaatgaaacatcagggaccaaattgattccaaagcgaaacctagaggaccaaaataaaaacataagtaattaacagttaacagaaaataccaggtgctcgtacgagcctaaatgtaagtctttcttggctcatgcttctcacttgtctcccacatgttaaattttacaatggaacaccacaagaccaattctcaatccatggtactacgcaaatgaaagaaaaagaagtttatactgcatcgcaaaaaccccgatcatcgcccctaaggccctgttttaacttgattaagatacatactttttctcaatttccgttagcacgcttttcaaattatgcaaaaactttctataaaaaggttattttaaaatatcagttaaatcaaatttcgagcatataatagttaaaactcaattaatcacacgtttatgaatcacttaatcatattcatcatattcaaacgggacctaagggcctattcggcacagctctagctccagctccacttctcctaggcctggagctcagtcaaacagtttcagctcagctctatctaaaatggaaacagagctaggtggagcaatatcacaaaatgaattagagaggttgagctgggtttaggctgctccacaactctacttcaaaactcaactcctgaaattaaatttagaagttatagctctaccaaacaggcccgaaatcaaaacacaaaaggcgcggaaattaaagcggtttgtcaaaacgccccgatggagaaaccacaccacatcaaacacagagccttataatttgcccatgactgactaggccccttccccctccctcctcatcagcaaataaaacgtgcattaacaatgaccctcccaagatgagcagccgcaggcatggagagcctccaatggcgccctccctgccgaccttccccatatatgcacacactcacatatatatatacacacaaacacacaagcatatatgcatcccaacagtccatacctccatctccccccatgcttcgcct

SEQ ID NO: 23403 - DNA, 415 bp, Oryza sativa
caaaaatttaaaaaaaaattaagataatctttcgtcatagagcacttgagcttgcaagaagaaatatttaatgtctatgctattattgagataaaatgaataaaaaaggcgttgaatacgagaaagatcgatttgataatcctaaagatctgattatagtatagggtataaatatcttatttctgatcttctgtgtatgcttgtctttttgcacaaattaaaaggtaaaaatctatttgtgatttcatatggactagattttccttcgctttgctaactaacacatttagcacatttcaatccatcttgaggaagcttcgtcgatcacacttacatccagttgcataataggttactggtgatagatgggaaaatatatggaaaaatcctagaaactaacgttggattgaataga

SEQ ID NO: 23404 - DNA, 1501 bp, Oryza sativa
gaccacaaaaatatagtgtaatataactacattttaacaacactttatataccttgttgctgcaaattgttgagccctgatagtagtacataccctctctgtttcaaaataaactaatctagtatgggatgtaacacatcctaatactatgaattgtctttgaaaaacctcctatccagattcatagtattataacatgttacacccatagtactataatatgtcacatccagtactaaatttgtttattttgggatataatgagtattttaagtgttagatgggtataataatttagcattttaataaccaataacatcaacagtattctatgtactacatcaaatgcacatgaagcaaatagttaaggaagcgggaggaactaggaagccaagagtagttagggagaggggggaagccaagagcagcgagggagagcaccagagcaacggagggcccaagaaatgagcattgaggaagagaagagcatagaaataagaacagaaaggagtagctcagcagatgatgaagggggagaggagatagtactcgttgaggggagagtctccaccatcgaaagagatgggtacgtcgttgccagatgcaaagagcgctactgtcagatgtgaaggggagggagcaaagtcaccaaatgtcatattgctttgctagatgcccctctctatgtttcctatagtgcatgggctcgttttcacttaaacttcttttcacgaaagctaattttttcactagcgatatagagcgcgagactcccaggtgtcgcctcaagctgtcttaccttggtgcgatgccttagagcctcagagataacttggagtatatcctaaagcgacactttacagtctcaaggacatcaagtcgacaccttaggaacgccttaacctccatactgcctcctacccaactagatttgctggcttcctctaggagatgaaggattttatcaatttgaacacaaattaaatggatttatatggacgttttacaaaattacagtaaaatccatcagttataaatggatgcctaatattcatgatctatctaaattcataaaatcatattacttgttgtttaaaatctgatactatggttgtgtttagttcgtgtgccaatttttttttaagtatacggtcatacacttgaagtattaaacgtagactaataacaaaacaaattacagattctgcatgtaaactccgagacaaattcattaagcctaattaatctgtcattagcaaatatttattgtagcatcacattgtcaaatcatagcgtaattaagctcaaaagattcgtctcgcaatttatatgtaaactgtgtaattggtttttttcatccacatttaatgttctatgcatatatccaaacatttgatgtgacggagtcggaaaagttggaactttaacgaaaatttttttaatctaaacacgccctatatacgtatttttttgggaagagggcgacgcagagaggaggatt

SEQ ID NO: 23405 - DNA, 241 bp, Oryza sativa
gtccacagataaatccgcaagcgcacggaataccgctgtagcacttcactttcgggtgaccccaaaaggatatcaaactcagggaacgtgtgtaatttagctaaggctaagactatccaaggacaacaactgatgataggcaggctagagaggtcttcctatgtgttttatttacctaagctaagttgaaggtaatttcctatctgttgcttcgggcaccgacccctgctggtctgccagc

SEQ ID NO: 23406 - DNA, 1501 bp, Oryza sativa
aattatattatgatgaaagaaatttgtatgataatatttttgacagcacattgttcgctagtataccatatttttcatgtattcttttttttttgtgcaaaagatggttaaatttaaaattaaatagtgccggtgtcaattatttggaatggattgagcaactttcagtatcactatattaaccaggagtaatggacgtggaaacaaattaattacctcatcacatatgacctcctttattccccttacattatcttagtcaatattgtgcctcatgaataaatgatctatcaatgcaccatttgaaatgtacaataatatttatagggcaataaaatcatttaaatctttcttagttcatgtatcaaattaactccaaaaataacttctgcatggaattatagttggaataagacgcgaatggaagaacgttgatcgatgtgttactacggaattggagcgaaataggcgtgcagcggccagtacaagcgaagctccatcttgtacgtcgtccgagtccgcccacgcgtgtccaccggcgacgaccggacgtagccgacggcgtacaggaagtcgccggtgccaccgaccaccgggtacacggacggcctggtgatgttgggcgtgcccccgaggatggacacggagccccggtatccgcggtggtggagcgtgatcttggccaccgacacgctcctccggccgtcctcgcagtcgaagctcgtcgagatggaggtcccctccgccacgccggcgacacgggaggagctgtcggcgcgcaccgtcaggttgtcgcggaagacgtacatgctgccgaagggctgcctgtcggcggagggctcgccggcgtcgctgacgacgaccctcgcgggcgcgggcgcgtcgacgccggggacgacgacgtaccccgtcctgttcatggtctcctgctggtacagggtgaagctgaccgtcttgtcgatgatgtccttgcctatcttgctgcgtgacgagaacggcgacgacgacgacgacgccgccgtcgccgcaagctggggttggggatgcagcaaccggtgcgtggagcagatgatcattaccagcaggcacagcaccaagctcatggccgtgttggtagctgccatggcgatggctgcttggttgattattgctgttcactagcttcccgtgttggcctattgaaaccgagagaaagagaaaaacggaagaagaatttgagcttaggtggtgctaactgctaaataatccttttgattgattattgctgctcactagctttccatggagatggctgcttgattgattattgctgttcgaacacacggtaagccaccgtgccgtctgaaagagtccgttacatagaatgttaccgggagtctagatccgcacgggaaggttctcgtgtgtttaagcacacacggtagggattgtctatttatttgtcaggtgatttctaagaaaaaatcacccagattttttctacccttaaatttacatccaa

SEQ ID NO: 23407 - DNA, 1501 bp, Oryza sativa
ggtggtactgctgctgctgccatgcacatataaatgtgacttggagctgcatgacctcttttctgtggaaattaatagcgctagtgatgaaaggagaggggagaaaattttgctgcaatttatgggagatgtcatagtgatggagacagacttgtgagttgaactggacagagatgagatgtgtggacagtgaaagcagtgataaagcatagctacagctattgttggtgtaagcattggggattggattgactgggaatattcagaggcaaatcctactccctccgtggattttgattctttgattgtaacgtttgaacactcgtcttaattaattttttttacaaatataaaaaacgaaaagttgtgcttaaaataccgtagataataaagtaagtcacaaataaaataaataataatttcaaaattttttaaataagacgagtggtcaaacattgtaagcaaaaactcaaaatcccttatattatggtacagagagagaaccttttatatcaaatgtcttttacgagtattcttctgcttgtatgccaaattgctttcgtcatgcaccctccattaaaaaaaaaagaatccttatatgccaggaaaaactggctcttcccatgtctcatgccactttcgtttgttgaccgttaactccaaaggtaaaaagacgtatttgccattctgagttgttaggcatgtcgtatactcataagagcaaatacatcttttttatttgagagttaacggtcaacagacaaaagtgatatgagagggtgcgtaaatttggactaattgcatacacgaaaagagccaattttttttggacgtatacgggtgtgtttagttcatgccaaaattggaagcttggttgaaattggaacgatgtgatggaaaaattgaaagtttatgtgtgtaggaaaattttgatgtgatgtaaaagttagaagtttgaagaaaaagtttggaactaaacaatgccgtaaaaaagagccaattttcaatggtatataagggatatgaccaattttcagtggcatataagagattctctcttaaaaaaagctattattagattggatataacctaatacagcagcgaatctagacaaactttttttatatttgtggtactaagttatgtcttattttaatagtactaggttgttttctttatacggagagagagtatactcctatttttaaggatgtataaccaaaatctacaggcagtcaatttacccccctggaaatactactgtaggtgtatagaggacgagacaaatacagttcacagccggctggccccgagcatttcacaaccggtaaatgctcatccacagaaacctggtctgaagctagctattcctggagacctggacaatctctgcctaagcatcggtcgacgagttccccgccactcgagcgtctagacttctgatacgccagccagccatcccgatccctggcatgcaggactgcgattcgatcgagctac

SEQ ID NO: 23408 - DNA, 251 bp, Oryza sativa
  unsure (1)..(251): unsure at all n locations
agaggggtnatctagtggtcctgctaattcagattttgttttacacacccatctgtgtngatccagagcatagaatattatagtatgaattgagacatattcttttttgttaattgtgagatgtagcttggctggatctggagaatggtacgcgattttagaaatttagagaacaatattgtagagaatgtaacttaaggcgtagtacagaaatgcgaggttaacgcagttattgttttcatcaagcacaa

SEQ ID NO: 23409 - DNA, 1501 bp, Oryza sativa
aggtttctgtggatgagcatttaccggttgtgaaatgctcggggccagccggctgtgaactgtatttgtctcgtcctctatacacctacagtagtatttccaggggggtaaattgactgcctgtagattttggttatacatccttaaaaataggagtatactctctctccgtataaagaaaacaacctagtactattaaaataagacataacttagtaccacaaatataaaaaaagtttgtctagattcgctgctgtattaggttatatccaatctaataatagctttttttaagagagaatctcttatatgccactgaaaattggtcatatcccttatataccattgaaaattggctcttttttacggcattgtttagttccaaactttttcttcaaacttctaacttttacatcacatcaaaattttcctacacacataaactttcaatttttccatcacatcgttccaatttcaaccaagcttccaattttggcatgaactaaacacacccgtatacgtccaaaaaaaattggctcttttcgtgtatgcaattagtccaaatttacgcaccctctcatatcacttttgtctgttgaccgttaactctcaaataaaaaagatgtatttgctcttatgagtatacgacatgcctaacaactcagaatggcaaatacgtctttttacctttggagttaacggtcaacaaacgaaagtggcatgagacatgggaagagccagtttttcctggcatataaggattcttttttttttaatggagggtgcatgacgaaagcaatttggcatacaagcagaagaatactcgtaaaagacatttgatataaaaggttctctctctgtaccataatataagggattttgagtttttgcttacaatgtttgaccactcgtcttatttaaaaaattttgaaattattatttattttatttgtgacttactttattatctacggtattttaagcacaacttttcgttttttatatttgtaaaaaaaattaattaagacgagtgttcaaacgttacaatcaaagaatcaaaatccacggagggagtaggatttgcctctgaatattcccagtcaatccaatccccaatgcttacaccaacaatagctgtagctatgctttatcactgctttcactgtccacacatctcatctctgtccagttcaactcacaagtctgtctccatcactatgacatctcccataaattgcagcaaaattttctcccctctcctttcatcactagcgctattaatttccacagaaaagaggtcatgcagctccaagtcacatttatatgtgcatggcagcagcagcagtaccacctatcccagccactagataaatgcgaaagcctccatggctgcattgctcattgatcatctgcccaccattagagacatcaagaacactctgcactagctcactcaggttgcatccaaagatcacaagatctgaagatcacattgatataa

SEQ ID NO: 23410 - DNA, 799 bp, Oryza sativa
  unsure (1)..(799): unsure at all n locations
cgatggtttgaattcggcttgcaatgganaancaccttggtacccattgtgaaaaagagaataaaaaaatatgaaaaaaatgaataccgaatccttggaaacggtcttgacgacaaggacgtattcgatgtgagcaaaataattggagccgaatccctggaaacagtcttgacgacagggacgtacctggaataaaagagaaaaatatgagcaaaaaggctcaagaaaagaaaaggttaaaaaaattctcttggttattttgtgctaaaggttatttgagaaagagtgataaatgcaataggtatatgtgtttagtgtttattcttcaacctatgtgcttgttaagatgttgcattataaatcatatgaaatcatgaattttgattgttgattcaagcttaattgtaaaatctttggttcatggttatactttaatgcatgcttgttatattatagatgggtttatcttctttttattgcaacacatgacttgatatgctatatgtgtactaagctcttgaacattaatgaacataattcctatgcttgatgaaatcattgtcaaaagggggagaagtaatgtgagcaaggtgaatttttggagagttgttgagaagagcatgtttttggttcaattgggaatttctttcttttaaaaagggggataagttttcttttggattttttgagcacgatgtgtacgtttgtaccaagtgttctttccgctatcgctttggagagcaattgagttgagttttgagttagggtttcgagtttagtcgaaaattttctaaggagg

SEQ ID NO: 23411 - DNA, 397 bp, Oryza sativa
ccaacccccttgacgcttccaaaatataaaaataagggtttattatcccaagcttgtcatacctggtcaagtagatccaactccctccgaaatcacaaccaaaggttgtccccaagagtttcatgccccaccaacttaaaaacaacaccctcgctgcccaaaaactttcaaacccaaacagattgacaacatcgtattctctacaagcagaccctccaacagaacccgcgtctctctccttatcatgggggcaccccttgactggagtctagaaacagactagtcaaagaagggaaggggttccaaggaacaggagaagagaacttcagccggttatggggatcccttgccgtcgaccaggtcactgaccacacatttgttcatcgtgtcccgcagc

SEQ ID NO: 23412 - DNA, 1501 bp, Oryza sativa
ctcatgttaaaaatactccaaaacttgtatgaatttgggcattccttagaaatttgataagactcaatagttttcaataatcctttggttcaaagaatcatatagaaaaaattcctatagcaaagtttatcgtttctatacagaataaaagttcctatatttttctttcaagtaaaggggccctaattagttactccactaaagtcgaatgagctaggttcactttaccatgcgtggcgaagccacacggtttttctagtatgtgtactaaatcatagttatctaacaagtttgtatgtcatcaacgcaatttactcatgattaaggctttattcagaggcacttactgttgtagccgctgcggctgcggtagttcaaactggctgctaccacagcctagcccagctgaacacaggctaaaaagtaacaatttgttacaactttgtcgagctattacggaaaatgacaataatttatttgaaaatcgtaactccatcctctacgtgtgtatgacataataaacccgacatgcaacaacacgagtattgcatatgtgtatggcgtgtgggctcaaatatattggacatataaagttgcatctttctgtttaaatcatgttatcatcgatgcagtttctatgaaattgcatagctaaagttgtactagtgtactgatagttttcacaaaatagttgtggcttcctacatctactctatatttatgctcctacagaactactaaaaacacaatgaaataaaagtaccgacaaatttactgatatctgtcttcacatagattaggagcaaaatttatcgtcgtacgtatttcaaacaacatctgtttaagcttggcaacgaacttcctactaacgaaaatcaaagattaggcaagccttttggctttagcaggagctaagcggttgcgtgagttaatcccgcactatgtatagtgtacagctatagtggttctccgttttccttttacccctaggggtttgtattttctcctgccctgttcaatgaaaagtcactctagtgctgtttttcgttaaaaaaaaaaagcttggcatatttctctacacaccagtgttgctctgtatatctccactcccttatataagcacacacacagaggcaccgcattggtagaagtagctccgtgttgtagtgttgtgtagcagtagtccaccgctgagaagctagcaaagccagccatccattcagcgcagtactctcgggagagctagaagcgatctattctagccacaaggaggagagataaacgtatcgaaatggagcacatcgcgaggttcttctttggagtttccggtgagtgtgccgccatggctagctgcagcttgttcttaatttcctatctgtctatatgtgcatgtagtatttgtttctcccatcttcgaacactcgaagaaatgaaggtgtatgggtgctcctagagctacctactttgctggttaatttttggtgaagttttacactactgt

SEQ ID NO: 23413 - DNA, 1501 bp, Oryza sativa
gccgcgtgtttctctcggtgtttctgttggggcctgaacttaactgacgaaacggtgtttcctcgtctgtttgacgcggctttggaggcttaatttagtattccagctgactggtgactgctccgtcatgaggtgtttcctgtgggattgcagctcaagcttatgcagagagcattacctatttacagtcttgtcgttttgttatgcttatacttactccctccatctttaaaaaaaaaaagacaaatcctgaatttacgtgtctaacgtttgaccatccgtcttatttaaaaaaaatatggaaaaaaattaaaaagacaagtcacgcataaaatattaatcatgttttatcatctaacaacaataaaaatactaattataaaaaaaattatataagacgggaagtcaaacgttggacacggaaacccagggtttgtattttttttttagaacggagggagtataagctagtgaaatttaaattttaaaattttattttacagttgattttgtgagttttttttattgtagtttactctataacatttgcttttgaattgttaaatacatgcatatacgagttttatctgtaaattatttttttaataagcaatacagataagcatgtatgagcataagccaaacgatgaaactgttagttatcttaagagtattagggtagtaactgaattactgttagctattctcaacaaattatggttggtgctaacacttaaaattcaccttgtatcctctgttgaacaaattatgcagtgtgttccttctgaaagatagaacattttgtaggggggaaaaggcccacatagacataactaggcccactgctgcagtgggtctattgggcttgaccaggctggttaactctgaaaaagctagtgggctttgacggtttgacccatgattttttttcatagccaggccctggctaattttgcttgctttcttcatctgtcaccccttcaaattaaacacttcgacttcgagagcaaagataaccgtcaggtctgtatcattcacgcgattacgttatgtcattctaggctagtcctctctccgtttcagaatgtatatataaaaagacatagcaacacttataataccaacttagggcagttttgaattgctaccaaaatttgccataccaatattttggtagcataaatagtatccaccatttgtttggattggtgtcaacattttagtaatgcccatctcaaatttggtagcaatctagaactttcttcactatgatatcacaatttggctagattttggtagcaagccaaataagatgaatacaaatttattctaccaaataattggtagtgccaaaacttgcctatgttttggcactaccaaaaaattggtagggcacctatccaaacaagcccttaatctcattaaatacaccattaaatatattttataatatatttgtttggcatagaagtattactacattattctataaacttgatta

SEQ ID NO: 23414 - DNA, 766 bp, Oryza sativa
cacttctagatatagattatgagaggtgaaaataggaaagggaaatgaatgaatgaatggctatgattaaatgagatatgaaaaatggatggctatgataggtactctgttttcccaactctctcttctacggttttccgcgcgcacgcttttcaaactactaaacgatgcttttttttaaaaaagtttctatacgaaacttgcttaaaaaatcatattgatctatttttaaaaaaagctaatacttaattaatcacgcgctaatagaccgctccgttttccgtgcatgggagatgggttcccaacacccacctccgaacacagccttagagggtgggatataatttccctatcccatttgccaaacaaagccttaggtcgtaaaaggttggaacccttcctctccaacatgtaaaacaaaacacacattagcgtatgattaactaaaataaactttaaaaataaattaatatgatttttaaagcaatttttttagaaaatatatataaaaaacacatcgttgaatagtttggaaaacgtacgcaccgaaaacgagagaggttgaatagtttggaaaacatacgcaccgaaaacgagagaggtgagttaggaaaagaggggaagaacacatccttatatttggaagtaagtttatttttattttattttatgaacggaaggagtatctcgctgatccattcatatgcgcatgaaggcgtggtccaggacaacagtacacagacgttactatagtgatccaaatgca

SEQ ID NO: 23415 - DNA, 1501 bp, Oryza sativa
gtccagcaacccaattaaatcgaattttggcctctagcatgcttcgatatatggcccgtgatagcgaagagagtcaatttgtgttttgtgggtgtgtgtttatgtgtatggtttttttaatctggaacttagacttgccctgattattttagaacttttgatatttcagtcatgatcgagatcgagactgattttcttgatcttcattattttcctaaattaattggtttctatttttagataaccgaaacttgtagaagatcaaagatcgagaccggattttttggtttgaccaaacgtccaaccctagttcaaggagtcttaatgttacggtgagaaaatgaatcggacttaaactatagttgaggaaaggcaatataaactttttccttacaacatggtggaagtgcaaaacttccggtgatgtgcttgtgagttgtgatgcgatcactcctttcttatctctacttacccaactcacctctttcgttttccacgcgtacgtttttcatactgctaaacggtgtattttttatgaaaaattttttatataaaagttattttttaaaaaaatcatattaatatatttatatttattttagctaatacttaattaatcatacgttttattttacgtgctagggagtgacggttcccaaccctcgttccgaacatagtatcttcgtcgcttcggtgaagcgaaccagggagtcaccgagtcggcgtgataacgaagaagaacggcttccagaacgtctcgtcaacccaatgacaaagaatggaattaaatttaaaaatatactgttgatttgtttttccttagaaatattcgtggcgtaaaatttagaaatattcgtggcataaaatttttagcagaaatataccatcaatctcgcacaaccgttgtgcaaagaagcgtgacgacgcacaccgcgcagtatcgcgagaccgaacgtcttgtccagcggttctacttaattagtgatcaattatcctaattatcgaataataactagtgattaattatcctaattagtgattaattaacaattaatcaatcactaattaacaattttcaaccgtcgtaatcgctcactgattgagagagactgctcggtctcgcggtttggccgcgcgagaccgtgtggtctgacgccgtctgcacgcacgtcctcgatttcgtcgtttggtgtcacggtttcattgtacggggccgacacctgttatagatgctatttgcgtcgtcacgtccacgtcacttatgcgaaacggttgcgcgagatcgacagtatatttctgctaacaaatttacatcccgagtatttatgaaaaaaaaacgaatcaatagtatatttttaaatttaattccaaggaatggcgagttcgtgctgagcacggacgctaacttgcacgggacgtggaggcggatctccggttaaatgcttggccatacgaaaccgcttggtgagcgagtgggtttacatacggttttggtttgaat

SEQ ID NO: 23416 - DNA, 1501 bp, Oryza sativa
aaatgtgtgtccatatatttcaaaacttttacacccaaagaactaaacacacccttaccctggattgtaaaaaaaaaaagcatggaacctttttgtcagcaagagagagggaaaaaagagagaagaagaactatgaacttgggcctagtttagttcccaacttttttttcaaacttctaactttttcatcacatcaaaactttactacacacataaaattctaacttttctgtcacatcgttccaatttcaaccaaacttccaattttggcgtaaactaaatacacccactgctgagcatatcatatcatgctgggcccttgggggaccatgcagtgagcatcaacaatgaaactaagggctcatttcttctgatgcaagcctttgcagcaacaaagaatactcctagtatacaataaaatactactagtaatacatataaaaacaatcctatgcatgaaaaactggtacaggaatctactagctgtgtcaggctgctgcataatttcattgcctcctccatggggcagccttaaatttctctatgctttttttaacaacaaaggaaaaggcatatctgacagactgacgcctcccttcaatctaccctgaaactatttattatatgcgtcgtctaattatataaatgcatctttatttatctctctccttttgtccatgactgtgttgcatggcaatggcaattgtatgtccatgccctttggcccccacatgaacctatcagaataaagatcaaagatgctgctatccacaactttggtgctggtgtcacacactgtcacttgcatggatttcttaggattatgcctatccatcactaccgattgaccaactgtggattgaaaggcaaataattttgtagctatttggaaccaggttttaggggtgggtcgaaccgaaaagaccgagaccgaaaaattcggtcctagaccgtgaaagaccgaattttgttcggtcaattcggttagtcttctcggttaaccgaatagaccgaattaaaaaaaagtctaaatgcaacctacgatccactaagttcaataggactaaactctaatttttcacatccctacttcttctagacatgcaacctaataagagttttatacgtgcttacgaatttttttgtgattttttattgaaaatttccattatttctttgcatatatgaaaatgttgctgaatttcagtcaggaccgagaccgagaccgaatttgtcggtcttgacattttttgttgaaatttggtcttcacttttcaaagaccgaaatgacatacaccgaagaccgagaccgaaattttcgatcagaccgaatgcccacctctaccagttttaggtgttgcctgaatgtaaaagctgcagtcttccggtgcctaagagcaagtataatagtgagctataagcttactataagcttaagtggaggagagaggtagtgaaaaattaagggtgttgactctcatgcaagagctaacttatcaca

SEQ ID NO: 23417 - DNA, 1501 bp, Oryza sativa
aatcctctattttgtacttgcattactattagaattctccagtaggtggtgtttgaatctcttgaagatgaagatgaagattaaatgattcacgcaaaatgatatagtaataacatgtgattagttttaattattacaaactttaaaaatggattaatctgatattttaaaacaactttcatatagaaagttttcacacgaaacacatcgtttagcagtttgaaaagcgtgccacgataatccaaaattttatcctctcctagtaggagaaacgaacagggcctacgttttttctatttctctgtttttttcattcctatgattgaaaaggccctaagggtgatatagacattttccttattatattaattatagtacagtaatgcttagttgcacacgctatctgaatgaagcgtacaatactgtgtacgagtttaaagtcggtcggtagcagcgaaaacaccatgcgaataccacttgagtattcaacgcattgcctcacaagtcacgagggtgtagtatttaaaaggagagacagaattttcaaggaaggcatggcatccttttccttgccctttattcgctccctttgtttgtcccaactaactccattctaacacgatataattaagcaagctggatatatctttttttttccggggaaaacaagctggagttgatgtgcatgtgtccaagaaacgttagggaaatttgcaagtcaagatcaatggtactcttttataaaacgaccttgcggtaacctagcaaatggtcgtatcttatcttattttataattagggattgttttatctgtcaattgtgtagttttgggctaatttctcactcacctttgaactaaaacaagctggggttgtggtggtaaatatatggtggaaatcttaatttgggttaaatttgatgtaaaccctgataaaaagccgtctaaattcactaaaataatcacacgtacgcaagatgatgttacgctaccatgtaatttttttcaaactcaacttcatttgcaagctataaaaccaaaaaaaattgaacgaatcatcatgacaaattgttattttaatatctcataaacggaatcgagagtttgtacatgatttttttacatggtagtttaacatcatcttatctacatgcgtaatctttttaatttagatgacttcttaattatggtttacacgagttttcacatgagttaagtttccaacacatatttgtacagatgttagaataagaataataatatagccaacttattactattagcccatcttaaaaccaacatatataattgattagctataaggttggctacaattttcttctcctgtctctatctctcacttatacatttaatgtatttgtcttggagcttgtgataagttagctcttgcatgagagtcaacacccttaatttttcactacctctctcctccacttaagcttatagtaagcttatagctcactattatacttgctcttagg

SEQ ID NO: 23418 - DNA, 1501 bp, Oryza sativa
caacgacagaaccttacaatctttccgcttcttctcagcggtccattcatccttcttcttcttcccgaagctttccagcgcctcatcaagatccgaagattgcaccagaacagcccgcatcttaacttgccacagtgagaatcttgtcttgtagtctagcagcggtagatcatacttcatcgatgccatcgcggaaccctcgtgtgagaacaagctctgataccacttgttaggaaacgataggcaaataaacgataaagaaaatagatcaatcacagaagacatgagatttaacgtggaaaaccctcccaaagcaggagagaaaaaatcacgggcgccagctagaaaaatatcttcactatatcggggtgaggttacaacaccgaacagcggcttacaagaagtatatatgaaggtgaaaccctccggcgacaggcctccacttcgctccggcagaagctggcctttatatatgtgaaaatgaatttggatcacaactcaacaggaacgagttctggacttctagtcgcctcgtcgacgatgagctaaaggtttagggcaaggcgtattacaaatgggttgatggagagcaggttggcaggggacgctggctcgtcctatgcttgacggaggacggcggcggtggcggccaagatggcgggctccgtcatcggacgatgacatgacatagagaggaatggtcaacgttggaaggaagtggaagaaggaagatgaagatccaagggcaataccatccacgatgcattctagcaagaacaccctccgttcaaccatggcacttatcgaagcattttagcgaagccagctatttttgatggcacatataccgatttctccctctcaaccccctccatgaagacttaaatagttaattcatttgtaataaatcaattccattactgtaatgggcagtgtagcctagtggttgcagtgacttgagtagcacctaaaagtcttgagttcaaatctccataggagcgaatttcagattgggttcctaatttaaaaaggttgcatatatccagttgatgctctctatcacaccatcttagagcaattgctataaaacctttaaactgtcatataaactcaaacaataagttagaggagagagaagaaatcgtccattatgtaaagggtaatctcaatatataaacttcaaaaaagatcaaagaagaaggtcaataaattgaaagataaagaaggaaaaaaatattgtagtctattaggacaaattgcttgagataatatgttgagcgtgtcacttcttaattaactaatgagtagataatgtggataaaactggagatgattatattacctttacttataaaacttgttcttagatgtcagcggtgagcctattttgtatcttggcacatatcagtagcatcacttttaccatctttacataatccctctcaaaagattcaccgtttaccacatgctatgcataaattaaaactgcacattaaaaata

SEQ ID NO: 23419 - DNA, 1501 bp, Oryza sativa
atctgtcaattgtcatcacttataaatcttttgctgattatctttgtattttttttctatgacaaatggaatagtttcaacagaaaattagacaaaagacagtacaatcaaaataaaattgggttttactccctctatcccatattaagttcacttttggttactctcattcttagtaatcatcgcattggagtttgtgaaagtagggaataattaaattgaatgtaaataaagtggggaataattatattgggatttgataaagtaggagcattatagtttttttagtgtttgtattggtatgtgtgagaccgttgaaagatttaacttattttaggatggagatagttgtaattataaactagcatattatcagtaaatgacagttgggaataaaaggtctccttctcattggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagt

SEQ ID NO: 23420 - DNA, 1501 bp, Oryza sativa
ggaatcttttaatgctgatatatgaaggcccatgtgttagagcaggtacaatagcaggctataagcaagttataaacatattttaaagagataaaagaagatagagaagagcagcgggctacaaatctgtagccaactgcagcacggactccaaaacgtaatgcgtgtatgacaggtaggaccagacattaataatatagtaagaactattgtatgaattggctatagataaattggagctagtagttggctatactattaaacttgctcttagtgtgggtgggtgggggtggaagagtcttctctccaagagtaggactatcatttttctagtggttttatagggtttttcaccaatttattttttcacaggtttggaaaatagtttttcgaaatctaaaataggcctgagattcaagatactggggataaatacgaacttcattataggttgctaagtgtcatgtgtaagatagtatatgagttggcagctcttaaccacaacataccatgttgtaagctaaaagatttgtaaaataagattgttcacttttttttttagtattatcaaaagttcacacttagtaagataaatcaggtggctatacaggcatagatgccacacgaacaaacggagaaaatttttgtacattatatctagaagaggcagtatgttgaaccacatcttggattaggagggtggccggctgactcagcaccaacgagtgccattgttcgttgctgtaaaccgctcttacatgcttcatcttggtttgatggccacacaaatttaaatgaagatcaggaactgaattttctctttttatatataggtgtatgatgttgtgccctgttttatctaatcaaaagggtttcttaccactatgaaaataaactgtaaggcgcgttgatatcactatcaaatgcacaacctttttttttttaagagtgaacttcataaaactataactattttatcaaaaatgttagtatgctgaaaatttagctagacattttagagaacgacaataatattatataattttattagaaaacctcatctttacatctttgacaagtttgggtctcctgaaatacttgtgctcttgcatcccacatgacatacacacataggagataaaattatagttttgtaataaaatcgtccactattgttgcggttttgtaaaatacattcccttaaaattatagcaaaatgatagttttcatcaaacaattatagttttgtaaagtccacttttttaaaaaaaataatgaaactagtacatgcatgtacatctcgatggccagtgcattgtgtagtatttcctttaggctgataatccttgtcgttttagacaaggctattgttaaactaaaaaactttgactataaataatatttaaaacatttgtcaaataaatatggctcccatatgtataggttgatcttaaaaagtgctctgataaaattatatacttattgatatttctatatatat

SEQ ID NO: 23421 - DNA, 1501 bp, Oryza sativa
ctaataatgtcgcgcttcattgataatagtatcgcaacaagggactaattatctgcttcaataattatcagcacttaagtagctggttagtagattcacttgctgtccttcacctccttttttgtgctaatttcggtactaaatgatggcacctttcctctgtgttcttatcttggctccaaaagattgatatatattgatatgatatgactaaaccacatcatcaaccgatgttgattgtacagttgcaacatcaaaaaaaatgctggaccattagcttattgatgatggtggcaacccaactgttgcttttgcttttaagctgagttttggttgggttcatatgcgcctaatcttatcggttggaggcagcttagctgctctaatttggtgagaaatattggctgtgatggcatatttgttgggcaacttgagtagtgaccgatgagaaagctgcagagagaggggcatatatgataatgatatatctctgggttaagaacgttgtcgcctaacaccatgtgggaggtatcagtttggtcggctgcaaaaatgcttttgccatgtctgtcttatcctctggtgatagatccactggcttataaatataaataaggcatttgtaagcttgtttaagatggcataagcaaaggtttgtgtgtgtcagagtcactaggcctagctagctccatcagttttggctctgggatggtgctggggcagcttgcactgtggtccaagattgccagttcagtaatccttgttttttttcaatggtttaatcttgcctctcttttttttctttttgttgcattcggaatgcagatgttaattatggtttggtagtgtatattaatattattatattggtgatttttgccttgatagttttgaaaagtttgccattctcttctcttctttggtgaatatgtgtggtgtaatctgatacataaaagggattttttttttggtgaatcttatgagggaatgtacctgttcttgtgcagatgaagcatcctgtgggtcaccaagatggatagggaagagcctctcttgcgtatgcatcaagagaaaaggagcctatgagagaatatgcatgaaccttacaccagtgcaggtatgggcttgcgagatatctttactgtgcaaagatttgcaatgcttttatgccaatgtgcacagacagggcctttttctgctgtcagaaaaggatttatctgcagatcaaatcaatcaatagataagcgggcctgcttttgagtaaagatcacatcgcttaatcgcagactcgcagtgaccactcaaaagggattgtttaagctttggctttaagttattgtttttctttattcatggatattagtttttttttcaatttcagtatgtggtctgaccactgacatcagaaaatttacatttcagaacttcctttgaaactttatctcttcatatatatcactaatacagatagttaaaacaatcatctcttccaatttacagg

SEQ ID NO: 23422 - DNA, 532 bp, Oryza sativa
tcatcattgcaactgaactcccccatgtcgcactttagatccgcccctgcgtgattgtatagtcacatggtgcttgggctccggttttaatatctgctatatgttgatgctcatgcaacctataggattctataattgcattattttgattctttgaagttatatagaattgtatgtagatacgacgagtcagttctaagattactggctagacttggctgaactggttctttgtgaactttagtggttgcatatatgcttgttgatattgtctatgctgctatgagtgacaaggcctatccaatcatgtcttacctcatcctctaatctgattacccctaaatttgggtctatactgtatgtgtgcgttgtacttaccaagaacttttgttttgtaagtttttcctgcatgaaaaaaatattccctaactgtacaatgcatttctgcgcaagtattcatgctcttttcagtcattcatattcattagattttgaaaagtactgatgtttctttgcttttgttttcaggaga

SEQ ID NO: 23423 - DNA, 1501 bp, Oryza sativa
gtgcgatttaaataccagagcttccagataccaggaggaaggaggtttctaggctcactgacctgtggggccagtatatgacctggcccacctggcattgagttgcagccgctctgcgctacgtgacgtgacgctttgctttttgactttggcggtgtcgagaggagggtggtggttctctggtcgtgcgcggtggtgaggtgaggtgaaacgagtggtctaagaaaaaatttaaaatttgttatatcgtgggaccgagggagtatcaccctaccggtaacatcaacggccatacggagggtcaagtgttcatcggtacgaccgtactcgcccatgatctgtccacatcacgaaggttaggggaggtctgcaacttttctgccattctcagctcagagttaaatgtgaggagaaccggagatgggctgatggattgggaggccttctaaacgaacacaacgccggatctaggccagctttcatgtgcggcgcgttagtgttccatggcctgatctaagaggccgaaaccttcgggcaatcctttataggcccaactacaacagcccacacgtccgtggggatcccgttaggccgtttccgacccaacagctacggaccgcacgttctcaaagtccggcctgggcacatctgttgcacgtaggaaaggaataagtttactttgtgaccctcaaaagtgatcgaaatctaatccgtaaccctaaaccacaaaaccggatacctcgacccctcaactcttaaaacaagtgcaattcggtggttttggaggacggtttcgctgacgtggtgcctacgtggcattctagtcatcaaataaattaaaaaaataaagtggggcccacctgtcagtgagtcctctcctacgttctctctttcttcattgccagcagcggcgggaggacggggtgagcggcggcggctggcggcatcggggcgcagcgcagtcggcggctaggacggcggcggctcggccgcggaggctcgcgatagtgggaggacgaggggaacggcggcggcggcggcccaatatgctgctcgtcatcctcgcccttgcggttaccggcgcggtctccgacggctcgcgagtcgctggaccacatctccatcaactgcatcggcgtcgggggacatgtccggctgccgctccgtccactcgcgcccgttcagcaccgatgaggagggcgaggctcctcgtccccgctcagccgcggctcttcttggatagtcccgactggaggcagtcggcggcggggagggagtgggaacgggagcgggacgatggcgacgagagaagaggaagctggctcgcgtcgggatcttggtggttcgtcggcgatgatgccgtgtgcgctgatgtgcaatcttgagctttttaatttctgttttgcatgcatatagtggctggggctgaagtctggcttgttctttccagttatgcatgtaacgaactgctgatggagatgaataaatagagaagaaaaca

SEQ ID NO: 23424 - DNA, 1501 bp, Oryza sativa
ccaccaccaccacttgcggtgcgcggccgccgccgccgacacccgcgggctcccgacgccgcccctcgctgtgagccgcgccgacgtgctcctgctaaagctcccggtcaccatctcgccgccgcatccgccgccgcctgatctcccatcacacaaacccccagcagccaaatctgctcgaacaaatccaccggcgcggcttcctatcccaatacgccgcgttcgaatccctccgccaaatcgggccggatcgaaccttgggggggccacctaaccccagtcccgcgcacagctctccagatcacggagcaccaaaatctcttgctgcccaccacggaagaggaaggaaggatttccacgacgaccgggatcagggccggctactcaccagattccaaccacccttcttctccggcgatcgccggagcggccgcacccagccccctgagcaggctccggaactgctcgatatcttagtgggcgcgtcgcccggcgacctacggctacgtcagcgctggcgcggcgcgaggaggaggaggagggccaagtccgaggagtagaggaggaagacgacggctccgcgcagaggaggagggcggtggctgaggaacgcgtgcgatttaaataccagagcttccagataccaggaggaaggaggtttctaggctcactgacctgtggggccagtatatgacctggcccacctggcattgagttgcagccgctctgcgctacgtgacgtgacgctttgctttttgactttggcggtgtcgagaggagggtggtggttctctggtcgtgcgcggtggtgaggtgaggtgaaacgagtggtctaagaaaaaatttaaaatttgttatatcgtgggaccgagggagtatcaccctaccggtaacatcaacggccatacggagggtcaagtgttcatcggtacgaccgtactcgcccatgatctgtccacatcacgaaggttaggggaggtctgcaacttttctgccattctcagctcagagttaaatgtgaggagaaccggagatgggctgatggattgggaggccttctaaacgaacacaacgccggatctaggccagctttcatgtgcggcgcgttagtgttccatggcctgatctaagaggccgaaaccttcgggcaatcctttataggcccaactacaacagcccacacgtccgtggggatcccgttaggccgtttccgacccaacagctacggaccgcacgttctcaaagtccggcctgggcacatctgttgcacgtaggaaaggaataagtttactttgtgaccctcaaaagtgatcgaaatctaatccgtaaccctaaaccacaaaaccggatacctcgacccctcaactcttaaaacaagtgcaattcggtggttttggaggacggtttcgctgacgtggtgcctacgtggcattctagtcatcaaataaattaaaaaaataaagtggggcccacctgtcagtgagtcctctcctacgttctc

SEQ ID NO: 23425 - DNA, 1228 bp, Oryza sativa
atcttacaatcttaatatattactccatcgcacttgaggtatcgtggcaatagtccttacaaaatgtgataggagaagacaataatagaaatacacctgcctaggtcatataaactcacgcttggggattgacttggcttaggtttctaggctgtccgcttagaattttttctccttatccttcctttgtcgctattccaaaaaaaagtttggatgatattacatttatagatggatgaagtgggtaccattttgtcttaaggtccaaacattttccatgtctcacatcgacttggatttagcaaacacacaggccatgaaaaaataatgcacatgctgactaacttatctgaactataatggtaccagatacttttgacatcaacaatggttgaatttattattttttggtagtatgaaatcaaaggtggcaaataaaggaacagtgggttgtgctctccctccccctctccaacctaaaggcatggatataaatgagtagagttgggatgttatacttcttttggttctcacaaaagttggatcttgtaggcgcgtggtgtggtttgtagttttttttttcctagtcatggactcctatagctatgattttgtttttttttttgctatatcaatatgaaatctcgcaccgtcttgtacagttcagttcgaaaaaaaaaataaaggaatagagaactaacatgcatggctttggtggtgaccaatgtggccatggtgctgcatgaacttggaagcatatgcattacagtttttagaaagttggtagaaatcactggtaagcagctcttttactatacttcatgctcattttggaataccttgcagaagtcacaaaacttgtgcaccaagaagtagtagctagtatcagtaatttgtatttgaggtgatcaatgctgcacatatctatctttagctatgactttgacaaaacgtgctccaccaaacatatgttgtctgcctaaaaataaactactagaatttataggactatttccgattaaaatttgtaacttgagcaatttgagggaaataggccagcctacgcattgtttgtataacaatattgttaatgtttgctgcttataatcgcataaaaggctatttttctcattatctaaaattgatcgttttctcgtcgaaccgcctaatgtaatcaatgtgttgaaactgagcaaaagtgaaatcagtatctaagaaaagggcatga

SEQ ID NO: 23426 - DNA, 1501 bp, Oryza sativa
ttgctacacacattagttccatgtgcagtcctcagtggtcaccagtctttaggcacgttgaagcgtaagctacagttgttttgtgcctgtgtggcccatcagcgccaaatgggcgagcttagcgtgtgtatagaatgctgggttttggctagttggatgcttcgatgcacgctagtctagtgggttcagtagtcaggggccggctccgttgttttgaatcaaacttcttgacaaagctttggtgttcacagctgggattacccatgagtgcagcttttcgtttcatgtttaacgttatttaaatcgctaagcgcacttttaaatttgagaccaataacatggggttaggtactggagtatctttgtgattagtgatgcttttctttcctaaaagatgtggtgtgactaataaaggaagaatggaggaaaatgaattggcaccacttctttttgctaatctttttctttaattctcagtgcggagaaccttgctattttgttctctttagccttttttctttgatagctaatcaactttactatgatcgcttttccatactaccgtatgagagattaagtactcctttgaaaagatgtgctatattttttttatagatttagtgttactagggctgtttgtccatataggccagccagatcaaatacacacaagactagtgcaaacttctaggaaaacaaaacatgatcaccaagaaaaatgttttctaagctatctttttgggattaactaatgggaacaatggggccttacaattgatatggaccttggctagcaatttttattacttccatgtgctttcgataaaacagtacaacaatgtaagctgttttttggggaaaatatatcatacttatttattcagtagttctttcatatacaatttcttcttcagacagaattcccccttgtgtcttcatacctggtgcaaattccaaagttttgtttcatcttgctgactatcctacattcaggggttgctttctgaattgttctttaccaattattatttgatgcccaaataattactgtaagaagtcgctgtctgactgtttcttctataccttctttcagggatgacacagctaagagaaggacccagaaaagcaaaagtttcaaagaggtcgaaaaatttgatgtctttgtcctagagaaaagctctggttgcaagttccggtccttacaacttctgctcttcgcgatcatgtctgctgcatttctgacactattgtacactccatctgtgtacgaccatcaaatgcagtctagttctcggtgagtagacctatcaaaaggaaacttattacaatattctgtcagcagtagaatatccagtggaaactagaacaccaattcctgctcgcatcacagtggttatgttggagttatatataataagaaattgcgcattaccctttttgaccatacctttcatatgctttacaggtttgtcagtgggtggatatgggacaagaccattcc

SEQ ID NO: 23427 - DNA, 1501 bp, Oryza sativa
cacgcatggcgttgaattaggtttgagagaacacgcattggtcacaactttgcatatataggtagagtagcaaaggacaaaaagagaggatggttcaactacatagcgatcaaagacggctgaactgattagaagttaatagtgacaaaagcttatgtaaagtaatcttgggtaggatgagaactctatggcggggaagtttcctaatgaccactgggttaagcttttccaacctagagagagtagagtgttgtttagctctgtctttaggcgtggattcacgcagagagacgctttgccccaatctaatgcctaagcgcgtcaagctgatctcatctacccgtcaacgtgggtcaaaccagacgacttggatgccattttacacaaggttatgtgaacgcccagattctactccgtagcagtagcaccatgctggcatgcttcatgtaaacttgactacatataagctgattagcatgatggccttggctaggaaaccaaataccaaaagacttgaggacagatccgtaactgcagggtttttttactcgttttagaacataaccttgttataaactcatggaaactcgtacaggaagctctctgtggactttaggcactagtatttgagaaggcagctaatgccaagctagccggtgagcagggtttaccattccgacgaaatccggtcggatttcgcaaaatttcgacgtttcgacgagtctcgaaagtagaaatcatctaagatttcgagaagtttcatccaaatttaaatttgaattgataaaaaaaagaaaaaatcaaataaaatcttataaatactatgatattcatagaacctattgggatataaattttcgaaaaaaatgatatattatgtgtatttaaacttacatcagagaagaaaagaataaaaaaataaaaaaaggaaaacacttacatgggccggattaccgatcgaaatttcgatgatttcgatcggaatttcgcctaaaccgaccggttttcaagaatttatcggcaaactcagagaatttgtattcaaattttggtttgtgaaatttattcggaatttaccggttttccaccggatttcacgaaattctgaattccgccagtgcccaaaatggaagtgcatgtcggaatcgtaaaccctgccgtgagtgtttaagaaaagttattaagaacccaatttccagtttctaatttatttattttaattctatcaatatgaggatttttttaattattttttagaattttatttttttaaaattttattaatagacatttctgaaaattatttctaaatctgaaccttttgtcatggcgtggccaaatcactttgtcacgccacgcgtagctggcgtggcagtgttgtcttgccacaccaccgtggcaggcgtggcaaaacaacgctgccacgccaaatattttttggaaattaataaaactttttaaaaataaaaaaaatccactatgagttctaagaatttgcccg

SEQ ID NO: 23428 - DNA, 1501 bp, Oryza sativa
ctcacaccgacggcacgcggcatgatgaggacggaatggtctctcgctcctcgcgcgcgtttggtgcggcgttgccgtcggcgctgtgccgctggcccgtccgtcggtgaatcgtgtggtcgaccggtttccggttgcctccgacggccgatggggtacagtacggccgatcctatgtgagtccggtgaaatcgatcgatgtcaggctttcgtcgtgtggcggcggtagatgttactgccgtacggtggcacagcggaggcggtgtcgtgtttggagaaattgagaatgccacgtcttgtccgaatggaacggggttgcacattacgccgaaaagcgagccaacggatcagatcgagctcggaagagtgcggcaagttgccgccgtgttggtcagccgtcgggctcgtgcattgccaggtggcgctgccgtgcgctcctgcttgccgaaaatgacgaacaacgacggtgattgtgctgcgttagccgttagtcactgaaggacttgttcattttgctactattttcaatcttaataagttttgacattgtcaaattttgataaggttgttaaaattttagtaaggttattaaattttggagattttatatgtgcttactaaaatttagcaacaaaccatatagccacttttttaaaactttgaaaaaaaaagtatttttgaaaatggtagcaaagtaaacaagtcctatttttttttattttaccagaattttgaattcggtctttcaacctaatttgttgggtgaaccgaaggaactacgactccggattttcttttgagcttgccgtacgtttttggttacgtgtgtgtaacaaatgtgatatgcctgtcgcatatggttctcagccagaggccatatttatttttctgcgcggatagctcagatcaacctaactgtaagcgacttgaaccagaacttagaagttcaaacttcaacaacgcgcctaattacgatagttccaacctgctgccccgtgtttgatttgtgaacatgcgtacactcctacctgctgggactgcctgcccgtccagcaacacacacacgctgttgtctctgctaccctgcgtcgtgacagcctaacaggttgactgaaaatccgtatagaaaatgctttttatccgtgctgaaaaaaagagagaaaatccatttgcttcaaagacatgtgctacgtttatgcaagccaaaccatctcttacgataatgttcccccctaattttctccagtaatcagaagataggttgaccggttcatctacttccctcttgcaatagcataagctctttaatggtagtgaagggcagctctttgtagaatcgaagatgatgcaaccattcatggatatgaattaaatattaattattatgaaattaacaaaaagttttttttaaaaaaagctatctatctatgccttttttccccgacaaatcgtatttttaaaaatgtggcacgaataaaccgatgataacatgtccatgtta

SEQ ID NO: 23429 - DNA, 212 bp, Oryza sativa
  unsure (1)..(212): unsure at all n locations
agcaaatgcaacatccncggggncagnnnanngcacgncttcacttcggcaacggcaagcacttcaatcgggatcgagccatgaggggtgaagtagaaaagaaganagattgcgcgnntggccactttcgcgggccactccggcngtcggccacttgcgccgccttcttgngcgctncctcngcccttttgcgccgcccgcaccgccgccca

SEQ ID NO: 23430 - DNA, 500 bp, Oryza sativa
ctattagtttgcatcagaagaacaatcaaaagaagccgattgagtttgttaaatagctccatgtgtttcgaatgcaatgataatggtgtttcactcaacatattgatgtatattgttttatttcaggtatttgttcaatatccataatcagaggaagctgtgccttgagtttgagtatttagcctagtaggtttagaagcactacagaaaagtaatgtcttttatcaggcgagcagacccgtcaaccacttacgcagataatctttacatacataaatttggcactccaaattcaaatttcgctgcacgaagatatgcgtccgacacacagctgttccgttatgggcctgaaccatacaatcctgagaactccttttacaatcaacaggcctcaccaatgccgtacatggtaacagctgatggccattctccatcttctgcagacaattcctgctcagatgtggcaaaagactcaccattggtgtccaatgtatctcagc

SEQ ID NO: 23431 - DNA, 1501 bp, Oryza sativa
atgaggatgcttccatatgcaagctataacctgcaatcactgaaacatttctcaatggtgaccatccatgttgtcatatgcacactcctacagttaccaacaagcacatttaatctaagcggagaggaaaacctgctgaatagctgactccttgcttggtagcttgaggaagcatttggaaaatgtgcagtccaggaacacaaagtctaaacggcaaatgttttctttccctttctttgctatgtacttcagtggcaaattatgtacacaatctggcgtcagccgacagtcccccgtgtgcagaatgctaccgaattgaccctcgaacaagaacataaccgcccctggtatcacagaacacgcaagcattagccgtggtcaacccttcccatttctcaatatacaaattcaataatgttgcgctgaaaatggcctcatagaacgatgaatcactccgcctgaacagcggagcaaaaactacaattcccatggatctgttaaaaaaaatcggccgctgaattgaacaatcactcccaccatcacaccctgatccctgacaactaagtaatctactatttctaccagcaaattatcaacttatatatagcacggtaagctgtaacacgacggtatgcagaactgaagaagcggaaccagaattaccagggcagtgattggcgtcgtacgccgtgacggagaaggccccggcggggtcgtccaccaccaccgtcttccccacctccatctccacgaactccccccgctcaagctgcgacaccacgagcgaccattcgattagcacggcacccaccaccaccacacgggaacagaatcggcttccgcgagtcgggggggcagttttacccggggaaaatggcggagggcgaggtcgagggtgagccgcgtcgcgtagacggcgccggggcattccccggagtcggcggcgccgccggcggcgacgaggtggtcccggtgcgcgtgggtgaggaagcggtggcggcggcggcgggaggaggggccccacgtgtcgacggcgaaggggagccgccgcggcatctctatcggcatcctcccgagaactttccgaaattacagttcagtcctccgctcccctgaacctcgccgcctcgtttggtggggccatcgggttgagttagttgtgcccgtttatatacccgcgggaagtggcgccttccagaggaagaaaggctaacgggctaatggatgataacgggttttatttttttacatccatccatgacccgctaataagtagtaccagtctgattttgatgggcccaagcgttggtatgggccttcacaaaccggtggcttgatacactttcggcccaataacagtacgacaatgcaatgtgagatccataaagatgcagcccaattaaactagattttttttcttctttttatgcatttctgctcggattcttcttcattatgggggcctggggggcatacagtatcgtacggtagaaaaaaaaat

SEQ ID NO: 23432 - DNA, 1123 bp, Oryza sativa
  unsure (1)..(1123): unsure at all n locations
ctgtcatgatgatacgtcancttgtaccccaactcaattcaaacctaccctatcgaatcattcttttacattacttactttcagtcatgtcttttactttatcctagtttcatctatttttctcgattttcatcataaatcgcctgccttcgctacgagagtacgataacctttgtaggtttgtctcgtaaaccttccgattcacccatgagatgggtgattaactccatattgacctaaatcaacctagagaccggtttacatctctaaatcggctccggtagcaggtttaatcttcaaaacccatcttgctttagagttttctatcaagatggttggcgactccattaatgcctcaaatatttagatgagtccgtgttgatcagaaaaagcacctgcagtactatcgtataattatttctagagtgaattgtacattggaccacctattttgacctaagttgcatatctttctgttcaagcaagtacacatacattatctttatctttgattaatctacaatatacatataaattatcattttcaatgaaattcgatgcatataggaaatacatgataaaaacagtatgataacatgacatcatacttcatccacacaccacactgcagattaatttactgaaaaaagtggataaacttttggataaaagtggcacgcttttcaaactgctaaacggtgcatttcgtgcgaaaactttctatatgaaagttgttctaaaatatcatattaatccatttttcaagtttgtaataattaaaactcaattaatcacacgttattacctccttattttgcgtgaaatatttaatctttatattcatctttatgttaaggagatttaaacaccacctaaatgtaccatggtccctctaattttaatgctctgaaaagtataactcaaatttgtgcattcctatgtgatatacattccctaggtccatactccatccacgccacactgctgtgtgtactgtccactgcctacctaccctgtaccagtacatggaccatagctaggacagtatcacagacggtacaactgttttttcatggtgtccgtatgcccttgtccgtttacatacatgcttgtattcatcagg

SEQ ID NO: 23433 - DNA, 219 bp, Oryza sativa
aggattgattgtgatttacttggaccatcctatagtgaccccatcgtcattttgggctggttccgcccctgtctccaagtttctctcaattggtcctattttctggtttcatgtcggttggctaacgaatatcaacctatagcaaaggaaacgtatgtcagttttggtgcgagaaactgataaatcagttctgcacttctgctaaaatcaatcataaga

SEQ ID NO: 23434 - DNA, 1501 bp, Oryza sativa
gcagcagtattatcccaggcggatcctagagtaaaaataacagtgaagaccgaacaaactgacaaagcttttaccattctttctcatgaatacttcctccgttccaaaaaaaaaaaatctacgactagagatttatagtcttagaatatgtcacatccaatactatattggttttttatgaaacggaggaagtatatagaaaaaaatgatagtggggttcgagcctcctccgctcctacggtagatctgtcatttgtctctggttcagcaattaaagttaaacacgaacccggatgatattgtggagttgtgttcaaccgtactggtacatgtacgtgcccgggcaaagcgttccataccccggcaggcttacctgtactcggtaaactgatatactccataatcgatataccagagcttctcatgatctgattagtcatggacgatgcgtgtaatgcatgtgggtcggcattgtccctgcctgaccgacccagatgcgtctcactcgatgccatccttcaatcacctaattaggtgctttcttcgtaaaaaaaaaaccaaccgaattaaagatgaccattttctaatgcaataaatctgtacatatataatttagtcgaggatggaacgttttctatgacaataaatctgtacatcattgtcctataaaatgttctacttcctccgttttacaatgtaagtcattctagcattttctacattcatattgatgttaatgaatctaaatagatatatatgtctagattcattagcaacaatatgaatgtggaaaatgttagaataacttgcattgtgaaacggagggagtatcttaattaggttggttttcttttttttacgaatagagtatgtacaatccaatcattgtcccgagagaagatcagatcgacctttcggcgtgtccgtcgtgtatgccatatatccagtttctcgagttcttgtcacggacttcaaccaattcttcgtatgctcttgagtagagtacaccatacggacagtagtagcgtggttactttcagcaaattcagcttgtgttttgttaggaatggacgacaatggatcgagatactgactcaccagatacagcatacgtacgtttgttgttgttgcatatgcatgcgacgacgatgcgcgcgtccggcaaacggaatcctaaatcacacctactaactttggactgcccacggacaccactcgtatatgaccatatgtgcaaagttgcaaatgcaagcaaacaaagcgaacgatccttgaacggcactgtcccactggctaataaacctacaccttgccacatgctactgaatttctagacttgtagcgactcgaaaaagttggcacaagaagctgcaagaaagcgatcggaattcggaatacagcgtcatctgttcgtctctacctgcctgcctgcattttgctgccatatcattgttgatcacaggagatgataatacaaatgggcaagccctgtttaagttcg

SEQ ID NO: 23435 - DNA, 1501 bp, Oryza sativa
  unsure (1)..(1501): unsure at all n locations
gtaaaaaaagaagataggaactgcaggtggacaacctaggaggacaagagggggaccaagagaggtgggaaagaggagaggaagaggggcggcatcaacacagcggccacgtcgagagagcaacgatgaataagatttaaatgaactggatagaggggtaagaggagtaagatagggacgagttgggatataaggtaatggaggtgaattcntgnaagttgatgtaggaacggtggaggtatgaagtaggagagacgatangggggggcacttacatattttcccccataggatcctaaaaactagggatctttatcttgcagaatacgacgagatggagaagtgccccaactggaaatttgtgtgggagaataaagctcctatgaaagttcagttctttgcctggctcttgactaaagatcgtttcccaataaaacgcaacttgcacaagaaaaccatagtaccggctccgacctgtgaactttgcaactctgctgatgaaacagccctccacctatgcttccagtgccccttcgctgtgaccctctggagcgcgatgaatataccggtcaatgttgcgatgcttgttgagattgcctcaagttcccttgaagcactttagggtgttctacttgctatgcttttggaacatgtggaatcaccgccacggggttgtcttctgacacgaggcttcttctttgcgccgtttactagagcagtgtatcgaggatgccttcctctggggggaaagaatcaaagtagaggagacatgtaatttcgacctggaaagatctcttttcttcctccctccactctctcaatatgtaatgctctagactttgtaaaactgccctttgctccctttttaatgaattcaggtggggaagctctccccccagcgaattttctaaaaaaaaaatgggaaggatgggacatgcctgagtttatttccataaagctggacacaccctgatccaagagtgtcaggaaactcattttagccttggatgctctgcatcaccttcttcaactcgggagttctcaagaaaaattaaagttaggttgtgtttagttcagcgcaaagtttggattttggttgaaattggagatgatgtgactgaaaagttgtgtgtgtatgacacgttgatgtgatggaaaaggactgaagtttggatccaaactttggatctaaacacagccttattgtaattcatcagcgatgttccttaatccgacgtgtcgacaccattgtcaacaaatcttgaaagagaaaattgacatttagccatcctcgggttggggtttcgctagaatgccatccccgaatgtggcttcgttataatgccatcttcaaacgtcaccatcttgccatattgccattcatccaatttcagttatttgcaaatgttaatccgctttgatctgacttttttgcccctattgctatttcgttgacttgctgggagggacagatcgatctccatccagtcgtcttcttcct

SEQ ID NO: 23436 - DNA, 1501 bp, Oryza sativa
tccatctattttcaaatctgaaaaatttagttttaattggcatatttcaatcatatcctcttaacaactttctcggatttaatacgtgtctctccattcttccacacaaaattggctacatggacatcgaaaaatgtaaatattaatgaatcgcttgtttacgagaaataactagtactccctctgttttcaggttataagacgtttaactttagttaaagtcaaactactctaaatttaactaactttgtagaaataagtagtaatatttacaacaccagcatagttttcttaaatatataattgaataaattttcataatatatttgtcttgagttaaaaatattactattttttctacaaaataagtcaaactcaaagcactttggctttgaccaaagtcaagacatcttataacttgaaatggagggagtagcatatttaaatggatgataagtagaattacttatccttagtcagtgtgccaagatgaaatatgactatcaaaaatagatgaagagagtataatttagacagaagcatagccagatttatattttgtgggacggataaagtacatgtcaataagaaaatgtgaataaggaaaagaaccaaccaagaagtaaaaaaaaatagacaaaatttgctacaggacatccaaaaaagtgtaattagttggggacaccataaaaacgcgtatctgctttagggcatggcaaaaaaccggtaattaggtgttggacacttgcggtattattttattattttcgaagtaataggagaaagaaataaccattaaagttaagtttgcccttggtcgaacttacttcaacccgacttggtacggttcaaaccagccactaggcctcttgcagtaaatcgatccccatcgcaaacctgtaaaattgacacggcaatgtttgcactagatcttccagagatgacatggttgcatgaattgctgaaatttcatagtaaagaaaacatacccatcttgagtgtcactcttgcaggttgctcgcttcctaccaatggaaatacaatccaagcttatgccacggcaatatcaagattggtggatcacattattgagcactacacatgccctctatgatcaacaaagagaactacattagtggggcaaatggttactgaagtgtataatgatgctacgatttctttcagaaggataatgttgctacatttattagaggaggtgcacaaggctgtactgatggtggagttgaatacaatcggtgcaaactttcaaaattcactatagtttgttcacttgaattcgattcagccaaggacattgatctattgttgatgtaattggtagaagcatggatggtcatggtctacaaagtctggttatctgaagctaatacacaaaatggtatagctgctatacttgaggccatcctggagggtgtaacacccaggtattctcttacctagggcctgtttggtgcagctcccactcctagattcgcctcag

SEQ ID NO: 23437 - DNA, 1501 bp, Oryza sativa
tctttgtgtttatctccattgagccatagagagaaaagctgagtgcgcgtgcgtcgccattgtcgtgtccactacaatttgccacttgtgcgtgtgtgccatcgcttgagttcgctgctcgcgtaagtttgctgctccgcgagttctttgcatccttggccaaagctaacaaggattgctcaatctggttttgccgtcttctgaaacagcgcggagcctaagtcaggactagtcatactgacatgccaagagaagactgaagcgaatcatgcatgaagcgaagcaatcgctgatcctgacattgtccctgccggcagaacatgttctctgatacctcctatgtctatttcaatcgagaaaggaaggcagagaggtaaaagaagtgaattaaaaaggtactctgttcctcactttctccttctgccattcccataagaatcaccaaataacatggaattcaggcagtgttggttactctctgtcaatgaccatatatatggtccatatgtataaatactcggcaatcaacatgaactggacaaggactgagtcattgtttttagcccttaacatttacttctacaacttaaggtaccatcttttgccataacgaagaacttaagactccattttaaaggaagatcaaggggcaagacattgaaccttttgtgtggggttatatttcatctcattggcagaatatttttttcctttgtttttacataattcagaagaagagtgccatgtgctcaaggaaatataagtccaatagtagttcaattggttagcttttcagtaatatttattctgctttttgatatttgagagatacccatggataatgcttgctgcctccttcttgaacataaattctagtgtatatatatatatatatatatatatatatatatatatatatatatatatatatatatatatatatatatataaatgttagagatcgtgctaaaatcaggccctgtcagtaaccattccatcggacgttgaacctcctgtgtacatcaagtgactgtagggtttttgttgctatagctggtatagtctattgtttccatcacaacactgcttagagatcacactatgtttcagttcagaacccgatatgtccttgtgggtgaaaatgaggcattttactgtgttccatcctactattcaggccttcttttatttcataaaaatagtttgtccttcaattgatacatcatagcaaaaaacacttcataactagaagataccccgcgcgttgctacgggatatgagtgcaaaaagtaataccgaactatgtaatttcgaaaagggtgataatatgaacaaacacattctgaaaatatgggaaatctcttatatgtttttgtaatcgaggagtactgatattatagaattgtagtacagataatgctatagctgcaagatggagaacagaatgggaccctaataaaatatagcaagtcttatgcatatgacataatgaagtcttcat

SEQ ID NO: 23438 - DNA, 272 bp, Oryza sativa
tgtatatgtgttgcagcacaactagcaactgaaagtctagggaataagaggattaggtggtgtttgtatccacggacttaactttagtctctgtatttagacactaatttagagcattaaatatagactacttacaaaactaattatataaatgaaaggtaatttgcgagacaaattttttaagcctaattaatccatgattagcctagcatcacataggctaatcatggattaattagactcaataattcgtctcgcgaattagtccaaga

SEQ ID NO: 23439 - DNA, 1501 bp, Oryza sativa
accaaatacgttttattctctgaaattgggttccatttctagtaaaatctttctctgatcttgacatgagggggatgggaagtagcttcctcgcgccgtgcaccactctgaatcgccgccgtgcgttgccgctgtgtgccggcgtcctcttctgcagcaagatctgctggaggtcaagaacccatggacaagagagagaacagacatgaggggagaagagaaaggagaggaaaggagaggggaaggaacctgcactgccgccgccaccagtgcgccacctctaccgatgcgccgctttttttcacccgcacggtccgctctcttcacggatgcgcgagtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgagtgaacacggtagggctcacctaaccgcatttattgcggtctggtcaagcgtgtcacgctgcatgcagcgcaatgcagcgcgctcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgccgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaacctccgtccataaagagaagaaaagtgcagtttggaagggagaggggacatgtggtatccccttaagatataaaaggaggaccatgcccacaaagaggggggattttttttccagattgagagcctagaacaagggataagtcggctcacactttgtagctcctccacagacaaatccaccaaaacacaggagtagggtattacgcttcccagcggcccgaacctgtatacatcgccggtgtctcgcgtttcttcctggcacgcaatctgtccacacacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaa

SEQ ID NO: 23440 - DNA, 1501 bp, Oryza sativa
ggaagcgagcaacctgcaagagtgacactcaagatgggtatgttttctttactatgaaatttcagcaattcatgcaaccatgtcatctctggaagatctagtgcaaacattgccgtgtcaattttacaggtttgcgatggggatcgatttactgcaagaggcctagtggctggtttgaaccgtaccaagtcgggttgaagtaagttcgaccaagggcaaacttaactttaatggttatttctttctcctattacttcgaaaataataaaataataccgcaagtgtccaacacctaattaccggttttttgccatgccctaaagcagatacgcgtttttatggtgtccccaactaattacacttttttggatgtcctgtagcaaattttgtctatttttttttacttcttggttggttcttttccttattcacattttcttattgacatgtactttatccgtcccacaaaatataaatctggctatgcttctgtctaaattatactctcttcatctatttttgatagtcatatttcatcttggcacactgactaaggataagtaattctacttatcatccatttaaatatgctactccctccatttcaagttataagatgtcttgactttggtcaaagccaaagtgctttgagtttgacttattttgtagaaaaaatagtaatatttttaactcaagacaaatatattatgaaaatttattcaattatatatttaagaaaactatgctggtgttgtaaatattactacttatttctacaaagttagttaaatttagagtagtttgactttaactaaagttaaacgtcttataacctgaaaacagagggagtactagttatttctcgtaaacaagcgattcattaatatttacatttttcgatgtccatgtagccaattttgtgtggaagaatggagagacacgtattaaatccgagaaagttgttaagaggatatgattgaaatatgccaattaaaactaaatttttcagatttgaaaatagatggagggagtagggttttttttcctgacggagtgcgaagaaaatggttgacattgtctacgaaaaaattattgttcaattaatatccaactataaagctgcccataacaccatattgattcctcgtctaaaaaaagcattaagaaaataataaagaaataaaaaccaaatatactccctccatacttttgatagtcatatttcgaaatctgaaaaacaatttgtttttgataggcatatttcaattcaacaacctatcatcttacatcttaatgattttctcgaatttaatgcatgaccttctattcttccacacgagattgactacatgggcatcgagaaatgtaaacattaatgaatcgcttgtttacgaggaatgactttaaatagatgataagtagaattacttatcgttgatctatgtgtcaaaataaaatattattatcaaaagtagatggaaggagtacctcggaagcctag

SEQ ID NO: 23441 - DNA, 1501 bp, Oryza sativa
cacacgcatcgactcccctctcttgcatcgctcctcccctctctcgcatctcacgccgccgcacccccccccgcatccccgccgcaccgcatccacgccacatcccgcttcgcctcctcctcttgcgccactctacaccacggttccgcttcacctccccttctatgccttgccacgtcgcacgcgaggtccgcttccccccttcccccctcagcgccacccagccctcgcttctgcgacccacaccgccccaacgacagttgcctctccttctcccgcgccgttccgattccatatccgagagaagcgaaacgaccgccgcccactaaaaccagacttcatcagcgtcatcaagacattaattttgtttgctcataatgccatggcgatatcgttgcggcccttcgcttatattgccaatgaaattctgcaatctacctccaccaactgcttcgtttcatctgaatctccattgcataggtacatattattggatttattcggagtacaatgatcttctgataggttttttcatcagtttgaatctttcatgtctacagaagggcatttgtttatgtggtaccgacggccttccttttgaatttgttctgtggctcctgtggattttcattcaggaaagataaatctggtacgtgccttttctcccttatgctttcacccggcttttgtttctttctactcttgatgatgaatgctcaatttgacctattatctttttgtaagttcaacaattgtttacaagataagttcagtttgattttattcggttatagacacctatttatttcgacttataggattcgttggtttatgctctcgggtagaatggataatacgataggttcttctcaaccaattatacgtcgtcgtggtcgaccacgccggcagccttctaatatcccgatcccacatcctaatcaaactgttgctgctgaatctcgacgtaggcgtaggcaagttatcgatgcaaataggaacagaggtttgttagaagattaacattcctacaagttgtcagtattttatgcagacaaaaaaaatgactcacattatcaatttcatcatttttccctagcatcaacctctgcagatcaacgaatattatgcccacggttaattggtgaatcttctaattctaatcatatagcacaaaatgaaccccctattcatattggttcatctacatccaatcaatcattcaatcacaggcgtaagttgtcttttctactcctaggatctaaccactttaaggtatccatttgctgtaaagattccttcacatataccatgacacacctttcaggcactatatttgaaccattgaatcttggtggtccacatcattcttgcagccactgtggtgcttttttttggtatgaggagtgaacacgtagagagagacatacttcaaatccatcaaataatttgtgttgcaaaggtgggagaatatggctgccaccctatcaacctcctccacagc

SEQ ID NO: 23442 - DNA, 1501 bp, Oryza sativa
tcttcagatcagcaatgtccttcatcccagccagctccaacctcacttcgttcatctcctccatacctaccagcgacccgtgcgatcgagtcttgtttaccatacataaagtttccttcgatctgtgaggacagctcaggatttctccctccctgtattgcctcatagaactggtctaccgccgcccgtctcgaggatttggatccggggattttacagcctcctgccaacccttctccaaagatcgagacccttcttcgcctccagatcgaattcttccggcgtcgggattttacggcagcaaatccacagatcgccaccaacctgcgccttccaaatttgagagccagggaaagagctgagctctgatacctttgtcaagatcggagacagattttactagaaatggaacccaattttagagaataaaacgtatttggtgtgcgccgcaaggacctaaactagggttcctaaatctagattacttcctaagataagataattgcgagttttgatatctctttcattctcagatgcaattcgtttttatacaaagtgaggtagtcttagctctcaagcatcagacagctcaaaagtaggaaaaagacaaaagaatgaccagaacagtggtccccgacatcgattaatggctaggatttcgtgatatcgcttcgcttggtttgtttgttgttggatcttcataatcctcccgaaagtctacatctcctcctcaaatcttcagataactcaaacattcaaaaagttcagagtattcagagtttcagtttgttgcatctcatttccaggctgagtcctgacacctcagccccacacggtatcccctcctcaaaccctagaaatcctttccaaacctttccttcaaatgtgcatgttttctgtgagatggatttatgcatgttttctgtgagacagttttatgcataatttttgtgagatggatttatcttttgggttgatgattgcttcgtaaccgctcaatcttgtgttacatggacttgtagactctgatctactggataaatatgttcatatgttctatatttctcttgcagtgtgagaggataatgtaggtacctatattggtttgtatgcttgatttattacaagctgttccttggttctatgactttcagattgatgcatataattgtactaagggaaaaaaggtgtccacttcagggttcattcatatataatttggccaaaagttcttggtgtataaatgtagtataacctggcttgaacatattatgtgaaactatactagtaattctgaacattgacctaaatttttgaaactatggtgtgaatggatggcaggcatggctcaaaatgtgctatcgaagagtgttaaaatgccaattgactctgttgattggaatgactacaacactagagttgtgtgtgagatttttgctgatcaagtagttgtgggtaatcgtccaaatacccatttatccaattctaggtatgacgaagt

SEQ ID NO: 23443 - DNA, 1501 bp, Oryza sativa
tcgttgctgattctatgggagaaacacaggaaacttcctatctagtctgagctcatttttcacttgctttgcgtaggatcgaggcaatcaagctcctaatctctttcttcagagcaggagaacaagcaatgaatggataaaatttgtgttggatgcagtgtatttattagaaatggaaaatgggcctaagttcttaagtaaatatttctgtgtttttcctatacccaattcaaacgcattgtttacattcctctattttacacgtgaattcctattctatttttgtgttttttctattcctgtattttttcaatccaatgtttcaaagagaccctaaattaattaacagatggattctccagactaattaagcttctcctcaacgaaatatacaaattcactagggtggaatttagtatatctgggcctttcgtgttaactagattaaaggtcaaattacactagtccatttttgttaacaacctccttcactgaattcaaaacaatgatagttctcaatacaacttggaagtgtttaggcctgtttggggagtttctaatagctgcagcttctcctagaatctccagttgccagaagctcccccaaacagttcaagtttttactcagattctgagaatctgtagttgtaaaatctggaaaatgaactagaagtcacctaacttctcagtagctacttctcagaatcttaagttctcccaaacaggccttttagctaggacgaggtagaataaaggtgtggatacaagctactaaaaagagactagagtgttctgaaagctccagtagaggaactagcaagagaggaagatcgacgaggttcagactgaaccaggtcaccactacccactgctgccgtggccgaagccgccgatgcttgtttgattcgttcgatgccttccaatcaacgttgctgctattttttatctcccttcaaggatttttgggccgggcttggaatatggctaacatagcccatgtgtggttcaattgagtttctaacaatcctctctttttaaaatttggcttgtccacaagccgatgcaaataattgccaatgccatcaggatcccatgctatttgaagttatttggtagaagtagtgaacctgtcatcagtaataagattcaaagtctagggcatcattgcatggagtagattcactgcactatttctcttcttgtagtcactcagaccctctgtaataccccgtatattaaaagatattttgaatttttttagtttgggttgacttgttaaaatagagatgttaacataaataaataaaagaaaaatatctttagaagtgggccaacatgagaaggcccataaacccaacccattagttctctcctacaacctagagagaggggaaccgaatcccacctcccctcttggtgccaccatccctctccttggccggcctccaaggacgcctccttcctcccctcctcctatgtttgcatctctcccctctacagc

SEQ ID NO: 23444 - DNA, 1501 bp, Oryza sativa
gccggtcgcctccacgagccgcttgcgttggtcgatccgcttgaagccaccgccgccgccggacgcctctgcgccactgccgccggccgcctccacttgtcttgcagctggagagtgagcgcttcgaagttggaatggatagtgtgctgctgggagcttacgagctagggtttgcagcactttacccacctctcgactctggtctagttgggccggtttcctcttgggccagaccggccgcgttttacaatttagctacgctaaattacggccagtttagcggctattgccggctaaattgcgctattagcgtcccgctattcttagcgctaaaaactgcatctcttagctccgtccgttcccagcagctatctccggctatagcggcagctatagccggagatttaaaactttgattatatggatggatagcgctatgggaatgatgttattattagtttaatctataattgcatgtcgtggatgttcgtatttataagagagactctttcaaaatttttaatgagtttaggacttagtggtttctgtaccgtagtgtgtagcattctaggggcctgtttggtagggctccaactacaaactcctagctctgaactccaactccagttggagctagcccctattggagctggaggtacccctgaaagtgataattaccttggggaggatggggaaagatatttatatcggttcgcaatgcattaaataacacggttgtgtcatgcattgatccaggttgtccaatagatgcatagataaatctcatatcatgatcacaaatagccatcacattttgagtggttgatttagatctaccaatatatctgatcttctcttcatctggaacaactgcaaggatatgagtaccatcaactgtcccaatgcaatctttgaaatgtggccacatacgacgatccttcctaattctatcatggacagtaggaaagtttggatcctttggatgcacaatatcatgtcccaactccacaacagcaaacaatacttcttcaaattttcttgatattgtctcaccagaatgcttaaaacgattttgtgccctttggtttgatgaaccgtcacctagaatgtacagaaaaattgcaagtgcctccattgtgtgcatgtgtacagtaggtgccctttgcagcaaattgctcaataacttcgtcatacctagaattggataaatgggtatttggacgattacccacaactacttgatcagcaaaaatctcacacacaactctagtgttgtagtcattccaatcaacagagtcaattggcattttaacactcttcgatagcacattttgagccatgcctgccatccattcacaccatagtttcaaaaatttaggtcaatgttcagaattactagtatagtttcacataatatgttcaagccaggttatactacatttatacaccaagaacttttggccaaattatatatgaatgaaccctgaagtggacacctttt

SEQ ID NO: 23445 - DNA, 1501 bp, Oryza sativa
tgctcataagcatcgtctatgtagatgttttcaacataaaagtacccatggatctggttgagccaacaaatgaaagaataacatcgctacaaacaaatgctactaatcactaatcagccggtcagaatcgcacaatatatatgcatgatgttatataacaaaggcactgttgatccaacaaaacctggaaatagtagcacccaaggaggaaggtggtgatcttaaatcaatggacaataatgaatatctgaatcttctcattcggttattagtttcgacattgttggttgctctttgatgttcttgcatatttaactcaagaaagggtaaactcaagaccaaattcatgtagatgtaggcaaatattcatgttcaatctgttgaagcatataattgcagttctgaacatctcttggctagaaagctgcggctggactgcaattccgctggcagaggagaggactacaagtgcagcaatatgttgtgtgcaattgtgcatgagtgcacaagttgaaaaaaggtaatattatttcattccgaaaagatagaacaaccgtgaaaataacgttcaaaccagtcagttcagaggagaatacggtgatggacagaaggccagaaaacaacccaatggtgagaatcgatcatttttctagacaatgaatggtgagcaattgatcttggtgaagctgaaccagataagttgacagcgttactgttagtggtgatcagcccagccatccgtaaatcctttcttgcattttgcccaatacaagtcagcaagtcaagatgttcttatcgtttcagactaagtggacactggaatctgttcttttcacatccacactgggacacatacagaaaagctaaatggacataccacctaacagcaatatctcttgtcttccactctttgtcactgcataagagccagcccatctggatgatccacgcaatcaccggggaacttgctcgtcatcttcctcgcaataggcgatcgatttgccggcttgccatggctgcacgcaccaaaggcctcgctctggggtgagtctttctttcaattcctcgcaacatagcatgtgcttgcttggttgttgggtctgatggaaatgtcgtcttgcgatgcagcagacgcgccccatgccgctgctgttcccattgatctaggatcactccggtctttcctttcatgctgagcaagttcgccttctgtacttgagtaaaacccctcaactttgttgccagatatttctttctggttgcccgtttacccaagaagctatagaaaaaggtaacctcattatttcattttttcagattcagtgatccagtatggtcttgtggcaaaacacatgcaaaataacatactagctagatatgtgctcctctcttacaaatatactctactttatgagtcaggctgtgtttagttcagtgcaaagtttggattttggttgaaattggagatgatgtgactgaaaagttgtgtgtgtatgacatg

SEQ ID NO: 23446 - DNA, 1501 bp, Oryza sativa
ttactaaaatgttgacaccaatccaaacaaatggtggatactatttatgctaccaaaatattggtatggcaaattttggtagcaattcaaaactgccctaagttggtattataagtgttgctatgtctttttatatatacattctgaaacggagagaggactagcctagaatgacataacgtaatcgcgtgaatgatacagacctgacggttatctttgctctcgaagtcgaagtgtttaatttgaaggggtgacagatgaagaaagcaagcaaaattagccagggcctggctatgaaaaaaaatcatgggtcaaaccgtcaaagcccactagctttttcagagttaaccagcctggtcaagcccaatagacccactgcagcagtgggcctagttatgtctatgtgggccttttcccccctacaaaatgttctatctttcagaaggaacacactgcataatttgttcaacagaggatacaaggtgaattttaagtgttagcaccaaccataatttgttgagaatagctaacagtaattcagttactaccctaatactcttaagataactaacagtttcatcgtttggcttatgctcatacatgcttatctgtattgcttattaaaaaaataatttacagataaaactcgtatatgcatgtatttaacaattcaaaagcaaatgttatagagtaaactacaataaaaaaaactcacaaaatcaactgtaaaataaaattttaaaatttaaatttcactagcttatactccctccgttctaaaaaaaaaatacaaaccctgggtttccgtgtccaacgtttgacttcccgtcttatataattttttttataattagtatttttattgttgttagatgataaaacatgattaatattttatgcgtgacttgtctttttaatttttttccatattttttttaaataagacggatggtcaaacgttagacacgtaaattcaggatttgtctttttttttttaaagatggagggagtaagtataagcataacaaaacgacaagactgtaaataggtaatgctctctgcataagcttgagctgcaatcccacaggaaacacctcatgacggagcagtcaccagtcagctggaatactaaattaagcctccaaagccgcgtcaaacagacgaggaaacaccgtttcgtcagttaagttcaggccccaacagaaacaccgagagaaacacgcggcccaaacggccggcatccccctcaaccgctcgtccgcgcccatcaaccgccaaagacttcccgcgcgcgtctacatatttcttcctctccctccgtctcctcctactctcaaaggcctcgttcgtttaatccctctcacggagagaattgaaggggatttggaggggatttatttcacacctatcgtggtgtgaaattattcctcttcaatcccctccaatccctctgtattgggattaatcgaacaagccctaattcgtgagaagctctgatcga

SEQ ID NO: 23447 - DNA, 1501 bp, Oryza sativa
gccgaccccatcttgccaagcgctggcctcgccatcgtcgactcctcactccggggaccgtctggccccatccctgcacaagatgctcctcatgtggaacgcggcgaggcccgtgtccacgcctttcttgagtagcatggtggtgacgcacaggatgcgctcacacttgcctgacatgtcccagccatggaacctcagaatggcgatgtcctcctcggcgtccagtgaccttatgtactccaccatctcctcgctgaatggctgcctacactgcggccagcagagccactcgaatgtgcaatcctcaaactgcacatgcgtgatcgatgcatgatcaccaacgaacaaaatggaaatcaattagctagaagaaaatctatcagcgtcagtgcttacactctcaggaagacagtatccattgtcgattgtaaccagggagaggccatggccttgttcgtctctgcaggtgaggatgttgccagcgtgcatgtcggcgttggccagcctgatgtccagcacgcaggtcccatctcgccgagcgctggcctcactatcgtcgactcctccactccggggactgccgccaccgccggaggaggggtggcgaccacctcttcatcacgccgaggtccacggccatcgcctcgaaggacgagctccccccgcagcctcagcctcagccccgtcgcagcaccgactgcccagcctcatccgctcccttgtctccatcatcaccgtcgccatcgaccgggtggacgagctccctgcaccaactccgtccaccacaccggcggtgctgccgctccagaacccatatcacctccagcccaccgccgccgccgccgctccagctagcttgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacaattggtatcagagccaatttatgcccaagatcctgcgcttcaacaagatggccatcgtcgagcactccgcatcgcgatcga

SEQ ID NO: 23448 - DNA, 1501 bp, Oryza sativa
cctgccggtctccaatctccaggaatgattccgacgtgccgcacaatacgacgctcctgcctgcggtaggcgaggcgatattccgaattcccggtcgagttagttaaagctgtatgcaggaagcaacacatgattgcatctatcaggtgttgctgtgtgtgtggtgtgactggtgaggtgtggtgtggttttcctaaggaaaagacgccgctgggatacagatcgatcgatcgatccgatcgacgcggggtttgttagctgagcaacctgagctcgcggacagggactgacccgtaaaagcaaagcaagctaagtttcgctagctcggatcgatcctctttgcgctgtggtgatcgagtctggtgactagcccttccaggtcagtgacagaggccaggcgcacctcacctcagtccggtgcaggggctcctcgtgtagggtggtcccaccatggttcattagttgttaagcaagtagtaataactaatctgatagtcacttatctgtctgtcttgtgccactagtgaccaccgacgtagctgcaattggtccatggaccttccctgcgtggatataatcatatatatgaacgtgtttaatggctttctgtttttttttcttttgtgaacggctttctgaataatggctttttgtaagcaaagaatatgggcgcatatctaccagctcagtgtaaccgctaattactccatataactgtacaaggaagagggccttttgtaccgttgtaccgagtacttcgcttgtaggagtacgattagttgccacgatagagcgttcctgagtcaactgaggtgtggacttgtcatctttgtcgacgtgacgacacgagacacaaaagtactacctccgccctaaaataattacaattctatattgtttagcatatattaaggtttgagaaaaaagactatggtgctcctcattaaaagatgtttatgtgagagtggaaagatggttgagggtataatagagagaaatttgaatgagagatgattgatggggcaattagtactctaaaattacaattattttgggacaaagtttaaatcatggaaatacaattattttgagacgaaaatagtagccaggtaggcatgttggtccgcatcaagggaatcgatgaagtatagttgaaggaattaatgttagagcgtacttcccgtacgtgatcttggcaggattaacgtttccagaatcagatgggaattggtaccaaatatcctgatctgaaaatgttccgcgcgtcgaattccacaacaggacaatactagacgagcgccgcatacacacagacacactactctgcctttctacacatacaccggacatctttctgaaatctaaactgtagtttctgcaaattaagcatgcattgcatgtgctttagcaaaaaccaaacggctctccgccatgccagataagcaaagcttgaggttgaggttgaacatacagtttacatagttataaaaattcaaaaaat

SEQ ID NO: 23449 - DNA, 320 bp, Oryza sativa
  unsure (1)..(320): unsure at all n locations
ggtatactaaactccataggcatgtcatcccatgaggtgggcttttgtgatttttcaaagaagtaatcttcgagtgggctagggcccattcattanttccaacacaagcctcgaagtcgatactaggtacagaatggcaaatattctccaagattcttgcttaaatttcagctaataaccacgtgcacaaggccaaggcaaggtacatttgcagaggcttgcagccaatacaagcttattggattattaagaccagaaagggcatgtcatagtgtcggactgtatcgtgtcagaattcgtctggtgtcctcgtcaacagt

SEQ ID NO: 23450 - DNA, 1501 bp, Oryza sativa
ggatttccaatgtgttttccttttccccttttctacaccccaccaaaaattccgtgttaacttggttaactcctcacatactgactccggtaggttaaagatgcccatcacatataccggaatagtctggataacggattttataagcacctccttcccgccactcgacagcaggttttcgccccagataataagccttttccagattctttcctgtaaactttggaatttccctttgcacattcttccttcaggggttgggaagcccaagtatctgtcctcaaaaccagagttagctatttgcaaggtcactctaataacatcccgagtctgcggcggagaggattccccaaacatgattgagcactttgccgggtttatgagttggcctgttgccaaagcataatcagtaatgacctctttgacagcctgggcttgaacgttatcagctttgaaaaacaaaagcgtgtcatcagcaaaaagcaggtgtgaaatccccggggcctgcctacaaatcttcactggcgagagagctccctgagccactttgtcttccaacagcaatggtagtccatcggctatgaacagaaacagaaagggggataacgggactccctgacaaagaccgcgtgatggagcaaaagtagagagcagagttccattgaatttaacagagtatctcaccgtggttatacaaactattatccatctaacccagcgatgagcgaaacccagcttatacctccaaaaaaccccagtccacccgatcataagcctttgaaatatcaagcttataagcacaagcagcgttctcaggctttctattcttttgtatggagtgaaaacattcaaaagccaaaatcgcattatctgtgatcatccgacccggaacaaacgcactttggcaaggcgaaactaactcatccaggataggtctcagtctattgacgagacatttcgatacaactttgtaaatgacgttacaaagactaatgggacgaaaatcccgaagttccataggttgctcaattttcgggataagcacgaaagtactgcgcatattcagtgatagtagctttcaaacattctcagaagtcaatactatgtttacttaataatgttacaactcgtaagtacgaatagtaaatgtttctttatcaatgtatgcattgcacttcttaatattaactctattgttttgtttaggcaaaggtttgagagatatgtgcagcttcctgatttttcatgtcggagagcattgattgaggataaagttagaagatttgtggtatgtgtcttgagtaatcatgttctagtgctataatatataattgactcattattttaattcacatcgtatattttggttgtcttcttcaaaggtaccaaccaatgttaacctggatgaaattgcttaaaaaacatacggttgtagtagaggtgcccgactgagtttggagagaaggggattgggaagatacgtaaaacaaggtgagccatt

SEQ ID NO: 23451 - DNA, 1501 bp, Oryza sativa
aaaagttaacggtatcgattcctacatcctttggtcaatgtaagtcaaaagtctacaggaaccctagaggcataagcctcaatccctctcacatcaggtcccacctgtcagcccgaaatgaatattcctttggaatatttattttccaaatccaaaaatcatttctgttgttcctcaaaataaattaatctctagaaattcatatacgtagctccgattgacttcattccacttccagtaatcctctaaaatcgtgattaggggtgaaaatggtggcggaaattccttatcgaccgagcgccgtttccgtatatgagtaccgtttccgaccgtaaccttttttggctatttttaaatttttttttttcacaattcttttttcatcgtattaatatcgataatgagtagtttaaatgataaatatgatcaattaccggccgatcgagcatcatttctgaagagatgctactgattccgatcgtttccgaccattttcacccctaatcgtgatctatctattggcactattattagtcctaaataaggtcttcttattggtctttgtgtatgattttgaatattttcactactttatcggaattatgttcgagtgcagatttcgagaagtgtcgtgaacaccttgagcaagaaaagtcacccttgaggccttgaccatattgctcttataatttaaatcttgattgttttgcttgcaaagttgcattaagtacacataaattgctttggtcttagtttgcgtgccaaaccgacggacctacctagtagtttcactacttgtaggtcaacataccgggtatgaattactccatggctattaaaataactatagatgatttggagcctgtagttggctatactattcaaattgctctaacctagagaccaagaaacaattcttatcatctcatagtttggatcatcctaataaatgtaatgcatgcattaaatagaattagagatctcgagggtagatgattttaaaaaaatgagtaataatttaatggagaagaggtcttagttaattgtatgcatgcatgcatgcatgccttatactcattcctttcaaaaaaagttacacctattacttttgtcaccaagatcaatgagaaattaactcatcttgcatgtaataaagatcaaagaatgaatacaaacatggaaccaatgaatatttacatggcttgttgggttttaatcaaacatataatttacctctcaatttaaggctgagttcttctctctactttcccaactcaccttcatcgttttccgtgcgcacgttttttaatctgttaaacattacatttttttcgaaaaaaactatatgaaagttactttagaaaatcatatcaatcgatttttcaaatttattttagctaatacttaatcaatcatgcactaaatgctgcttcgttttgcgtgctaggcaacttgggttcctaaccctcactcccgaacacaccctaagtcttggatgtat

SEQ ID NO: 23452 - DNA, 1501 bp, Oryza sativa
ctccgggcgcgccgctggagcggcgcaatccggcgacggaggtagtcgccgtacaccatggcccctgtgagcccctgggagcgcaggcccgccaggcggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcggttcagcaccggcccccgcggctggaagtagcaaccaccaaccaccgacggtggcgacaccgactgcacggtgaagaaccaccggaacagccgaagagatgggcgcaccccaatgaacatctcgcacaggtgcgcgaagatggccaatgtcatcaccgcattgggggtgaggtgcgccatctggagatcgtagaactccagaacgtccataaagaagcaagaaaatggcggaaccagccccgccattgcgaaggggaggaagaagacggaccgccccgggtagtctggtgccgggcgtcccccgcccagcatcactatctcccgaccggtggcggattccggcatgaagcggcgcggcagcccggcgtgcctctcgctcacgatgcgggaaggcggtagaacgctaccatcgagcagagcggagccccgtgccatggcgccggaggaagaggtgattgaaagcgagcgcgtgtggcgaaggtagggcgcagcagagaaagagggagggctcaagcggcgaaggcaagagggataatggcgaaaggaagggagcaaaacttttcctcggtgtttttatacccttgccatcgctgggcccggctcctcgtttctcgcgcccactatctcgctccctcgtttctcactatctcgctccctcgtttctcgtgccctcgcttccactaatcccattcgcccgcttgcggcgcatgaggtggatatgcggttgtggcagtcgagatagatcgtatcgtgcgcgcgttaattacgctcgccggccgaagcgacgttaccatatctccaggcgaagcaaatcagctcacccagattcgtgcgctgcttaagtgatgtggcagtcttgaagagaccgcccattatggacagccaagttaccatatgtgcatggtttgagaccgttgggtttctgcgcaaccatggaaaccggtcccacctgtcaccaggctttaggagtggcattacgcccgaccgcttcccttgagaagggcgatcgccctggcataacgccgggggctactgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcgggttgctcctgccccggccccgagggccgaggcaccccgaccccttgagggagttt

SEQ ID NO: 23453 - DNA, 259 bp, Oryza sativa
acttggtccagccaagccatgcgcgtcctcgtcgtgtctgcttccccaaccaccaccgtataaaggccgcgccaccgtgaccgcgtcggcgtcgccgccgccaccgccgcccgccacctcgccgccgaccagacgagccgccgtttgacccaacaccgagctcccgcgcggagttgatgtccatctccccttccgaatccaccagaggatcccagccgctcgcgccgcgcccttccaaccctagccccggaccccgcca

SEQ ID NO: 23454 - DNA, 1501 bp, Oryza sativa
ttagtaaatttatgcacctaaagtttgtacacttcaagtttacacatctaaagtttacaggcccttaaatcaaaagtttatatatctgatttaaatttaaatttaaatccaaatattttttatatatagtatttctatacatctaaagtttatacacctaaagtttatagacccaagtttataagtcaaaagtttatatacccgattcaaatttgaattgtatcggattcaaatttgaatttgaatttgaatttaaatattttttatatatagtatttctatacatctaaagtttatagacccaaagtttataagtcaaaagtttaaatacccgattcaaatttgaatttgaattatatcctgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcgggttgctcctgccccggccccgagggccgaggcaccccgaccccttgagggagtttgcgccacatatatgggataggtgaacacgacagtgctcacctaaccgcatttattgtggtctggtcaagcgtgtcacactgcatgcagcgcagtgcagcgcgttcttttatccggtctgtgactggtcacagaccggtcagatcacgggttaggtggcgactggcggtctgacgcacgccttgccccatcccgtcaagacgaaagcctctaggcacttgtctcaagccggagctagcgggttatctcttagagatggcacgttagccctggttagatttataccaggcttcatcccaaccattacatgcaagatgttacatgaagaagggcaaacatgcacgttgctaagctgacgcgtggtagacaaggatgactgatctgtgaccggtctgacactggtcgcgtcatccacagacagccataatcccacgtcgcacctgtttccggcggaagtgggggtaggtatgggccgtctcgtcagaagggcactcggacagcaatcgtaccgatctccgtccatttatgaagagaagaacagtccggtttggaaagggaaaggtgcatgtggtatccccttgagatataaaaggaggaccttgcccacctagggaggggactgagggctggatgacactttgtaacttgtccatacacagatccacaaaaacacaggagtagggtattacgcttcccagcggcccgaacctgtatacattgcccgtgtctcgcgtttcttcctggctcgcgatctttctacatacagcgagagcttgggatttcaccctaagcccccggacgaactggcaaaggggggcctgcgcagtctcccggtgaggagccacgagctccgtcatctggcgcgccaggtagggggctcagcgtgtgttttctgagctctcatactcttccgtgtgcgccaagtttcccttgttcagcctaa

SEQ ID NO: 23455 - DNA, 785 bp, Oryza sativa
ttttttaaagttaaaatttaattaatgggtattgttttttctaatactgattgtaatcttataattttcttgttatactaatatatcgccctatatagtaccggttctttttcgataagaaaaagacaaagggggaggtggtaaaggaggtgagagagcaggaaaggtgagacagcgttgttctcatctgtgtctctgggaagggaggaataaagtggtcatgatgcatgtggtactcatctcctacttgtgcattggagagggagagagagtgtgtgtgatgagaggagctagacaagggaaccttttgctgggtttggcagaagggggaatctgtgcaggaggggggccaaggacagtgttttggggctgtatgcccagcccccagctgagctgcaccacctacaactgcagctgccttgctagctaacaaagcctatgcacagcagggacagcatgcaacaccaaaacactccatacgagagagagcgatagagggagatagagaggggagggagtgttaaatagcattagtagcattgctaattaggctaagagcatctccaacagcttctccaaatcccactctccaaatacccatatagccaactctccatctgatttgactagttaaactcgttgcttgctccatcagtctctttatctaccatctccattataaatctatgacaaatgggacccacatgtcagcctatgctattcctaacccctacttttcccctttctcttttctcaccatttttctagatggcaacagcggtgaa

SEQ ID NO: 23456 - DNA, 1501 bp, Oryza sativa
ggccgctctgggccgccttcttgggccggccggcccgttaagcccggccgagccgccctttctctcgggccacgccctagccgcccgagggaagtctattttccatccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgctgagttgtcccgtttcgcgtgtagtttcggagcccgaagacccgcagcgcgaggatttcgaggatcaagctccagatctcgagcaaggcaagccacctttgaacatcttgagcctatatttgaaattcaattatattgcttgcaaaatattatgcattgataggatcgcacttaatctgttgtcccgtctgcaaggcagatcggcggacctacctaacttgttgcatttgatccttccattgttaattgctataccatgtccccttgtaaccatccagttgcgcctcgatattcgtgcactctgtgcgagtatcgacggtcgccttcaaacttaaaatctgagtaacaatttgggtaaaactggagttttacaaaagacttggaaaacccgacacctgggtcggtgcttgcgaactaaatgaatttccaaaaccgcgaaccggggaacgtaccgggtgtacggttttcccgctcttgcacttaaggatcgtttccttggaatttcatccgaacataagacaagtacgaccacataggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttatcaaactattcgaacagccgtgcccacggtcatgggcggatgtgaggtgattcctagcgtagttttgtttgactactgcttgtgaaattgctgttgtgaaaaaggggttcgatgtttgaaaaatctgtagctgaagggatcagctaggcccgggtggccgtttggaaaagttgttggcccgggtggccgtttgaaaagttgttggcccgagtggccgttgaaaagctgtcggccgggtgccaaccttgtttcaattctaaagactgatacatcgcacatactccgaccggacgagacgcactgtcttatccgtgtagtttgagaagcactcacttagtcgttctt

SEQ ID NO: 23457 - DNA, 1501 bp, Oryza sativa
gttgtttttgcaattgattttatttgaactcttttctaagaacgactaagtgagtgcttctcaaactacacggataagacagtgcgtctcgtccggtcggagtatgtgcgatgtatcagtctttagaattgaaacaaggttggcacccggccgacagcttttcaacggccactcgggccaacaacttttcaaacggccacccgggccaacaacttttccaaacggccacccgggcctagctgatcccttcagctacagatttttcaaacatcgaacccctttttcacaacagcaatttcacaagcagtagtcaaacaaaactacgctaggaatcacctcacatccgcccatgaccgtgggcacggctgttcgaatagtttgataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgttcggatgaaattccaaggaaacgatccttaagtgcaagagcgggaaaaccgtacacccggtacgttccccggttcgcggttttggaaattcatttagttcgcaagcaccgacccaggtgtcgggttttccaagtcttttgtaaaactccagttttacccaaattgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccgatctgccttgcagacgggacaacagattaagtgcgatcctatcaatgcataatattttgcaagcaatataattgaatttcaaatataggctcaagatgttcaaaggtggcttgccttgctcgagatctggagcttgatcctcgaaatcctcgcgctgcgggtcttcgggctccgaaactacacgcgaaacgggacaactcagcaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggatggaaaatagacttccctcgggcggctagggcgtggcccgagagaaagggcggctcggccgggcttaa

SEQ ID NO: 23458 - DNA, 1501 bp, Oryza sativa
gcgcccacccgatgtcgacgtcgaagctgacttcgcctctaccggggatgaaaccctccaaattcgccgccgctcatttaaacacaaaaggtgtaactaactttccctctctcaactcgaaccgaacgccgccgagccggatattttaccccttgccgccgccgcgcgtcgagcccgggaggacgccagctcaccgccgctcgtcttcacccccagttaaacccaaccgtcgtcggtaaatatctgaacatgatctcccgccactcaatttgctcttcccttccctctcacagcctttgccatccctgccaccccttaactccaagctcatccatggcggcattggtttagggaaaatgaagagtttgctttagggattactttcaatttgtcaacattgatgtgcttaagggctttaatagaaaaatcaacctcagaagaattatttcccaaagagacctcaatacggtttaaagacgaacaaaaactaagttgagaagcggaacaagaacttgtaaaaggctcattaggtgtaccttgaggggaagccaacaaggccggccttgccccataaggggcaaattgatcatccagattgatggctgctttcctcttcatcgctttcaacagagagtcatcatcggccgaagcgatgccgagggctgtctcggagttggaacgatcactgcggcgtattggtgtcatgttcggcgcaagcccgacagccactgcttcattgctgccggtcactggatagtgcgaaccagcgtgtcccgaagacttaagaagcattgccgcggtcatctccttttcaggctgcgccgacaaaaccatatcaccatccgctaccgtcaccacttgctcgccagccacctgctcgctacccgatatcttcttgtcgaccaaagtcggctttgtcagcccgacagtcgcccatcctgtggcttgtgcgtgctcccaaacaggggactgggaggagaatgaattggtgcatgtgttcaattgcttttacttgaaaactggattgtaatgaggttgagctaaaatagtttagaatcaaatttgtccaatagagcaggcgagcagcagagtggatgtgcctctaataattgaatagacaagaatgcagcaaatttcaagaaaattttcaatgatccacctagcagcacagcatcgtttcactagacaagtatatatacaagattatcccctcctccttttccgggcttgggaccggctatgtcattaaacacctcaagtgacataggcggagttacctacacacctacaagaagaagaagaagaagaagaaacacacaaatcattgacctctcagagccactcgttgacctccagctcatgctcatctccatggagctggcggtgttgctccggaagcccagggatccacagctgagagatctcctgcatacctttttccagcaatagccactccaaaccacccaactcctcgacatgcctcaaattcaggcattcattt

SEQ ID NO: 23459 - DNA, 1501 bp, Oryza sativa
ttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagattcagtagttgaaaaatggcttgaccagctaagagatgttatgtatgatgttgatgatattattgatttggctagatttaaaggaagtgtcctactgcctgactatcctatgtcatcgtcaaggaaagcaactgcttgcagtggcctttcactttcgtcctgcttttctaatattcgtatacgtcatgaagttgctgtaaaaattagaagcctgaacaaaaagatcgataacatttcaaaggatgaggtat

SEQ ID NO: 23460 - DNA, 1501 bp, Oryza sativa
cattgctgtgagaaacactgttgattttcgtttaggatgctgtggatttggcgattgggatttgtctagtgtttacctgaacgccctgaattcgattgtaagatcttcctattcttaccataggtagcgctgccgagcgtctcgctttcgacgaccttaatcgtcttgctccacttccagtgtcccttgatcttcgcctcggggaagaagaaccctgcgtgacacaacgacttgaactcgcccattcctacccggatcagcattgcttgtttgcattgctgctggaccatttcctgtccaactctgtttgttgagaactccgctttcctgccaggcttaatgtgatcgaacattcagtggcaatttcagtccagttcagtatccgctttaaggtatctttcaaaaaaaaataaaaataaagtagccccctccaggtgcagtttgttattctgttccatgtttacctttttccagtcaagaaacttgcatggaggtgaagtgattatgtaaagattcactagagcaatgtacttcagtaattactgaccatcgctggaaatcattcttgtcaggacatcaagcacgcctctctgtttttctggtttttgccaattccatttttcatgaatttaaattcatcatttttatttgttgatcatgtgcttcataattatgttctgaacctaaatagcgtgatatgtgataacagatgttttctgcaccagttttgatcatgaaaaatactaaagcctccaacaaacagacttgtgcatttgtggtctccaaaatatcaactcttgtgatcattgatctggcactgataactgaaggatgtaggacagaccgacagaggagaatgaactgatgcatgtgttcatccaaattgcttttactggaaaactggactgtaatgaggtcaaactaaaatagtctagaatcagatttgttgaacaattaaacagagtggatgactctccataactattctgatccattactgaagatgaaattagcttgataaaagtgcagaaacttccaagaaaatatcaaatgatgtatttagcagcagagcatcatttcaatatagaagtatacaagattatatcccctcctcctttttccgggcttgggaccggctatgtcatttagttacgccttaagatgacataggcggagttacctacacacctacaataaaaaaagttttaaaagaaaacaaacgcaagcaaatataacaaattatatgaagatgtattttacaatagctaaagaaaatgctttttttttcaatttttgacatttcccctttttttgatgcttttgttttttttttgttttaaattttcatgttttgtgatttttttttcattttattctctgaggaatgactgcactccaactcttcaagattaacaacctacaaaacaaataagcacacaaaaattaatcacggatgtatatatactttatacatcagacatcagttttaataacttaatta

SEQ ID NO: 23461 - DNA, 1174 bp, Oryza sativa
cactcagcaacaacaaaattcttctattatcacttattacatagaaaactaagaaaggtaaatatatatgactatataagattctaatcagcttaccattcacggcaaaacttcatggtactcatggctgatgcctatctggttcttgcagatcttcctctccacgttgaaccctactaagctgcaggcaactgagatgcttctagtacttctcaagaaggagattaaaggtgacaaagagcaaatctttgttatctcaaagagtctagagaatgggatcacacccgaccatccagaccccaatcagttcactctgctttgcatctgcagtgtgaaggagccgggcaatagagacaaggacagagcattcttggagaatttggatcttgctagtcatgtcgcattctaattctagaatttatggctgatgaacatatcacgaagtcttcaaaaactcttggagtctgtgccattgtaactatttctcatagaatattatacataattactggagtaattgcttagatgagtacttgttttcatgacttctttctatttgaccaaaatttatttcctccagtttgatagtccttctgcaagtttgtgttgttgataactatgccttagaatacctctgatctgaaaccatctggtttgattgaagtgttgaactcaatattgcacagaacatttactcctagaaagcattttactcctagaaagcatccaattggattgtgacatcaacaggagcactgatctaacattgtcccaaacagatatgtgttgatatcaaaagaattcaggtgttgctttcccgggataatttttggtaacacaatagtatctgaagtttactcagcagtacagcatctctaatttggtatcatgcgcaacttgtctgatctgtgagacagagagaagaagatgaaagagccaaagcacattatggaaagggaagactcgaagaacctacgtgatgcaaatcttcgccggagaggagctccgtggccagtcggcggagctccggcgagcggctgccatggcggcggattctctcatccaggagactatcgctcttgcggtcgggccgattaatgggcgtacgccggaagcgacgtaggcccatgttatatggtccagcaagggattccatttaatttgtgggcctgga

SEQ ID NO: 23462 - DNA, 1501 bp, Oryza sativa
gtgcattgactgattgtttaatgatttatatgatttagttttattttcatttatgctgcatgtaagcatttcatcatggtcaagattttcataaaatggtggatatacattgacaaattcattagttgtccatttctttaatcctctcgtgatcttattaacatgcgtcctgtacatacggtgtattctagataaatgaattgtcctatatgtactacaacataatcatgtgcaatagtgttcctagctctgcagacaaagatagagattacttctactccaaaagaaaattgtatgggttatatcaccaaacaatgctatgatggcattgctatattcactatatgatagtagtaatatcacaaatgcatatatccatccaaggacttggggacaacataaatggtttagcatttggtacacaggctgcataagtgcacgactaaacataatggacttcgctaggccaagagataagtaatccttaattcagctcttgaatgtgctagctatgattggccgtgtacatccttcgggatgtagaggccgggttttatttaatccattatttaaaaatgcgctatctatgacgaagaccagatcacgtgcatttagccttcaagtctgcaagtgtgttctatgtcatatcaatgtgcacatttagtactcagtatcttataaaaacacaaatacacatgaattttcgcaagacattaggcaatagagtagtttttttagatttcacaaaaaataggtcaggcccaatgttacagattccttgcagcctgtgagcaggatattgaagatggaagggttgtgcccaacatctgttcctagtgtagggctcctaattaaggtttgtttggtgaaaaaacaaaagccacctaaatgtctttgtattggttcaaattgattaatatttttgttcgtattacatctgttataagcagaggatattgccgagcgacatgcctatgtatagtccctatgtgtcttttccttatactttttgtaattcacgtatgatgtttggtaagttcaattgtagaaaatagattgttgcaaaacggatgtcacttgtattttcttttccttaattaagttatttaattaccaaattgcttatgaatatacatccatgattaatttttgtgcgcttatttgtgttgtaggttaatcttgaagaatttgggctgcagtcacctgtaatctgtacttttgtctttacctagctactggtctttgaaatatattaaaaaaattaaaaaaacaaaaatatcaaaaaatgggaaaatgtcaaaaaaaaggttatattttctttagctcttgtaaaatacatcgtcatgttttcttagatgtgtgcgtttcttttctttttattttttttattgtaggtgtgtaggtaactccgcctatgtcatcttaggtttatctgaatgacatagccggtcccaagcccggaaaaaggaggaggggataatcttgtatagatgttggttga

SEQ ID NO: 23463 - DNA, 189 bp, Oryza sativa
aacacgtgtgcccttctgtactactgaaagctgggttttcctttcccatgtgcactatgcgctttcatgttttcctccactagatgttaactacgatatactacctccttcctttaatatatgacgttggttagttcaattaacatcatacataaaagaacagcgcaagtatcgattattcttacccta

SEQ ID NO: 23464 - DNA, 178 bp, Oryza sativa
agtgattcaataactacaaatgagaaaaaaagattactattagtagtagcattaaagaggtatagtggaccactctaaaaccacacatttttaaggacgaattctaagactaaaactacaattaaaagatggagggtgtagtgcataatccttctatcccaaaatgtctatttctagg

SEQ ID NO: 23465 - DNA, 1141 bp, Oryza sativa
ctgactttcatttccaatatgccattttcaggatgatgggatggagtatttggtgagaatgctcttatggtctcaaaaccattccgtccctcaactgtagaactgtttgattggtatcccctaacttttaaaatcgtttattttttatccatcgtcttaaatttggtggatctagtatttgggccttctggaaaatcaaaataagaaaaggattacacatatttcgatgcaaatctttcgctaaacaaagaaaaggaaagtaagctggtgtggtcatttggctgtaggagaaccggtcaaagtaacaaatactctctccttgactccattaaaaaagataaaaacttgagtctttcatggagattaaagataaggtaaaattaaatgattaggtgactaatcaattaagataaaatagtaggtaagaaaattaaataagagatgttataattagttgaggaatagatggagaaattaaattacggatggttgtaggtgaagtaaggttccattctatatctttttctcaactttcactatctcatttttcatgtgtacatctcttgatctattaaacgatgttttttaagtaaaagtttctttaaaaagtgtattagtagatatttttaaaattttcgagctaatatttaattaatcacgtgctaatgagtacttcattttgcttgccactaataaaccacaccgttttgcttgtccagacgattggttttcaacatgccatgcaactatattttggaatggatctagtagagaattgacggggcccactttcatcctactgaaaatcaaataggagtagtcatttgcattgcaaatgggatcgctgttatagactgttaatactcaaaattcaaaatgctgccctgaaaaatgatattggcttctttcgaatgccagaatcacatgatatagcctaaattccataaaaatcccacgaatttctccatttaaatgatcactcgaggttaactgcgactacttcattcaaatgatccagtttaaggctgcaactaataactactgtacacaaacttacaacaaaggcaggcagcctttatcctggtaaaaaatatatgattccaccagagttcccccctaaaaaattgtttttgagcaaaga

SEQ ID NO: 23466 - DNA, 1501 bp, Oryza sativa
aacattttatggcatgcattacatgtagtatatttatttagaatttttttagtgtgcattgcatgagcaaactgagaataagtatagctagctagctagaaccattgttcacaaaaccattcgtaaattaaaacgtgagttacaaatcgctcgttcaatcagtcaatttttttaaaaaaactaatactaaatttgaattttttaatatactttattttaattccagccgttctcactagttctccaatggtttcaacgaaaagaaaaaattaaagctaattaaggagatctggtaaaggcttttagaaatcagaacattggctaaaactttgctacacaatctctgtgttctaatatacaacgcattattgttttccataaagtctacatttgaaaaaatggactaacaattaaataaaaatatgtgtttagtgccatgcaagtagcatttttgtatttgtatttgaaaacattttttatgatgttgattttgtagtagatggtaatatattacgaaagagattaatgatcaaagtataatgttggaacaatatgaaaggtttaatataaaaggtttattataagcctagccacttattagcgactaaaataatttatggtaaaactattatataaatgtttttagcaactacctatgcttaaaaaataaactaaaattcaaaatttaactatgacagatgagaatacaaatcatgtgttgtttggtttgtgcaagcatatcaagggggagaaatcagttatatactacctctgtgacaggaagatcgcagttttgtttatatatatataacgtttgactgtccgttttatttgaaaattttttataattagtatttttattgttattagctaataaaacatgaacaatactttatgtgtactatttttctttatttttttataaattttttagataagatgaatagtcaaatgctaaacacgaaaacccacagctgtattttaaaatgagacggagatgtaatcgatcactcccaatccatatgtaagtgacacaggcatcccaatgcgcatactatatgtggcaaggcattcttggtgctgggctagtggccctctctggattatgttggattttcaatccgctcggcttgcgtgattaagagggcacaagtggtcttccaaatttgcatcccaaagacaaggacctagctcccacctacaaaagcgtatactagtgtggaccaaaaccccttaccacggggcacgggccctcaccaagtttcattcttcgtacgaaactactccatgaattcgcattgcagggctccaaaaaaaacaagcgaaatcctacagcagcagtattgctcgcgctgcacctctactctagtctgccaccggcgaagcgcgccgctcgagccttctctccaaaaacccctataaaaccaccgcttcgcacagtaaaacctccacctagttggcagtaaaaaaagcgccgctacctacacacacaaccgctctg

SEQ ID NO: 23467 - DNA, 1501 bp, Oryza sativa
ttggtcgaacaaatattgttttcacgtgattctcgccaccgaatctattagattttttaaggcagattgtaattaatgtggacaatgtgatcaaatgaagtgtcaaatttttcttaaaaaccatatcaactactatgttttgatttaaaaataatgacatgtaggatcacattctagccttttacatgttgtccaaataattataaaaagaacatagattataacatatattactaataagttataagtgctcaaagttggaaccttaatagtactctaagctgagattaaactttttaattttggctataaatgactttaaaatagagttaatttaatccatgatattgcaaacatgttatttcagataaatgctattacaatttgtctatttgtagttgtgccattgaaattttacaaaattagaaccgtgccactgtcgtcacgtttgtacgatcaaacacaagtaaccaagtctaccagagggggtgaatggtagataccgtagattacgtcagcggaagtcaaataatcgaatcttgacagatcaaaacacaccccaacctcaaaagccaatgaaacacatgtaatccagtctatccgacctactagagtcagtctgaccgagcctggctggtctgaccgcaggtcactcggcggtctgaccgtcagccctaaaaacagcacgacagcgtttctgtaaaaacacgatttctcttaaaccaaccgttggatcgagttgcaaacttgatagaataaactagacaaactaaggaaaaactccactggagggatttgaaaaataataaacggtttaagagaaaacaccctcgaaagtcagttgtctcagagtttcagcaaatctgaaccctaaaactgaagcaaattcaaatctaacaataagccaagtttgtgaaattagatagggtttcgtgagaaacttgtaaggggtgcattgttaaatatatgatccgaattttgggcccacaatatatttggataagttttctaatagaacttgactattatgattagtttcctagtttgactcataagtctttccccactaggactgttagatttatactatatatattccttgtaagccacacggggagggtgcgatagcccaatgtatcccatgcgtatgtatccaactcctcaatagtgatcattgccggtcaacgcccatggtttttcccgcaagggttttccatgtaaaatttgtgtttcggtttcgggttgttttattgtatatctgtggatagttcatgtttatggcttctagatggatactatgcgtatgtaatactgtagttttctaataatgagtcacgttggagatagtttggaatcggaatatggtttctttgtttgattcatgtgtaggtgtctaaatgcctcgggagagtattgccggtgatgaatcgggagtcaacttggagataaggtgacgtccggatggtcagatatcatgcgggattcttaggctaaagatcaa

SEQ ID NO: 23468 - DNA, 355 bp, Oryza sativa
gatgatgtgccactatgatattgcttctgtccctgctagtagttagtacaacattaagagttaactagtttgagtggattaacttgtccaatcatgctcaatacacacacacacagcacagcacatctaaatctcactggttctgttaggtttgatatcagctagaacaatcgcaatgatttccctgttactcatgattctctgtcctgtttttacctagtgctgtgcgacaattaacagtacccacaatgcaaacttagagttgctgttataactgtaatttgttttctttcagagtaggaaagaaacatttcaaaaaatgaatgagcagtaatacagtacatctgtatgcagg

SEQ ID NO: 23469 - DNA, 1501 bp, Oryza sativa
cgggccgctgggaagcgtaataccctactcctgtgtttttgtggatctgtgtatggacaagttacaaagtgtcatccagccctcagtcccctccctaggtgggcaaggtcctccttttatatctcaaggggataccacatgcacctttccctttccaaaccggactgttcttctcttcataaatggacggagatcggtacgattgctgtccgagtgcccttctgacgagacggcccatacctacccccacttccgccggaaacaggtgcgacgtgggattatggctgtctgtggatgacgcgaccagtgtcagaccggtcacagatcagtcatccttgtctaccacgcgtcagcttagcaacgtgcatgtttgcccttcttcatgtaacatcttgcatgtaatggttgggatgaagcctggtataaatctaaccagggctaacgtgccatctctaagagataacccgctagctccggcttgagacaagtgcctagaggctttcgtcttgacgggatggggcaaggcgtgcgtcagaccgccagtcgccacctaacccgtgatctgaccggtctgtgaccagtcacagaccggataaaagaacgcgctgcactgcgctgcatgcagtgtgacacgcttgaccagaccacaataaatgcggttaggtgagcactgccgtgttcacctatcccatatatgtggcgcaaactccctcaaggggtcggggtgcctcggccctcggggccggggcaggagcaacccgaccccccctcgggggggaaatcaggaggagggcggacacctcaccctcgggcccgacgtccccgaaggtgccaggccacgtgggcgattgtgtctgcctcaagcctctggtcacgatacccccggtcccatatcaccgacagtagcccccggcgttatgccagggcgatcgcccttctcaagggaagcggtcgggcgtaatgccactcctaaagcctggtgacaggtgggaccggtttccatggttgcgcagaaacccaacggtctcaaaccatgcacatatggtaacttggctgtccataatgggcggtctcttcaagactgccacatcacttaagcagcgcacgaatctgggtgagctgatttgcttcgcctggagatatggtaacgtcgcttcggccggcgagcgtaattaacgcgcgcacgatacgatctatctcgactgccacaaccgcatatccacctcatgcgccgcaagcgggcgaatgggattagtggaagcgagggcacgagaaacgagggagcgagatagtgagaaacgagggagcgagatagtgggcgcgagaaacgaggagccgggcccagcgatggcaagggtataaaaacaccgaggaaaagttttgctcccttcctttcgccattatccctcttgccttcgccgcttgagccctccctctttctctgctgcgccctaccttcgccacacgcgctcgctttcaatcacctcttcctccggcgcca

SEQ ID NO: 23470 - DNA, 1165 bp, Oryza sativa
aggaggaatcaaaattaatggtcaatgtgggcctctagggttcttctaagtgaagctaaggttcacatcagtagtgtccggaaagtggttatgttggaattgtttttgtgcttcaattataggcagatcgatgtgtgttgaatacgggtgtttatcagttgtttataagctaaaaggttccattcaacggtagaatttcatgagacacggatgaaagcggaatctgtgctgcgaccatcctgttggaacatgtagagttgaaaatcactagaacagtgcatgcttcttttgataattgatagtgactatgaatgtttcatcagaatatgacagtgaaatcgataatgttcaaggtagccttttggctgcttcgtcaaaagcctattctttgcttgtttaagtccaattataattccttttgatagttcatcaagctatagctgtatagcttctggctatggaatctttggtttggttagttttctagcacacttttccttgtgttgcttggcccaatgctcatttgctctggaactcaaagagaactattactgcattttgggatcaatagcataattgggcaaaaaccatataatctagttcgttacaaaatgctgcactgcttcaactgttggctgtattgccatttcttaaatgcttgagttgctctcgcattctctgctgcattgttgatagattgcattgccaatgattactatttagcagacttaaaattttcttgaggatcaaatgatggtttttattgtccatgtcatgtcatgtaagcctaagcttacaggttaacacttctagctttgagcaattgcaatttataacttttatatttttgttggttggattaaaaggtttttggggggttgaattgaaatagttaatgtgcttgtctaaatagccaattggagtttattgtgatgggcaaaatttatgtttaatattacattgcaattggccatcaatctttgaactgctcaggctctacaaggagttatggatgcatgcatgtttgagcaccctgcattctatacatgcccttttttttttaattttgtagcactttcaatttctacttccctccttagattatagatttactatcattttcagtgttgtggagttattctgattcaatttactatgttctgca

SEQ ID NO: 23471 - DNA, 1501 bp, Oryza sativa
cgtccctgttgacgtcctcgtcgtcgccggagccggtggcgaggattatgaacagtagcgcggcgagcgcgaggacaaggccgtcgaggccgaggagggggcgcggcacggaggtggaagcagaggaggaacgggagaagtcctgcacgtagcggatgtacttgacggcggtgaaggcgaaggagaggccctgcgagagctggacgccgcgcacgacggggagcgggaggaggcggtagagggtggtcatgaggccggtgacgccgaggaagaggaggatggcggcgacggcgaggccagcggacatgatctgcgggatggtgaggtgcgcggaggagagcgcgacggcggcgatggacttcatgggctggacgggcatggggatgccgaagaggagcccggtggcgaagttgtagagcgcggtgaagatgagcgtggtgccgaggtcgaggtgggacgcgagcgacagcgccagcacgatggggatgtaggtgcccagatcgcccaccgcgccgcccagctccgaccacaccgacgtcttgagccgtatggtggacgggacgaacctgcggcggccgtcgccggcctcgccggagaggagcgggtcgccggcggaggatgccatgggtgggaaactcgaaagcaacgacttccttttgcctagcgatgttgttagcttgcacacgtttctgaccggtggaatgagcgaataaaaatactaatgtctctctcgaggcttaattaagatgcgatccagatttccgtagtggcagagtccagtgaactcaagtttgatccacactatccgtaattgggcgttaattcctacctaaccttaaatagtcgatgtcactgtcagggatggtatatgcttaaagattatggaggccagctactgcacgagataccacccaaagatctcagttcagattgggtaatttaccgtgtttaaatattcttgaaactgcgaagtgcgaaccatatggctttggcttttacttgaccaaaaacataatgatggtcaaatattatccattattttagaatatattctgaaactatgaaccttgattcaattgggctttagttgacggaaattacactcgcttatagccaaatattgccagttttatatcgagaataacttcttttttctttccaaactatctttactgtgtttttgttgtgacttttggcgtgatgtagggacgggacaaacaatatcatggatgatgcattctgcacgtacgtcttcgcaagatggatagcttccaacgagaataatggccgcgacaaggatgtcaagtgacattctggccttctgggtgacgacggggtatgaggatatttccctcttcggcccatgataaaggtggacacttcagcggacaacattgtttgcgtggtcacttggaaaccttttgtactaccatacaaatcacaaatgcttttgtaaagaaatgatgtagacacggtgaaaatatctttcacaaacctgctt

SEQ ID NO: 23472 - DNA, 1501 bp, Oryza sativa
cgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttga

SEQ ID NO: 23473 - DNA, 1501 bp, Oryza sativa
ccgtgcccggcgagatcagagatagcgctttcgtctctcccgacagtatccggagacaccgtaggggactagccatgcttatccctgaagttgatatccaacgtcttgtcttggcgtatgttggcttgtatgttgtggcttctgttgttccgtgtcccctctcctcctagggggccttgtatttatacccataggtgtctccttgtcctagtagaactagggaaaccaatatggatatagtccgagtaatccttgtcgtttccatgtagaactctggttgtctttccttatccagaactccctccatatctgaagtcagtttccgtattagacatggtatgtggtgggtcctgccgagatgtagtcgactactattaggtatgtggtatccataaccctgatagtagcccctgacttcaatgcaaatgaacgaattcatattctcgaccactgaccatggagtaactgttatcgagctcaagtgaccattctcggtgagttcagagataacgttagacttcctttatcagcctcgtgcgggcacctaaagggtttgtctcagtccatctccaacgtcaaccaagaaagtacagaacattcgactaagtctcccgtcttgctgtaatcgagaatttggattgaagtcaagaaattttatctcggcgggtacaccatctcttcaatccgtattccttgccgagatccaccaactgttctcgagcgatcgagaaggcgtagaatctgcgacggagccttgtcaacatttgtcgtactcgccttagtcgatcttggtgtagaaccatagagacatggagtcttccacaacgtcgaatagaattttcctgaaatcaatactcagaaaagaatatcaaatagaaatagcccccgggcgaacgctcaaagggtgacatgttatagtatgtatggaaaactgaaaatgagttaaatttacagaccaatgttttgtatatgagcgccttctctcttaccgacttcgatcagtcagtttgttgagtcatacactctccctagcccccagccttgtcgtcggagaatcgttctcggaggagaaggctcttggacccttgacctgccttggttgaacaagcactaattctagcccccagtcgtgaagttggaaaatccaatttccgattacacggcttggttaatacgcacggcgagaactcttacacgaccagatcttacgtggtcttttgtctctacaggatccgacaaggccttatcggctctaggcgcccccagccaaagttcccttaggttcctcggaggccttgtcaagacggcgtaaagggacatgaggataggtttcaatgctaggtgtcgtcatggtaagggatctctaggtaaaacacttagcaatattgtgtatctgatatcaactttgttcgagtagaggtaatgggagaatcgctacaccgttggtcaaaaaccagttgtagccccaactcgaccacttgaaacaaaggtagtgggagaa

SEQ ID NO: 23474 - DNA, 1501 bp, Oryza sativa
taatctgtttttctcaccagttcactgagctcttcttctactcctagcacgagtattgcattgtctgtaatgatatcctgcaacttcttgatgcatgagacaatcaaagcatctaataccgccgccatcaggcaaacacaaacggggagatccaccaaggccaaaataccagatgaatgtaaaaaaaggcaggctggcaataattccaattctgttaacatagtgaaaaattagagaaggttcacaaaatttgccaagtgatgttaacagaattggcatattttgtgaaaattacagttgtattttgtaattaaaatttcaaaatgtgccaaataacgttatttcaaaaattatagttgtcttttgggtcgccatgcttacaatagcaagtttgaaatgtaatgcctccttttaagacctactccctccgtttctaaatatttgacgcagttgacttttttaaatatgtttgatcattcgttttattcaaaaaatttaagtaattattaattcttttcctatcatttgattcattgttagatatactaatatgtatacatatagttttatatatttcacaaaagttttttaataagacgaacggttaaacatgtgctaaaaagtcaatggtgtcaaatatttagaaatgtagtgagtatttgcataggacgtaatatgattcaaaaaatgccaactgttggatcagtgtgaaatgactagtctagacaatcttcgagtatcataaaaaacatttctacaagtcgtgacaggacttcgcattgtggtaattaacgtcatgtagaaacacctccctactagtttcatcccgtaaagcctccttttggaacacatgaactgtggtaatagaactaatttctttgaaaatattgtaaaactcatgtgtttgaaaggaagtctcaaaagatcatgaagagaaaagaatacgatatttgaagtgtgcaagcaaaatttaccttactgactgttttcattcagcagaaaaaaaaagtatagtaataataattttgcaggcctcatatacaggttgaatggccaacgtgtagacaaggcaaccaataattcagctcttcctgttgattggatcaagcaacctataatattagtgtttgattgctcaaacattgcaaagttacttagtttgcctcatcgactttgatgaacaattacctggtttaattgtcctgccggatcatgatgaggaaaacataattcattgctcatgaggttgcacaattggcataatgtttaaaacgttctgccgttgatattgatatgttgatttccttttttattctatagagcaaatagttcctgaagaatgtactcttattctgaattattaacaaaattccctcttcatctcgaaaaatagttgctagccatcatctcgtaaccagtttgcatgaccaacacatccacttcaaatctcaattgagtgagattagtgaagaccaaacacaattgattgaatgagccaaag

SEQ ID NO: 23475 - DNA, 627 bp, Oryza sativa
aaacggcagtacggcatctctgcatcattgaacgctacagaccaacagaggaacacgaactcaactgctatcgaccaaaatttcttcgttccagcgatccaaaaccacagcctctctctgcaccgttcgatcatatacaggcggctgagattagacgcgcctcggaatccgtgggccgattttcgtttaggccctcgtattatctcgtgttgtcgtgtcgttgtacaagggaggaagagatgtcgagacgccgccgccgctgccgccggcgatgaggagaagggaaccgggcgttgcccctggcgcggcctctccactgcaatgttcacaaagataccccgaattattactccatctgcaactacacattctgttaatcacagttggcatctgaaccgaaaccgagaattattttttttgagaatatgcagaacttgcgttagttgagtatcttttgtattaactctgaactctgaataaactagttggtttggttgtgatcgataatcctgacctggaagaagacagcttcgccgtggccgcaggcggcgcaccggacggacttggtgcggggcagggtggggtcgccggcgacgtcctggagcacctgggtgaaatccccgggcg

SEQ ID NO: 23476 - DNA, 1209 bp, Oryza sativa
cccgcgggccggggggagagagggaggactttgggccagacttggcccaaaggaggaaggaggattatttttaggtttttctttttaataaactttgataattgtttttgttgcttaataattattttcggtgctctgaaaattcaagtaaaatttgagggctccttttagaccaaagagaatttaacaaaaattctccgggccacatttgaatttttcttgtacgtattttagtgtttgccaatttcttttcgaattttaaataaattctattattccttttagagaatgatttttaattcgggatgaatttatcaggacgtgacagctggtgctatgagataggtcatcggtcttcgttggtaggttgggcgcgacgattctgcatttgtcgagatcgttctcaataatggggtgtactcgaccacaacctactcgagtgctcaattgttcctgaaaaatattttctagaaggcaagaaatatagcagagaatatcgagtatgtactcaaaaaactgcataaatcttctagtattatcaggatataacgagcagatgtaaatatcaggcattacgtgaaccgtaaacaagcttgatttgtacaaaataaaatagagcgagcccccggcattaaaccgtagtcggtttaacatcagggacactcgcacaacagatattgtacaaaaagcatgctctaggtaaacataattgatctgacaatatctgaaaataggtacggtaaattgtatataaaatattgcgtacctttgtagatatatgccggatatatctacggaataagtagatcaattaaattaattattccactaattaccttaattttccttggccggtcaatgcacagaccgtagctctgtacataccaatatgcatccgtatgcataggcatgtatgtgtacagcgtacaggggtgctggtcacggtagagtgcatccgatgcatgcgaggtgaagtcgggatctcgtcggaagacatactccggtcgggttagatcttcccacagccgaagttatcgagcagcttgttgttggagaatccatctcttaaacccatctcgtcgaaatcctgaagcaccaaaatccccctacctggcgcgcctctgtcaacgtttgatgtcgcgattccggtatttgcatagtatggggatcgttgatactaggatatacgcgagactgaggtaaaagaga

SEQ ID NO: 23477 - DNA, 1501 bp, Oryza sativa
ctgcaaaattattattactatactttttttttctgctgaatgaaaacagtcagtaaggtaaattttgcttgcacacttcaaatatcgtattcttttctcttcatgatcttttgagacttcctttcaaacacatgagttttacaatattttcaaagaaattagttctattaccacagttcatgtgttccaaaaggaggctttacgggatgaaactagtagggaggtgtttctacatgacgttaattaccacaatgcgaagtcctgtcacgacttgtagaaatgttttttatgatactcgaagattgtctagactagtcatttcacactgatccaacagttggcattttttgaatcatattacgtcctatgcaaatactcactacatttctaaatatttgacaccattgactttttagcacatgtttaaccgttcgtcttattaaaaaacttttgtgaaatatataaaactatatgtatacatattagtatatctaacaatgaatcaaatgataggaaaagaattaataattacttaaattttttgaataaaacgaatgatcaaacatatttaaaaaagtcaactgcgtcaaatatttagaaacggagggagtaggtcttaaaaggaggcattacatttcaaacttgctattgtaagcatggcgacccaaaagacaactataatttttgaaataacgttatttggcacattttgaaattttaattacaaaatacaactgtaattttcacaaaatatgccaattctgttaacatcacttggcaaattttgtgaaccttctctaatttttcactatgttaacagaattggaattattgccagcctgcctttttttacattcatctggtattttggccttggtggatctccccgtttgtgtttgcctgatggcggcggtattagatgctttgattgtctcatgcatcaagaagttgcaggatatcattacagacaatgcaatactcgtgctaggagtagaagaagagctcagtgaactggtgagaaaaacagattacatacgatgttctcttaatgacgctgagacaacgaggttggatcatgaagcagttaataattggcttggacaactaagagatgttatgtatgatgtcgatgatattattgatttggctagatttaaaggaagcatcctactagctgaccatccttcatcatcatcaagcaaaccaacacgttgcaattgcccttcgtgtcattgtaatatttggacacgtcatgaggttgctgttaagattagaagcctgaacaaaaagatagcgaacatttcaaatgatgaactacttcaagatctcagacgtagaccgcatccgagaaatggttcgatatggacaccgataaaaacctccagcatagttgaacccaaccttgtgggtgaagaggtcatacttgcttgcagagaattggtggatttggttattgaaaataaggaaaagaaagattacaagcttggtattgtagggacag

SEQ ID NO: 23478 - DNA, 214 bp, Oryza sativa
ttttgagcaaggtgacgggaagagcacaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagt

SEQ ID NO: 23479 - DNA, 820 bp, Oryza sativa
cacaacccaccattatcaagttttagttggcaatttaattaattaaccaatcacgattgaccatcgtgagctatcattaagccagcattaaataatagtgaattataagttatcccaatagtgtgctaaagtttctaagcatggctaagcaatcatatctaatatatagctgaaccaatatataaagctcaactagtcaagttataataacccaaggtatcaagcaataaagtaatcaagaacaaaagggctataacaaacaataggttaattccacccaatgacattcgataataaatgtaatagttgaataaaaacaacaactttaaacgggatcaacatgctcaaagggttgtttgggatctgtgtgacttgccttgctggccttggaactcttcaaattcttctgctgcgaaaacggactctccggaaatgtcggaatctaaatagaaaggagcaaaacaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaaaggggtttattgcgtcagtggctagggttcgcggtgaaccgggtgcacagcagcggctcacggaaacgaacggccgagattgatccatccaaaacagacggccaagatccatcggtccatgactgggccagggggaacgacaacga

SEQ ID NO: 23480 - DNA, 783 bp, Oryza sativa
  unsure (1)..(783): unsure at all n locations
agaggcgtgcngatgncggatctgacgagaacgacggtattggtgcaaggttagggttcggttttttttttttttttttgntttttattttgcgtnngcggncgatataagcacccgcacgtgaaaatcagattttcgcatgagggtgcgccacccgcacgcaaaaaatagcgattttcgcagacaactgggtgcgtgcggttcgcccactcgcacgtgaaaacccttttccaccgcacgaaaaaatccttttcgtagttgtgatttgtttacatgaataggtatgtgaattattggctagcaaaggattgtcgaggtccttttactattattttttcaaatggaaaattgtgctaagatagtctttcaccaatggacctggcactgatttggttttttgacaagttatcttgcccatgtgatagagttttacgttaacttaattaagataactaacccacaggagtccactctatcccaagcctatcatttagttgttgtccttcgaagaatttcgttcttagattatacacacacgtttactgtggatacgatacactggaatactcttgggtgaaggctacaacggtatttgtgcgcttatagattattccgtggtcataataaataccaacagtgaggcgcggcggcggcggatacaacggtggggaggggcagcggctgccctaccccgcgcggcggcagtgggaggcacagtggcggtggatctggctctggctccggcgacgggagcgggcggacccagccgccgctaggccccta

SEQ ID NO: 23481 - DNA, 350 bp, Oryza sativa
tttcaactataactataactatagtataattataatataatttcactataactatactataactataatataacttgtatataagtattaactagaaaaaaatatccgtgcgttgcaacgggtaaatattattttaattctattgttgttatacggtttagctagggtaaaattcactgtgggaattcgcttggatatttattttttagaaaatcataagctacaattagtagtccatatttcatctcaagttagcatgtgagttttttaaagagatttcttatcttttttatttccaaaagcaaatgagcttaaaatccaactcaaaaacatatctgtatttctaaaaa

SEQ ID NO: 23482 - DNA, 1501 bp, Oryza sativa
acggatgcggaggaactcggcgagtttagagtgttgtgggggtggtggtggagcattatgttgtggcgggttttggatgtggtggaggaaagcagccatcatgttggcctgctgggcgaggatttgggtgaggatggcgttggtgtctggtggtggtggtggaagcggaggaggaggtggaggtgggctgccatggttgttgtggttgctgccttcggggtgactgccttcacctgtagcagcacttctcctggttgtcaccatctgaaaaccccacacagaaccagcaaacagagagagctgacaactaaaactaaccactcatgactaccataattcttgaatttattactgctattaaattggttcattaaagttcaagttgcttaagcaaataaaataaagacaggctccgacacagttataccacacaccggcttaaccatgccccatacgactctagcagaaaaacaaacgagaagaacacacacgcaagcctactaactgctcgtctactgctgcgacgggccagggcggaaggtgagtagcagcgcatcctccgtgctgccaacgccggaggctccatcctcctaaggaaccacgggcgcgggctcggcacgaggggtctcgacgaagcaggtccacgccagggactgacgaacaagctcgggcccggaggtactcttgcgggcggtgatcttcaggctgcggcagacgcggcgacgcttggggcgacagacctctccctgggcgatcttaagctgatgcagctgcgcctccactgcgtctaggtccttcttcagctgcagattctcctgacgcagctccaggatcttcatgctgttctcgaccaacccacgacgcaccatctgatggaagtcgatacgggtcgcgtcgtacgcctccaccatgcgcgccaggtgcatgatggtagcgtcatcctccgagctagcatcccggaagatggcgtagtcgcgggctcctccacgacgagggtggtagcggtagggcgagtgctgcaactcgtccgggtagcgctggtgaagagtgccgatggcgaggagtgcggcgttctggcaacccgacgctgggtcccagctcgtcccaagccaacccaggccaaccattccacattttagttgttaagcaggttttgagaattaaaacactaacttgggtacattgctcggcttgcccataaccaagggcgcggctattcgaatagattatactctgatcagaggtgtacatctttacccacaagacacatcttcctcacgtgtaaccacgtgccgcataccaccacggtatacggactgaagacgtgacatagtttccaacccatcctagccatagacaagagtaccgacccaaccccacctacggccggaacctccgggacaggtaggcaggactgagcccctagcagcaggacaccggccctctgccatgacatctcgactaccgggccgcagctcgtgtagccttcatttgccctaga

SEQ ID NO: 23483 - DNA, 181 bp, Oryza sativa
ccctttccactaggcgcgacagcagtgggagcggagccttttctcttaatatgcagcctatattgtgcatgactctgattttaatttccatggacatttctagtaacaaatatcttaatttgcagtgacaaccttcttgctctgtagtaacacatctttttttctaccttttccatgcaga

SEQ ID NO: 23484 - DNA, 539 bp, Oryza sativa
tttagttcacgctaaaattaaaagtttggttgaaattggaacgatgtgacggaaaagttgaaagtttgtgtgtaggaaagttttgatgtaatgaaaaattagaaatttgaagaaaaagtttggaactaaactcggcctatcactatcacaaacaacctttaatagcagtatctcaaaatgattatttgctaatattctctccatatataacctagcatcgaatgaggcacattataatacattagtactacgaatctatccaacattagtactatggtgtgtctagatttgtaatactatcatatgtctattcagtccattatgtatcacattcaaccataatttcttatatttgggatagtagcacactattcattgtcacggattgattatatggtaaattaaatactttaagaaatacatttagttggaataaaatgaagtggataaaagttcgttaaagaatagtaagcgtggatcaaataattctgaacaataagtaaggtgaaaaagatggagcaaatattcccacgagatca

SEQ ID NO: 23485 - DNA, 298 bp, Oryza sativa
cgggggcaagcttttgtgtgatttcgcctttcaacaacgttcgcctttctccccgttaaacacgttggaagccggaattggactctgccagggcacaagcccactatctgcggaagttccaaaaaacaggtggtgttcaacccgtttagggtaggttctttctccaagtttcccttttctcttccaaatccccaatacaacaaaagttttgtaggttgtatctggtagccattagacttcaatcagtttatgagtactcagttttgttatttcccatcttaatttcagccaagatgaa

SEQ ID NO: 23486 - DNA, 1501 bp, Oryza sativa
ggacactatggaatggttggactattgtggaattagattcacacctcccccactattcaaaatcttcaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcagagggccggtgtcctgctgctaggggctcagtcctgcctacctgtcccggaggttccggccgtaggtggggttgggtcggtactcttgtctatggctaggatgggttggaaactatgtcacgtcttcagtccgtataccgtggtggtatgcggcacgtggttacacgtgaggaagatgtgtcttgtgggtaaagatgtacacctctgatcagagtataatctattcgaatagccgcgcccttggttatgggcaagccgagcaatgtacccaagttagtgttttaattctcaaaacctgcttaacaactaaaatgtggaatggttggcctgggttggcttgggacgagctgggacccagcgtcgggttgccagaacgccgcactcctcgccatcggcactcttcaccagcgctacccggacgagttgcagcactcgccctaccgctaccaccctcgtcgtggaggagcccgcgactacgccatcttccgggatgctagctcggaggatgacgctaccatcatgcacctggcgcgcatggtggaggcgtacgacgcgacccgtatcgacttccatcagatggtgcgtcgtgggttggtcgagaacagcatgaagatcctggagctgcgtcaggagaatctgcagctgaagaaggacctagacgcagtggaggcgcagctgcatcagcttaagatcgcccagggagaggtctgtcgccccaagcgtcgccgcgtctgccgcagcctgaagatcaccgcccgcaagagtacctccgggcccgagcttgttcgtcagtccctggcgtggacctgcttcgtcgagacccctcgtgccgagcccgcgcccgtggttccttaggaggatggagcctccggcgttggcagcacggaggatgcgctgctactcaccttccgccctggcccgtcgcagcagtagacgagcagttagtaggcttgcgtgtgtgttcttctcgtttgtttttctgctagagtcgtatggggcatggttaagccggtgtgtggtataactgtgtcggagcctgtctttattttatttgcttaagcaacttgaactttaatgaaccaatttaatagcagtaataaattcaagaattatggtagtcatgagtggttagttttagttgtcagctctctctgtttgctggttctgtgtggggttttc

SEQ ID NO: 23487 - DNA, 155 bp, Oryza sativa
atgtgtttatagctagcttatagcctactatttaagctgctcttagcaccaggtgaaaatacagatcaaaacaaaaataaacttcactaacaatggaccagccaaatgaagaaagacgagaagaacagaggaccacagccaacagtgggaggaaa

SEQ ID NO: 23488 - DNA, 1501 bp, Oryza sativa
ggattcgcccggatttattcccaaaatcctcgccggcgtctttgatggagccgagatcgccgcgccggtttccttcctctccggccgccctctctcactctcgacgctatataatcgttcctcctgcttcgctcctccgtttccgccactcgccgcactctctccccgtcggattcgagctcgcgccgtcttcctctctctccgccgtcgccgccgagctccggttcgccgccgtcgtcgccccggacctcctcccgtctcggcgtcacctccttcggcttcgccgcgtccccgtcaacctcgtccaccccttcgtttcgcccgccgaccgtcggagcgccgccgtcctcgtcgatccgaaccgcgccgctaccttcctccgctccggtcgtcgtttccgccgtcctcgtcgtcccggggtgagccgaggaccgccgcttcgcttccctcttccctcccctctctcggccgccgctccgccgcgccgttggtcgccggcggcgaccatcggggcgcgggtgcgccgcctcccgtcggccgtgccggcgaggccgccttcgggcgcgccccgcggctgccaggtgggcccggccgtcagccgcccgcgcccgtgggtgcggctgacgcgtgggacccatggcgccggccggcgtcagccgcgtgcacccggtccaccgtggaccgagaggctgacgcgtgggccccactcccgtggacccggtccgcgcgccctctcccccggctgacgcaataaatgagtttttaattaaaatttaaatgaagaaattcgcaaatatccatttaaagagcatataaacttcaaatggccataacttggccatttgaactcggaattggaccgttcaagtctctaattttttccttaagaagtcaagaacccatttttgtgctttgtttctgcttgttatatggggtttagtagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttatttaaattcccgtgttatcactgttttatttagccatgcctatttacctttgttatgaccttattattattgctattgttattattaccttgttcaccctaggataaacaaaaccccaactagtgagtattctattcatggttccactagtatgaatttaggtagatgcttcgctgattaattaggcaatattaggtggttttataactttagactttgggaattctcatatcatttggacactttggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 23489 - DNA, 177 bp, Oryza sativa
caacaacacacgtggaggacatatcaaaagaaaacggcactaagctgttgtgaaaaaagaaacatatacatcagcacaaatctaacgataccgatggagttcagcatcactttctgtcactgtagctatgtccttaccaacatatattattgccttctcttgcctcctctctctaga

SEQ ID NO: 23490 - DNA, 1501 bp, Oryza sativa
aatgtagtaacgtttttgccttaaaaatttgtctatagaagggtgtagttttagagtgattcactacgcttctttaatagtgcttgaccatttcttatcatttgtaaccattgaaccaatagtactcgttcctccttgttttctcccattcttggtttctctccgtattaactccttgttttctcccattcttgttttctctccgtattaataaagggcatagaagtctttttaatctcttggttactatgtatttgattagttaaaactatattatattttttttgggctgagggagtaactaatataacataaaattgtcaacttccgtcctcaatttatacaatatagtaatgccaagtatgtgtttgcactcatttgtgggtgagagaaaaagaggtaaagatgaaatatttaagtagagattttaacatgtaccccaatgtgtatatcacatagtcaagtccattcaatatgtatgcaaatttgataaaaacaaaaatcatcttactataagtgtaaagtttggaggttgaatcttgggttttaaagtttagggcccctttaaaacataggaattttggagcatttcaatcctatagaaaaaattcctatgaatgcatttgaatcaaaggattgaattatatccattcatttgaaattcctatagaatggacaatcctatagagattttggaggaaacttagggccctttgaatcgcaggattgagaaaacgtgggaataggacaaacacggtattttgatataaatgtaagtgtaaaattgttgatatttctgaacgatgttaccaggaatataatcccccgcaatggtgccagaaatattagacgatattcttatggtttacaaatataaattcgcaagtgcacggatataccgttgtaatataaattcgcaagtgcacggatataccgttgtattattttacccgaaagtatttccagggtatcgtatttacttaatcccaaggaaagttatggtcagagagtactatgctataaattcatatcacacttatgcaaatcaaagtctaatgcagggtttaatcaagtcaaggtaaggataggttgacacatagaaggaacagtttagaatactcttactaattaataagtctaggcttagtgaagaagaaataagaaaagcatcgtttctatacttctagtatatcgtcattttagtatacgcttgctaatatacaactatgtggctaatacctcctaactatacccttctggtatatcgaaaaaccacccctaattgttgagttctttatgacaatccgtcatggctatccaaccagttatagatacggaggagtaactgcaccgggaacctttattagacctatatacgtacgtggaggaatacccgtattgagctgtcaccatcagcgtcctacctctacagatctgtggtgactagcaccacttaatgatatctaataatctaggcattgtgcttacattactaaatatt

SEQ ID NO: 23491 - DNA, 1501 bp, Oryza sativa
atttattttgtaggttgttaatcttgaagaatttgggctgtgcagtcacttgtaatatgtatttttgttttacctagttattggtctttgaaatattaaaaaaattttatttttttaaaaaataaataaaacaaaaatatcaagaaagggaaaatgtcaaaaaaataaaaaatatattttctttagctcttgtaaaatatattgtcatgtttcgttagattttgcgtgtgtgtttcttttctttttatttttttttgtaggtgtgtaggtaactccgcctatgtcatcgtaggtataactaaatgacatagccggtccccagcccggaaaaaggaggaggggatagtttggtatagatgtgtgttgaaatgatgctccgttgctagatcattgggaattttctgcacttttattagattaatttcattttcagtgatggaataattgtggaaacatttctggagactcatccacccttattgctctgttggacaaatctgattctgaactatttaagctagcttgaccagaccaccaggtctaagagctgcgaattgacaagtaggtgaaggaaattcagtgccgaccatgacctgatgaggagcaaaaatttttttcaagtcttggagcccaaatgtgcctgaagtcctgaacaacaagatacaattttgctgcaggatcaaacaattttgctcctctcatttgtttcttgtctttacctagttgctggtctttggaagattacaaaaactgaaaaaaaaaagagtgaaaagaacacgaaaattacaaaaaaaaagtcaaaaaagggatacagatccaaaaatgaaaaaaaaaacgtgtttttgttttttgtcttgcacgtgtgtaggtagctcctcctatgccatcttgggtgtgcatctttaatggcattgctagttccaagcccgaaaaagagaaaattgcatatgtaccatcgcgtaaaattggcttcgtaaaaataccatcacttaaatgggcttcgctagaataacatcctgaactgagtacacttcgccactttaccattttcatcatttcttccattttaaatttattttatcatctttgcatctctttttggactgaaatacccctaagtcatcaacgctgaagcacttctggtcccaagcccggaaaaggagcagggggtaatagtgtatagacattaagtgaaacaatgcgctgctgctatctagagcagtgaaagttctcttgaaaatttctgcactcttgtcaagttaattgcatttttattgatggaatagtttactgaaaaacacttctagacactcatccactctggtgctctattgggcaattctgtttctaaactattttagcttgacctcattgcaaaccagttttcatgtgaaagcaatggaggcgaacacattcaccagttcgtcctcctctcattccctgcatcctgtttgagaattgagaattgtgaacactgcggtgtggaggctgcggttcgtca

SEQ ID NO: 23492 - DNA, 157 bp, Oryza sativa
cgcgtcatacagacagggggcccacccctaataaatgccggggcgggggtctctcctctcctcccaagtcccaacccaacaaacaaacagcgacggagaaattattttctatttttttgtttttgtttccggttcgcatccgcatcgcggtcgcagt

SEQ ID NO: 23493 - DNA, 413 bp, Oryza sativa
tttcttaaatcattaggctttgatgggtcattttttcttttgaaagtgctttggtctttttcttggcatgagcctctagtggggcaaactgccagctttatgcttccactacacaggcatgcttgtctgcataagtgcatagctgcatttgaagatcatggaatgtgctttcttttggactcagcacacacacatctgtcgtgattgctcgtatgctatattctcttgagggtttatgagttaaaagacacaattagagttatgtttacagttctactgttacttttcatgattttagcactgacgttttccattttcattgcagcaggactggtagttactgatataaacagatgctgatattgttcatttagtccagttgattcagagacacctcttatgggctataaaat

SEQ ID NO: 23494 - DNA, 161 bp, Oryza sativa
ggagacaagcctgccaagggtatttggaggaattgcaccaatcaggcaagcagctggtaccctaagggcatatatgcgtgatcggtccggcgagcaagttacaccatgccatgagcacaaagaaatgtttacatcccaattgagtttgttcccacggtaga

SEQ ID NO: 23495 - DNA, 1005 bp, Oryza sativa
  unsure (1)..(1005): unsure at all n locations
aaaaactagacaaattttacacaaaaaatattatcttaaaaaataaaaattaaacttggtgaatatacattgtgatttccgttaccacacactaatagcaaatccctgttgccgaacgtaaaccgacgataatgcaaaccctggacacactatgccaattattgatccgatcgaatgggtgaaagcaaacaccccatgcatctttaccccttttgcacccatgcattgcttgtgaaaaactagtgactacaggcgaccaaagccccatcctgccatccgtatccaatgatcgatgtgactaatttttacacccgaaaaggcgaaaatataatgagcagctaggttgtcgcacgtctttgccgggataagatcggttagttgagagctgcacttcagctagctctcccctgatctgttcattcatcacagaggcgagatggatattcaccaacaaagctaaaacataagggatccgatcaacataatggatagacattgcactttggaggcattgtattattacacccnctagctaacataacatactacctctttntcaaattataagactttctagcattgcccgcattcatatagatattaatgaatctatgtatatgtatatgtctagattcattacatatatatgaatttaagcaatgctaaaaaatcttataatataaaacggaggaagtagcctacatacatgtacaacatgtgtgagtgcaacttccctccttttttttcagtatctttttttttttgcgccaaagtcaccatttggactctagctctcgcaaccccggcccctctccccccccggccggacaccgtctatacatacacgcacaacactgacgaccagctgaaacacgcgcgcgcgcgcccacacacacactcacattttttttgcacacacacaaacacaaacactaggaggagaagcttagttaattaacgtcgtaaagagagtcgtagtgagtgagagagagatggaggtgggca

SEQ ID NO: 23496 - DNA, 1379 bp, Oryza sativa
agcagtgtgccgcaacaactagccatcctcgagccatacattgagggacacatgaacgagataagagcatgcaaccctagaagaccggcgacttggatctcaaaggaacagaagcgcaaatttcctgaatgcctgaaggaaaaaacatgtcgttcggtgaatcgcttgcacaggttggcaactggcccaagtagcctcatgaactcatggcaatggtacgacatcggcggatatacattttacacgataggcaagaacaagaaaagtgcagctcataatagtggagttcgtgtggaggcgttggacgcaataggcgagaagaagtcatactatggataatacaagacatttgggagcttgactatggcattaacatccaggtcccggtgctatgatgccagtgagtcaaagacacaacaggcgtatccatcgattactacggccttacggttgtggaatgtagtaaactaagccacaaggatgatccatgcgttctcgctgaatatgttggacaggttttctatgtgaaggacccatccaacgagcggatggacattactgtagtgggaaagcaacacattattggcatcgataacactaaagacgtgtcagattacaaccaatatgacgacgtcccattattcacagatattcctaaccagatcaagcgaattgagacaacccttgacgaagagaagttttcgtctgtgcggaaggatggtgctgcgaaaattgtgaaacattagtgtgtatatatatctatatatatatatatatatatatatatatatatatatatatatatatatatatatatatatgttgttgtgtacaacctgttttgaaaacgattaatgtatccaacttatagcctcttcaaacgattaatgtataaaacttatggttccatgtttatctgtactatatgtcgttctcaagttatatggttgaataattaagatgtggtttgatcaatatacaagcgatttaattagatgcgattgaaattcatttgtggttaaataattatatttctatggttgaataatttgttggcattaatcatatggatgaataattatattgattaattaattaagttgtggtttattaactataaccctttttagttatagttaaagaattatagttaaataatttatgggtttaattaactataactatatttaatttgtggttgaataattatattgattaattaactatatttagataggatttattaatttatctgcatttatttttgcgtccgggtggcttaagccgcccgcatgaaataatatcatcccgtgcgggcaacttaaaccgcccgcatgggaatatcgattacccgcaggtgataatatggttacataagc

SEQ ID NO: 23497 - DNA, 797 bp, Oryza sativa
acggcggaaacgacgaccggagcggaggaaggtggcggcgcgtgtcacgtcctgataaattcatcccgaattaaaaatcattcgctaaaaggaataatagaattaattaaaattcgaaaagaaattggcaaacactaaaatacgtaccagaaaaattcgaatgtggcccggagaatttttgttaaattctccttggtctaaaaagagccctcaaattttacttgaattttcagagcaccggaaataattattaagcaacaaaaacaattaacaaagtttattaaaaagaaaaacctaaaaataaccttccttcctcctttgggccaagtttggcccaaagtcctccctctctcccctcggcccgcggccgaagtctccctttcctccctctctttctctccctctccttctctccctgctcttgggcccctcttcccctcccggcccactccctcctcctccctctttctcccaggccgccttcccccctcctctcctcctgggccagccgcccggcccaaaccgcgccacccagccgccccggcccaagctgagccgctcccctcccgcgcacgtgcgtcgcacgcgcgctgagcgcgcgcctggccgcgcggggcccacacgccaggccgccgtcgtcttcttcctcctcccgcacggccctctctctctcccgtgaaaaccctacttcgttcctccctcgaatccgcgcgatttaagcgttggattccaaaattaattgggggcttttaatccccattgaatcctcttcaattccccccaatttcccccttgaa

SEQ ID NO: 23498 - DNA, 1501 bp, Oryza sativa
tctcccttggattcatttggaaaccctcccctaatcccgccggccccattgatggagcccgagagcgccgcgccggtttccttcccctccggccgccctctcccccttccaatcctatataaaccctccccgcacctcctccgttcatttccgcctctcgccgcccttcctcctcgccggaatcgagctcgcgccgtcgctctctctctccgccgtcaccgccgagctccggtccgccgccgtcgtcgccccggaccacctcccacctcggcgccgcctccttcggctttcgccgcatcctcgccgacctcgtccacccctccgtttcgctcgtcgaccgccggagcgcccggtccccgtgacccgagccgcgccgccgccttcctccactccggccgccttttggtcgtcgctgtcgacctagggtgagccgtggaccgccgcctcgtttccccctttccctcccttctctcggccgccgctccgccgtgcctatggtcgccgccggcgaccataggagcgcgggcgcgccgcctcccgccggccgcgccgcagtggccgccttcgggcgcaccgagcggctgcctagtggggcccggctgtcagccgcccgcgccgtcgggtgcagctgacgcgtggggcccacggcgccggccggtgtgagccctggtgcacccggtccaccgtggaccgtgaggctgccgcgtgggtcccacccccatggacccgctcggcgcgcccccttcccttggctgacgcaataaacttttttttaaattaaaatttaaatgaggaaattcgcaaatattcatttaaagagcatataaacttcaaatggccataacttggctatttgaactcggaattggaccattcaagtctctaatttttccttaagaagtcaagaacccatttttgtgctttgttcctgcttgttatatggagtttattagagtaaaagccttttcttttccgttggtcgtgtagacgctgcagcttcgcaagatccgcttttcgtggaagttgaagccgacgtttgggaaagcgagcaaggcaagtcgcatcatccttgaacatatagaatcccagtttataaaattatgttgatttaaattattgcaatatcgctttatttaaattctcgcgttatcactgttttatcttgccatgcctatttacatttgttatgaccttattattgttattgttattatttccttgttcacctgagagtaatcaaaaccccaactagtggatactctactcatggtaccactagtatgattttaggtagatgcttcaccgcttaattaggcaacattaggtggttttacaactctagactttgggatactcttatcacctagacactatggaatggttggactattgtggaattagattcacacctccccctctattcaaaatcctcaaaatggttttaggctgggctcggggtgcatggttttgatagtagcacctcggccatataaggaccggt

SEQ ID NO: 23499 - DNA, 1501 bp, Oryza sativa
aactcaagcgtgaggattatatctccaatttggacttattccggatacattttcacatggattcatagtcatgagtctattttctatgtcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcatttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatgcaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 23500 - DNA, 371 bp, Oryza sativa
cgcctcatgtttcccctttctattaattctactcaaatgatctattttatcttaatatgaggtgctctgctgatcctttatcaggccaggtcctttgatcaaacgcttgtgttaagaagacgcacggactaatcaggtcgttcaacccaggccttgatctcatagttggcttgtcattctgcaatccgataatctactcaaccatgttagtgttgtttctctgcatgacaaggtgcaactctgctcatgtacacatgatgttatggctcagtagttccctctgcctcccaggcctagctagctacatgcagttttggtatatctaaactgtaatgttcatgcatggctactggacaaatggacatggagga

SEQ ID NO: 23501 - DNA, 1501 bp, Oryza sativa
cctgtgagtagtggttagatgatgtcacctagccgttatatttatggatatcgtccccagctcaccttttggccattccacttcagttctttcaagtcctagggttttctagcctttcccaaggtccctttgcttcctccactcaaatctagagcctatcttaagatattgagagaatagatgagagtgtaggagtgatttggagtaggtttgattgagcactttggataccttgggcttattactcttggtgatcttctcctagacggttaggtgtcgcctgtgaacttccaaagatcttgtggatgtcccaggaaggtttgtgaaggtttttctcacctccgcaaggaaacgaggtaagtgagtaaagattcttgtgctgagttttcagaggttgtcctaggtagagcaacttgcacttgtggtcttttctagaaggaattgtgagttggatcttggtggtcactcaattctagaagagagaatccattctataccactgagtttgttcgagttcaatgatttgccatcaacattgtctctttctataatataccggtgactttatcaattgttctacgatacaccattgggctgagccttttttaaaaaaatacccaaaatgcccttatagacatacaaggttaacaattcatttacctcattagaagtttcagaaaaatatgaaaacttttatgtggcctccttatacaacatggaaattcgtaaagaagtttcaagttttttacatttctatttttttataaaaaatataacttatttgttatatgccatataaaatacttttttattgttgtttttaatataaatcatctttcataaactatataagatatttttgtgctattatctcttatataagcatattttctctcatatacgacacaaaatattttttttctaaaaattaaatataccagaaaaacttgaaacttgtatacaaacttctatgttgtgtacgggggccacataaaaaatttcatatttttgtgagacttgtaatgagttaaatcaattgttaattttatgtttgtaagggtattttgggtatttttgaaaataagacctagcccaatggcgtattatagaacaattgataacgtcgtcggtatattatagaaagaaacaatgtcgatggcatatcgttgaactctaacaaactcggtggtatagaatggattctctcattctagaaaatgacctagaggtgttgagttcaaggctgtggacttcttctaggatctttgcataagtgaggcaagggttaatcgagacctggctcattggagcacctcaacggagagtaggatccgtgtgatccgaacttcaggaaaaaatctcatttgtctctcttgtgcatgttatgtggttgtgtttgatagtactctgtatttctctgtgcttgaagttacttagctaggacctaaatttccttgctgttttcaatctattatgtcacccggaagttcctggctcaaga

SEQ ID NO: 23502 - DNA, 552 bp, Oryza sativa
cctgcagccctgtgagattctcataccaagagatggtacggggtatggggcagtgagtgagggtgatgttaaagggatggcctggatggagaaagataggcaatgggtagcaggcggtggagacaagtaggtgatgagggtgtcacggtggcgctagagctgtagggatggaggacggtgattggggcagcgctagaggcaggggtgatttgttggattggttagggagaggggttacggtgatagaccggggcaggagaggcatgataggggaaaggcatcggaatggaagaagactagtgagagtggtgtgtggagaagaaggaagggaggaagacatttgagagatcactatcaggggcggttctcgatgtacgaaaggaagtggggtggagagaggcatagccatgggtcgtgcaatgtgatagcatgagcattctcattgagatgggattgggaagagggagaggaaggagggaattagattagtatagggttgttgacgggggatacccgtagaccagatgtatagggtattggggtacgttggta

SEQ ID NO: 23503 - DNA, 366 bp, Oryza sativa
ctagcagcttatttatacggtcttgtaaagtaaagaattaagatcagagcagagtatttctacacaaacgataattttagtgcaaggcattgaactagtcagaagacgtatgaacaaaattgaattaaaacattctcatgattagtacatatatacaagctgtaactacatctttgatattataatagggtttgtgtgaactaaaattttgtgtttcattatttgcttcagacattgtatgcagatattgttgtatatatgcttctttaattcccatggttgtaaaacttataagtgattactaattgctttgttcatatctcccggccgtcagaattttcatttcattatctaataaaaaaatga

SEQ ID NO: 23504 - DNA, 1501 bp, Oryza sativa
ctagttttctagccgttgcacagtagcacggtctgaccggccacatacctccggtcagaccggcagagcacaaagttgggggatttcacccctaacggctagttttggtgggtgggagtataaatacttccccaccagcagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttagaggttgccgcctcctagacggcttgtggaggagttgcccggtgacctctccgagaagattgtggaggaggcccggcgtcggtttgtgagtggtttggagttcagcaccttcggagtgaaggaagaactaccctagtgatcgaggcttgggtagtcctctccatgggccgctcccgccttgcccaccccttgacgaaaggggcgtgcggtggtttcgtggttgagcggtggagttgggctcgcctcaacggggtgtaggaaacaggcgagtttccgaacctcggtgaaaaatctcttgtctacttgtctaatttgattgtcgcatttacatttgtgcaatttacatttctagagacatacttgagatcatatcaccctaggattgctaaacattgacataggagtgtgatttacttttcctagagatataattgagccactatcaccttaggtttgcaaaacataacttagttacttagttagagttgacccttaccaagcctagcaacttaggttagttttgattaggtgtcatttagttttaaatcgcctattcacccccctctagttgacctctcgatcctacaagtggtatcagggcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgtggatgtaggctttgctatcaacggcacacccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcatttcgtcaagatccaatatgagacattctccatgttgcctcatgagagtgtgaatgacatgtatgggaggctcaatgttattgtgaatgatctcaaggggcttggggcaaactacaccgatcttgaggttgcccaaaagatgcttagggctctaccagagaagtatgagacccttgtcaccatgctcatca

SEQ ID NO: 23505 - DNA, 231 bp, Oryza sativa
agtatgaattagggtagatgcttcgctgattaatagaacaacattaggtggtttaataactttagactttgggaattctcatatcatttggacattatggaattgttggattatggtggaattggacatacccctctcttcctctctcaaaacccctaaaacctgttttccggtggggtttgggtgcatgccagttgtgggaagtagcaccccggccaatataaggattaa

SEQ ID NO: 23506 - DNA, 435 bp, Oryza sativa
atatatatatatatatatatatatatatatatatatatatatttgtataatgattttaataagtcaaaaacagattgatgcatttggaaggaatgattaataaagctgtgttcaattgtttctgggacaattaatcttcaatcttttttttcgccgggacggcgaagaatgctgaccgatgtatattaaggaaaaggggaaaaactgtacaaatgcagtacgtcagagcaccgcctttacaacaaaaagcaaattacaaaatctgtaatctttctaaagctggcactgcagcaacattcaacgaggtaactagccctgctgatttccaagtttcccattcatcacacatggtcgcacacaactgcgtgaccgacgaggccgttccctcgaaaacccgtgcgttgcgctctttccaaatcaaccatgtaacgagga

SEQ ID NO: 23507 - DNA, 198 bp, Oryza sativa
aaaagatttcgtctcgcaaagtagtcgcaatctgtgcaattggttatttttttagcctatatttaatacttcatacaggtgttcaaacgttcgatgtgatagggtgtaaaattttagggtgggatctaaacaggccctatattcttcactgccagtgccatcaaccattcatcttctattcttctatcatgttgttta

SEQ ID NO: 23508 - DNA, 1501 bp, Oryza sativa
tgctgctgtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgtaagggggtacaaggggataataatataggggttaagttttgcagtaaacagcatttaaaagtcacttagttgcccaaagccatttataaagacgatcctagagctacacagtattattaaacaaggccgtgaaccctcacgaacctgccttaacccaaggcctacgatgattcagaccgaaatggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacc

SEQ ID NO: 23509 - DNA, 188 bp, Oryza sativa
ctcgttggttgttgccggggaccttgaaaaatgaatctaatcatcgtcgagtttccgtttttatggtttgtacaagttttcatcgagcggatttagatttgcttggttgctagggtttatgccatatgcttttgcagttttgtattgcacgtaaggaagcaggaagaggacgagagttgtgtcgattg

SEQ ID NO: 23510 - DNA, 160 bp, Oryza sativa
gtcatatcccaccatgggccaagatatggtttgccattgtgtaatttgtgttttttttctgttacacataaatgtagcaatgcgctttgatgatcaaatatttttgaataatcagatagtcaaattggcaaagtagatatcttaccatgcccaatctgtt

SEQ ID NO: 23511 - DNA, 1501 bp, Oryza sativa
caaatgtctctttggttaatcacttgattttcttttccatcctcaggttggttattaactcgaggttagaacatagttcctctaaaatgagaccctaggtctcctttgacagtaaacaattatacacataatcccatatcagcatcttccgaaagagtcctcatagaacttgtttttattacacatttctcccttattacatgaatacaaggccctaccttaaacaaaaagggaaggtgcttaacatcggtacattgcatcctcaacatgaatcatccataaacatagcaagctcactgtttatagacatgaatatatttatttattacatgattgctgcaaactttcgattacagtgataagtagcgaactgaaaatcacaaacatggttactcattctgattctggagagatatagatggcattgttctagttactgcatcatccttgattggttctgtgatgatgtgataggactgcatattgctatcattcacaggagaaaaattccttctgattgctggttgaagtggataacggtcttctgcttggtatcaccctcctgaggttgatttcccttcgctcggcctggagtaggtcggggagagaaacaacttcttccatcgacgacaattcattgctgaggctgtcggtgccgagaatggttggtgctgaaggtattattgctatgatttattgcagagtcaagtgcagcaggaggagcattggtgctgtggatgatatcgtcgatattgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagtgcaaagtgtgatacacatgctagcaacgtgtccaatttctccacatcgggggcatgcctttgattccgtctcttcctctcagacatgtcggggagactcatcttcatcatgcgaggagacctgatctgacccttcactatcagatactctgccaccatggattagaaggtgctgggtcaactgacgggcacctcgaaaggcatttcctctttgacgtgtagggatagttatccttgctggaggccattcggtgctggtaatagtcatcttacgtacttcttcttcagttcgcatcggtgcttttctcttctgattcttactcttctggcctttggcttgcttagtatgtgaccccacgtggtacgaaaagctaggaggagagcaattcccgggattcaatggattctctccattaggctctctcctttgtacactaggctgcaagcttgacttggtgcgaggaggctggtttagcgatgtctgccctgctaaaccaaaggaaggggcttctttggcatatacccatggacaattcagggcatagtgtccttgctctctacaatcgtg

SEQ ID NO: 23512 - DNA, 445 bp, Oryza sativa
agaggagggggggaggaaacggcccgggagagagaggagggggaggcagtgggccgggaggggaagaggggcccaagagaaggagggagagaaggagagggagagaaagagagggaggaaagggagacttcgggctgggcttggcccaaaggaggaagagagattatttttaggttttttctttttaataaactttgttaattgttgttgttgtttaataaatatttctggtgctctgaaaattcaagtaaaatttgagggctcattttagaccaaggagaatttaacaaaaattctccgggccacctttgaatttttcttgcacgtattttagtgtttgccaatttcttttcgcattttaattaattctattattccttttagcgaatgatttttatttcgggatgaatttatcaggacgtgacaaatccaccccccttacagg

SEQ ID NO: 23513 - DNA, 1501 bp, Oryza sativa
gacgtcccgtcggtcgcccggctcgtcgtctcgcggcgccgcctccgtcatcgtcatcgcagcggcgtgttccacgccgtcctcgtctccgtgcagccgctgccggctgccctcgtcgcctcctcgccggccccggtcgtcgccgtcgtcgtcctctcgtcgttcccggtcgtcgtggcgttcgtccctccgtcaagccgttcttgtccgtcgtccgcgtccgtcaagtgtgtcgctgcagcccccgtcctcgtcttcgtcctcgcctccgcgtcgtcaagccccgtgccggccgcgtctcgccttcgtccaaggatcgccgccgaagtcgttccctcgccgtccgtctccgccgcgccagttcgtcgttgtcgttccctcgcctcgtcgcgtggtggtaaggttccctctccctcgctgccccgtcctcgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtctttccaggctagcgcttacgcatgttttataattgcaaagcttaattataataatccgcaaatctctatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagctttcgtcgttccggaggttccagaagcatggttcgcggtcgtcgccaaaggttcggaaggccgttctctctgagcaaggcaagtcacatcatcgttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggacattatggaattgttggattatggtggaattggacatacccctctcttcctctttcaaagcccctaaaacctgtttttcggtggggtttgggtgcatgccagttgtgggaagtagcaccccggccactataaggtttaa

SEQ ID NO: 23514 - DNA, 1501 bp, Oryza sativa
ttatttagccatgcctatttacctttgttaagacattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggacattatggaattgttggattatggtggaattggacatacccctctcttcctctttcaaagcccctaaaacctgtttttcggtggggtttgggtgcatgccagttgtgggaagtagcaccccggccactataaggtttaagctcgggcctctgttgcaaagcactaccgtacttccacatgtctagtgggtaaggcgtagtttgtggctcagtctggttataaacaaaagtacacggattagagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgggggttcacggccttgattaataatactgtgtagctctaggatcgtctttataaaatggctttgggcaactaagtgacttttaaatgctgtttactgcaaaacttaatccctacattatgatccccttgcactcccttgcattaattgtgcatttccggtgtggcttgctgagtactgtgattgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaatgcaattttctcggtagcgacaagctggtatcagagccatctcgactgtaggataagccaagtggataaaacctaaggacata

SEQ ID NO: 23515 - DNA, 507 bp, Oryza sativa
attgcctcttttgacagaatataaccttcagccttctgttcttgatgctcaatcaattgttagcaatctgaaggtatgtgccatctctcttatgcacacttgataatattatatccttgtttgttcttgattaagccccaagttttcaccaaaaaaatctatattatcttcaatagcgattctctatgatctgaagttttttaaatataaaaaaatgttcaacaaataaaagacaaatatcttctctaacataagatcttttatgaattgtcttaacaacaaacatggaaccactccttgcagacctcttgtcaggtgggataagagcaagctatcctttttctttatttttgttttaatgccaatattgtaatattactgcgcattactgcatatttttgttcttgtggggaataatcgttggaaaggtacacgagtgggtttgatcttgttccttacctagttgaagttgacctttcactaaacacttatttttctttttgtagg

SEQ ID NO: 23516 - DNA, 1349 bp, Oryza sativa
attcctgcaccccagagaggtgcgacggcacacgactctcgggcgcactctgctccccagatagtttcctgggcattccattagactggtcggtatctaggtactttagcttgatggcatcgtgcagcatttggtcagtgtggtgaaagagtccattgtgctgatcagctagagcggtcctggaattgagcgacgaggaagtggtaccgaagcatgttgaggtcccatggggagaagttgaaaaggtgtcggcaagagaagtgggcttggtagcctctgacctctggcagagcagcagatgaatgcaaatcaatactagtacctccgacgagtgttgcagtactagttagttagttagttagttgtgcgatgcggatgtactccatattattgtaaggtgagattcgggtggagaagaagagacggagaggaaaagggcagatcggggagccgcttacgaatctgtcaagctctcgcgtcttgagcatgagctcgtccttgaggcggctgttctcctccagctgagagagagagagagagagagtgagtgagggggagggggagggggcagaaaaatgaaaaatgaaatcgtaatgggataggatacctgctgccggatggtggcctcggcgtcctccacggcgcgcatcacctggaagaggttgttgtttgcgctgtcggagtcggagaccgcgacggcggcgagcctcctgccgagctcgtcggcgtcggccatggcccccaccaccaccaagcttgtggattccagagattggtcagactacgataagggaaagaggaattataccgacggcggcggtgcgaaggcgccacacgggcggaggaggggaagggacgcgcggcagcgacgacggtgaggatggggggcggcggcgcggccggggaagggccaagatgcggcccgaacaacacgacacagccttcttcttctttttctttctttctttttgggcgatatgaaaggcaaatttgcttccatccaggccatctatacttcaatcaacggttccatttcagtgacttactccattttagcagccagccaattaactagtaatagaatttactctctcaaaaatattcaagaaaacaaacaatcaaatacaactaatacctccctcgccttttggagcaacttaaagaaaagataaaatcaataaattgcaattttagtgcaagaataatcattcgtttatacaatagcaaaataattatcccacctctgtattaatcatccaccaactctcttgctaaaagcccccaaaaaaaacttttcttttcaaaaaaataaattatctacattgtatagtagtattttatcaaaacaa

SEQ ID NO: 23517 - DNA, 1501 bp, Oryza sativa
gccggctcgtcgtctcgcggcgccgccgccgtcatcgtcatcgcagcggcgtgttccacgccgtcctcgtctccgtgctgccgctgccggctgccctcgtcgcctcctcgccggccccggtcgtcgccgtcgtcgtcctctcgtcgttcccggtcgttgtggcgttcgtccctccgtcgagccgccctcgtccgtcctcggtgtttcgtctaggtcgctgcagccccgtcgtcgtcttcgtcctcggctccgcgtcgtcaagcctcgtgccggccgcgtctcgccttcgtccaaggatcgccgccgaagtcgtcccctcgccgttcgtctccgtagttcccggccgcctccgccgcgcccgttcatcgttgtcgttcccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcgtccttgtgtgcgtgtggtgaccgtgttagtgtgcccgctcggtagccgcgtggtttccacgtgtgctgcccgtgtggtgtctagtggagtccgtttgtcggccactcgcctcggttgacacacggggtccgcttctgtcgacccgtggaccgtctctgtgtacctggtctaccgcggtcctttaggttgacatgtggggtccgcatgtcaacagcgcagccttcctgtcttttccaggctagcgcttccacctgttttatagttgcaaagcttaattacaataatccgcaaatctccatataacagcattaaacttcggatgatcatatcttggtcatacgaactctgaatcgacccgttcaagtctcctaatgtttgttataacctaaagaactgtgtgcttcctttttatgtattgttattgcttctttataggctggtagctttgcttgtgtgcttcgcgtagctttcgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcagtaccgctttatttaaatacccgcgttatcactgttttatttagccatgcctatttacctttgttaagacattattattgctattgttattattaccttgttcaccctaggaaaataaaaccccaactagtgggtactctattcatggttccactagtatgaattagggtagatgcttcgctgattaataggacaacattaggtggttttataactttagacattgggaattctcatatcatttggacattatggaattgttggattatggtggaattggacatacccctctcttcctctttcaaaacccctaaaacctgttttccggtggggtttgggtgcatgccagttgtgggaagtagcaccccggccaatataaggattaa

SEQ ID NO: 23518 - DNA, 1093 bp, Oryza sativa
atttttaatgggtggcttttgggagttgataagaaaataagtaaactaatacttgttggagcttctgccatttgttgggcaatatggctgagtaggaacgatatggtttttgacaaatcaccatcattttcctatatgcaggttattttcagggtaactcattggctccggttttaggcacaactacaaaggtatgatgaagatgaagagtttctgaaggttgcatgccgaaagttggagaccacggttatgcaactatttgctaattatggttggagatttacaaatagacttcaataattgtgatctccttacgttaggctggtttcaataatagtgatcttcggtgtgttctattcatttagatttacactatgttcatgaaaactactatgtaataattggctgtagctcttttgagtaaaagccgggatattatattccattatctaaaaaaaatagatgtatatagcagtaatatgctattctattcaggccaggatctaccatgcatgcatgcattgtttcaaactttatcaattgatctgattggcacatgaaaatctctatatatatacacgtaaatgctagacttccattgttttatcatttgcaatacattgtgaataaaactaaaatcatatttatacgtgcaagcacttcattatattacttccttacaaataatggtgaaaccaaatctacacttttaaaattacggaaatgctagaggacgggatcctatcctctgggcggtatcacctcatacacaacgatgtgctaagtttgagccacaactctcacctccgtcgcagtcgcaccttgctgttactaattcgtcaagccaacgcctcctcgaatctggctcttcgctgatttctccgttggcgtttgccccgattaccactcatgttgatgtgatagatgtgggcacacacaccggcaacagcttcaccttgatgctttgctggacgagacagtcgtacatgaacaccaagagactagaacttgaagcaaccatgagctgatgtcaccggttgtctttttcttccaagcctcccacaggggtagctatgtcaatatgacaccgcca

SEQ ID NO: 23519 - DNA, 706 bp, Oryza sativa
gccgtgcctattgtcacgtccggataaattcatcccaaagtaaaaatcattttctaaaaaggaataatagaattaattaaaattcgaaaagaaattggcaaacactaaaatacgtacaagaaaaattcgaatgtggcccggagaatttttgttaaattctccttggtctaaaaagagccctcaaattttacttgaattttcagagcaccggaaataattattaaacaacaaaaacaattatcaaagtttattaaaaagaaaaacttaaaaataaatcctcttcctcctttgggccaagcccagcccgaagtctccctctcctccctctctttcccctctctctcccgggcctctcctccccctcccggcccactccctcctcctccctctctcccccgggccgcctctccctcctctcttcctgggccggccgccaggcccaagccgccccctgcccgagccgcccctccttctcgcgtgcacgcgcgtcgcacgcgcgctgacgccgcgcgccccgcgtggggcccacgtgccaggccggccgtcgtcttcttcctcctcccgctcagcctcctctccctctccgggaaacctagcgccattgctcccccaaatccgccccgaatccaaccgttctttccaaattaattggggggttttaatccccattgaatcctcttcaattccccccaatttcccccttgaa

SEQ ID NO: 23520 - DNA, 1501 bp, Oryza sativa
actcgtagtcataatgggtcgaaccaagctaggctttagctagtgagcttaacgagccagcttgtgagctgctcatttagctcattatggtaccacatatcaccatatcttcacttactgcttcttaaccatagatttagcctttaattaccatatcttcgctattatttaatgtttattattaaatttatatatgataaatggtaaattaaaaatataaaggtgatataaatgcgttaatgagcctaacgaacaagctcgtgagctgagctgagctaagcttttagttctctaaggttaacaagtcaaaccgatctagctcagtatccgcccctaaatccctaatattgttatatcttcctatcaacaactttcagactcccctatttatatgcggagaagatagcatgttgagttcccatcatccgcttattgcctcataagagcatcaccaacaaagtgccaaaattcaatcccctaaaatcttttgtatgagaatctctaatggaattcaagggataaaaatatcctcccctcccaacatagtcaaatttaacttctcaaaaaaattgagtcatgcgagaaacttcgtaacaaaatcggacctcttcttgtactcccgtgtgcaactcctcctcttggtgtgcacgaacttgcaattggagcgattgcctctcccaacttgtggaaagctagatttaaggagaagggaatgagtttagagctacctttgtagattgatttttgcttgaaacacaagattaagggattggtgttagggtcatgctctaaaccgcaaccaaaatttaaagagaaaatttcttatttgccaattaaagttcacgagtttccttatatgccatcgaaaatttgttatccctttatatgcgactgcttgaacttattcttcccctatatgccatctatgttatcatcttgtgtaatagggatgtaaaagtacaatattaccctcttagtccctcgaggggatgtctactctcttttttgcatgtcatctaaataattacaaaaatacttgttttaataacatagaaataatatgtgatatatcactaaacaaatatgcaagtttaaatttcacttttacattttttttaaaaaaaaatcaaatttggttatgagcacacctatactagttccaattaaatttgttgtttgcgttacttctattttgccatgttggatcttaattatgttgaacagaaggtatatataatggcttattatatacgtgatgagataagacaggcatgtaactagctagccgcgtatcaaggaacgaatcgtattcatttgggcttctcgattgagagtcgggtcggatcatcgtataaacaatgtataactactactacatatataaatatacgtactataccgtagataagataagtcatataattaaattaaagaagagtagctagctagctagggtaccaaaatatataattaagcagatcgatcgacgagacgacgacga

SEQ ID NO: 23521 - DNA, 672 bp, Oryza sativa
acacggctatcgggccgagccggcacgggcacgacctgagtcgggccgtgccgtgcctgggtcgggtcatatggccatctatacgcggagaggacaccttggattccactagcctagcaagtcccaattgatacgtcggctagatccccaactccgaagttatgttccccttatgttatactccctccgttacaaaatgtttgacgccattaacttttttaaacatgtttgatcattcgtcttttaaaaaaattaagtaattattaattcttttcatatcatttgattcattgttaaatatacttttatgtatacatatagttttacatatttaacaaaattttttgaataagacgaacggtaaaacatgtttaaaaaagtcaacggcgtcaaatatttagggacggaggtagtattaacaatcgttgagatgtgttggttttattcgtctagcccaatctgaccgtgacctattctgttgccatctctatgcaagatacaaccagttctctgttatccaatgagaaaaggaaagaagtattttctttgaaggtaggaaaatcttagcatttttgcaaggaaggagtgagagaaggaggttcggttcggatcggatatagtgcagcagcatataggagagagaggtacgtggttgagcagtgtctgtgtttg

SEQ ID NO: 23522 - DNA, 1501 bp, Oryza sativa
tctcctccctttctcttttaattaaaccaaactaatagcacatgcatttcataatctcttttagtggttctcattcaaaatttattccaatgttattagtactgtacatctattactgtactaatggctcatttaccagcaaaagttttacaacattgttttatttaatcttgctgcaatgaaataaacttagcgtgttgattttataactttcttttattttatttcttttgaagcctgttgttcaaaagtgcaaaatttgtgatcttgtttccaactgtttcaacttatcttgcaagcttggtttactttatttacttaccttttactttgattttctaactttattcaaattaatccaaaaacttgtgctattaattggataaaatgtcttaactccctcctttcacttgtcttttgatgccgcgcttcaagcctgagtacttgtttggtgttgagggatttgtccaggagttgcatacgatgtcctttgccataggatttgggactgcccctttgtatgcccagattcctcatgatcgtgatgaagagaagtgccgagtcaaagtcaccatgaacagtaatagtgaagatatcccatcagtgatgttcgaagctggaggaggaaactacattcatgcatgtcaggaggtggcaaggatggccataggagagctccgcgatcgctacagtgatcagttggccgacactgagtatcgctaccatcctcgccaaccccagggaagtgaccgtggcagttaccttgagactgtggggattgagaatgatgctaccacaaggcatttggttgagatgctgtgagctatggatgagacccgcgcggagactgtgttagcagctcaagatcgtgaagaccagaatcgtggtaagatttgcaagctagaggacaaggtggatcatttggagaaggaactagccgcgttgaagggagaagcaccaccgcagaaggccagggttcgtcttaccgcaaggaagagagctctattcgtccctcgctaccaattggcgccaaaggttcgtgtggtggagaaagaagttaccccagccctagcggatcctccggtcgtcaatgtaagtaatgatgataaagaagaatccaagcgcacccattccaagatcgagtggggagcaactcaagatgatggagacgaaccgaacgagccttcaatcaactccgatgcccggaagacctagaatgccttgtcaagccattgtctttgatcgttgtgttagtttgcttgttttaagtttggttgtgtgtgtctcgcatgtgatttacatcagtggtgggatgtaagcgcatgtgtttgtttgctttcgagtgttaggtagttggtgagtttagtggtgtgagagtcttcagttctgtaataatgaaactcagttaagatcaataaaagttaagttagtagaaagattaattctctgtcctaagtagtttttcctcggtttctcttcttgtgatcctgcccatgccaga

SEQ ID NO: 23523 - DNA, 1221 bp, Oryza sativa
aaataaaggttcaggaccacaccttactccctgaagacctattatcccctcggtgtgcagcagatgtctgcagaaagcataaacattattaagatagtagaaataattaggatagaagatcaaggtccagtaggaggcattcttccagcgttaaccgcacataaccacaacagaagatcccgcaaaaaagggcaacacaaggaagatgacaaaaatgaactaatgacattattattcatttgtacatacacaggagcatgatcgattagtgcagtcttgtttttacagagggtagaacacagttgtaacatagtaacatattgatggcagatcttgaaacttgaaagcaggtcaagttgagctattagaaatgctataaaagtatgttaaacatgagaaatatattatatttgaagatcgagctgtactactttgagaaaatctattcatctgagggttaaaaaaatagcccagtttataaaaatgacctaaagggccgcaccagctaaatacaattgaacagcttgccatgggcttagaaaggtactagtatatgaaaagaaggtatattgctcgacaaatttattggttgatgtgcgatatttggttatgatttaaaggagttcattggctgaaatgtgatactgttaaaggctagataggaaataattatttcttttgagatataaggaagtaatgtgacatgggcaccacaaaacactaaattgtgcctaaaattgatgcccagctaatttcagcaaatcttgatttacagcgtgatcagttgcctacctcaacgtacgatcttgaaaatgatccaggtgtagcttcattatgtgttgacgcaaatgaaggcctccctgctcaaacaagcagctaatggttgggaaaagtagggtaacaccagagacacaccaggcgcgcgcgcacaaagagagagagagagagagagagagagagagcaggaaggaacttgaagttttactgacctgagccaaaatcactgtttggcacaccatacatattagtttgctacaaaaagggaaatgagtcagatattcctgttatcttgatcacgttattggagtggaaaaggaacaatgtacaacacacctgagaggctctccatggagtgttaactggccctaaaagtcgcaaacaatatggtgagactcatagttatcagggttaataattacattcaatcgtaaaatgaagtga

SEQ ID NO: 23524 - DNA, 1501 bp, Oryza sativa
tgaaacattaaccatgccaaccacaagccagcgtgggcaatggctttaccttttgtatagcatggttcattgcggagcaccagactgagaagtggcggagataagcccacgggggtcgctggggagtccatgccttgtttataagggggtgattatgatccaggaacggtgcactgtggtggattgtgttgtgcgaggggtactgtcacagcttctttccgaggtaccgtgctggtattgaggcacatggtgacatgttgtggggctgtgtcttgtgggtacagtggtacacgtctggccagagtaaaactattcgaatagccgtgcctgcggttaagggcgggtctaacaatgtctttcgtgattagtctcacacttctcatcataataaaagatgctataactggtaataatttgattagctcctggtttggaatggttaattcctagtttggagatagaactgtgcagccgggatggttgttcagaatggttgggcctatgcaacagggtatgttgtaaagcgttgggttaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagggatgctgatggtgtggaggattaggtgtagccctggtcaagctgcctgtggagtggagtcgtctgcgccgtttatcttatttttccgctgcttagatctttattgattgagaggaactatctacctctgtaatgacattttattcacttattaattagagtagtaattgtactctattatcaatttgttattgtgtgcctcggctgattcctggacgatggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcatttcataatctcttttagtggttctcattcaaaatttattccaatgttattagtactgtacatctattactgtactaatggctcatttaccagcaaaagttttacaacattgttttatttaatcttgctgcaatgaaataaacttagcgtgttgattttataactttcttttattttatttcttttgaagcctgttgttcaaaagtgcaaaatttgtgatcttgtttccaactgtttcaacttatcttgcaagcttggtttactttatttacttaccttttactttgattttctaactttattcaaattaatccaaaaacttgtgctattaattggataaaatgtcttaactccctcctttcacttgtcttttga

SEQ ID NO: 23525 - DNA, 1501 bp, Oryza sativa
tagacttgttccggatacatgcaacatgaattcatgatatgggtctattttctatgctcaaagactagactatttattattacccgtaagggttatcaaccgaatacttgtgccagtcgggattcaattgttatatctattttggagtatcccataagggataatcactcatatcagaagctattcatatgagctacacttggtctatatcacccgggagatttattactcgggagcattttacatgcgtcatcctttaaagggtgtcgaaggcatattttttggcctaggcctaatatgtctgcagcccacattttcaagtgtggcctatcacgttcttttagggacttacgcactttttgcttaggccaaagtgtgcgtgatcaagtgcccaatacctaaaaatccttttataccgcagttactcaactttttaggagttggtacaatatgcatcttaaaaggtgtcaaacagtaaatctttatatagctaccccgctgacttttttatataagtcaaggtgctgtttgggtttttaagcaattgattggatacaatatcgttgctttttgccacgtaagtgtgcatttttattgaccaatattatggcttaggctgattgtatattatggtcattttccaggcggttggtaaatccttatgagttcatttactcggattttacaccacatatgtcatatttccaggtgtggcgaaaccatgtgtcttttagggatttaagcacatctgttaaagcagtatgcgcctggtgtgtgtctaatactttggaaatctctttattcacagcattcaagtcattttatagctgttttgctatgtgaattttcaatgatgtagtcaactttaggttgcacgcatcatattttacaaagcagtcgatatatcactgggatcatgttattcggggattcacaccgcatatgctatatattgatatcaagttacttggttgactataattatcaaaaaccactcagttggttggattatttattccttgactatatgcttagtttgttcaattaaccacatagttgggggctacacctattaggtgcatctagtcgatgtacctgactttatttttcagccctctacagtcttcagatttggtaaaagtactcgggagaccatggcaaagatgattgaagcattcggctttggtgtaatctagttcgagagaagattatctttttgactgtgaaggtctcaggggctactgtggagattataggtaccccatacccacacggcatggttatccaactagtcataggggatagcttatatctatggaatatgtaacagatcatgacttgggtattatgtttccttttatattatggagcggcctaaagttctgatttaataatattgtaaaatagatttaggaaaccaataccgtattggttaaggtttctatcttgtaatcctgtcccccatcttatataaggtgggcaggaggtcctctagggggca

SEQ ID NO: 23526 - DNA, 1501 bp, Oryza sativa
ggaacagtggcggtaacgccactgttgccggcggggatgcacttccggaggtctccacgggcaacagagggcaggccggcgcagaggaggcggctgcgacgctggaggaggcgccggcatggccgaccggcgctcgggcaaggcggtaggggcggctggagggtggccggcaccgaggaaagagaaggaggaggcggggagaggtggtgcagccacggggagggcgcaggagggggctaaaacgagagaatggagcaagggggttccgttttatagcggagggaagcgagccgagcatgggaggagcagggaacggcggcggaaaaggcgcccggcggccatggaaggcggccatgaatggcgcagccgttccggtcaaaatagtgcatgattgaaggggagattagggggaaaagggagaggaaggaaaggggattaattccccccaattaattttggaatccaacgcttaaatcgcgcggattcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggctcggctcggcctggcttgggccgggctgctgggccgaggcaggccgggaggaaggaggaggagggagtgggctgcccgggatgaaagagagaaaaacaaagggaggggagagggactgggactgcgggccgagggggagagaggtagactttgggccagacttggcccaaagggaggagggggattatttttagctttttctttttaataaactttgttaattgttgttgttctttaataaatattttcggtgctctgaaaattcaagtaaaatttgagggctccttttagaccaaagagaatttaataaaaattctccggaccacattcgaatttttctgacacgtattttagtgtttgtcaatttcttttcgaattttaattaattctattattccttttagggaatgatttttatttcgggatgaatttatcaggacgtgacataagtactattcggaataaatcaaaagcatagagataagataaatttattttctgctctttacaattgcaaaagtacccgagtagtaaattctgattcgtgaaactttgttccattaatgacgaactcatgtcactcatatgcatgtttgggaagtgcctaggctgactcccgatggttgggggctatgactagtcagacagagtgtttaaacgtacggaatcatctgctcgaggaaatcaagattgactagaggagaaatacatatttattaatattttaaaatacttgaatttttctcgagtattatatatacattaaatactactcatcccatatatgtttgttctgtaggatccagatccagatatgcataaaagggattcattgctttaagcttacatcctacgcttcatgaatggatcagtcagaacat

SEQ ID NO: 23527 - DNA, 1501 bp, Oryza sativa
taaactgcgagatgaatttattaagcctaattaatccgtcattagcaaatgtttattgtagcaccacattgtcaaatcatggcgtaattacgcttaaaagattcgtctcgcaatttacacaatctatagttctttttatatatttaatactttatatatgtgtgcaaacatttgatgtgacatgatgaaatgtttttttatgggaattaaacagggccttacattagtactcctgtttgctaagaagtgtacgtaccagacggaccgttttagatctttgattttgtctcaatctattactccctccgtttcaccctccgtttcaggctataatatgttttgattttagtcaaaagttaaactattcaaatttaactaagtttatgcacaaatatagtaatatttataatatcaaattagtttcattaaatcaataattggatatatttttataactaatttggggtgagttgaaaatattattattggtttttataaatttagacaaacttaaaataatttgactctaaccaaaacctttaacctaaccaaagtctttaacctaaaacggagaaggaagtagggtggagtaagtcttatctctaacttgctcttaagaaaaaggtgacacgtacgagtcgtccataaaacacgatggttggacttggaatagtataataataatgccagccatgcatgcataagcgctgacgaaacctcaattaggccacgttcgaatctcattgagacgaagatttttctagattttcgttagcatatatttcaaaccattagatagtatgtttcgtacaaaatttatatatatatatatgagttgctttaaaatattaaacaaatttatattttaagtttaaaataattaaaacttaattaattattatatgttatttttttccttgcacaaacttaggcctagtcctccgttcttttcttctctggcacatgttcttaaaaaagctgaaagatctctgccacatatcgttagaaaaactgaaaaatgcagtatgatgagatcaatttcgcgatctatctatctggcgcagtagcatcgacatctatctacgttttgcacttctgatgaaaaagtcaatgcatgtatgcattgagacgagttaggtgcagggctgcaggccgggttgctcaagtggcattaattaacaccagccaggcagccacctttgattgaatattcgaatttgactttgaccattaacgaatcatatgcaattagtaacttccatacaaaactttctctattctaaaaactgtcaaagtaattttggctcatgtgccggttttccgattgatttcaggaatctattgtcacacctagaaattctcgaaccagaatttctaagctgaatgtgcattaaatccctgtccaggaccagccaggatacacaaacgacaattgttgacatacagacccacgtcttacaaaaatataaaagattacaaatgcaacggaaaagataaaagc

SEQ ID NO: 23528 - DNA, 1501 bp, Oryza sativa
gtggggcccggccgtcagccgcccgcgccctcgggtgcggctgacgcgtggggcccacggcgccggccggtgtgagccaggtgcactcggtccaccgtggaccgtgagactgccgcgtgggtcccactcccgtggacccggtccgcgcgccctctccccggctaacgcaataaatccatttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtactttgttcctgcttgttatatggagtttattagaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattctcatcacctggacactatggaatggatggattattgtggaattggattcacacctccccctctattcaaaatcctcaaaatggttttaggctgggctcggggtgcatggttttgatagtagcacctcggccgtataatgaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctgttcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggttcgtgtgggttcatggccttgattaataatattgtat

SEQ ID NO: 23529 - DNA, 908 bp, Oryza sativa
atttcgggatgaatttatcaggacgtgacatagcggctgccgcgtggggcccggccgtcagccgcccgcgccctcgggtgcggctgacgcgtggggcccacggcgccggccggtgtgagccaggtgcactcggtccaccgtggaccgtgagactgccgcgtgggtcccactcccgtggacccggtccgcgcgccctctccccggctaacgcaataaatccatttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtactttgttcctgcttgttatatggagtttattagaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattctcatcacctggacactatggaatggatggattattgtggaattggattcacacctccccctctattcaaaatcctcaaaatggttttaggctgggctcggggtgcatggttttgatagtagcacctcggccgtataatgaccggt

SEQ ID NO: 23530 - DNA, 1501 bp, Oryza sativa
ctagccagagtaaaacaattcgaatagccatgcctgcggttttgggcaatcgaccagaatcaccgtgattaatctcaccaaataaatcgatccaatgcactgtgtggttcaggtgggatggttgggcctgtacaacgtgctgtagcgttgttcagtagagatttaatattatcttaattaaccaactgctttactgttttgctcaataaaatgctttacaacttcctttatgcaaattgccacaaacctctctttgtatccccttgcacaagtgcatcatttgtgtggcttgctgagtacggtagttgtactcagccttgctatttctcccttttttagaagtgtagtacttctgagctgaagtcgaagttagtagaccaaggcttagaccccagttgagttttgcctgtggagtggagctaaagtcccgctaggatcgccttttccgcggctgtcgttctctttcggtgtgaggactaagcgcctcttatgtaagtatatatgctttatttacgtatctatctgtatattaatttatcattttgtgtgccctggctgattcctggacagggatttaattcctcgaggacgagctgctcaaaaagaggggagtaatgtcatgggctttaggccgggcgtcctaggcccattggataggcttagggtttgttaggattagattaagtggccctccatctatagaaggagggatcctatcgtaggtcaattaggcattagatcaagatttaatttagtgcccatcggcctgccttctcagtgcgacggagagcgtcccgccgtttaggtttacgactgttccttgtcatttcatctactataatccaatctatccccactcatcacgattcttctccacataatccttgctcgtgacatgttcctttctttttttatttaattatttagtctaagtaagttatatttccatctttgcaggttcattgtttagtatttatactaagtgctctagtactaggactccggatagagaaggaagttcttgcgcaagtattagagtagtaattaataacttaggcgtggtgtctaggttagagattacctgtgtttgttgtgtatcccacggatttgtcagaggtaggcggcaggtggtgacagccctgaattccgtcctagtaatcctccactgtcacgtcctgataaattcatcccgaaataaaaatcattccctaaaaggaataatagaattaattaaaattcgaaaagaaattgacaaacactaaaatacgtgccagaaaaattcgaatgtggtccggagaatttttgttaaattctccttggtctaaaaggagcccttaaattttacttgaattttcagagcaccgaaaatatttattaaacaacaacaacaattaacaaagtttattaaaaagaaaaagctaaaaataatccccctcctctctttgggccaagtctggcccaaagtctccctctctccccctcggcccgcagtccaagtccc

SEQ ID NO: 23531 - DNA, 1501 bp, Oryza sativa
gcgacagcaaaggcaagcctgtcggtgaagacatagacgcccaacaacggcggcataacaggccagccgacggtgaagacgtagatgcccaacaacggcggcataataggccagccggcggtgaagacgtagtcgcccaacaacagcggcacaataggccagcgtgcaggcgaagacaccattcggtggcggcgaaggcaagccggtcgatgaaaacgaagacgcataacaacggcggcataataggccagccgtgtaggcggagacaccagtcggcggcggcgaaggcaagccggtcggtgaagacgaagacgcccaacgacggtggcataataggccagccgtgcaggcagagataccagtcggcggcggcgaaggcaagccggtggtgatgttctgactgatccattcatgaagcgtaggatgtaagcttaaagcaatgaatcccttttatgcatatctggatctggatcctacagaacaaacatatatgggatgagtagtatttaatgtatatataatactcgagaaaaattcaagtattttaaaatattaataaatatgtatttctcctctagtcaatcttgatttcctcgagcagatgattccgtacgtttaaacactctgtctgactagtcatagcccccaaccatcgggagtcagcctaggcacttcccaaacatgcatatgagtgacatgagttcgtcattaatggaacaaagtttcacgaatcagaatttactactcgggtacttttgcaattgtaaagagcagaaaataaatttatcttatctctatgcttttgatttattccgaatagtacttatgtcacgtcctgataaattcatcccgaaataaaaatcattccctaaaaggaataatagaattaattaaaattcgaaaagaaattgacaaacactaaaatacgtgtcagaaaaattcgaatgtggtccggagaatttttattaaattctctttggtctaaaaggagccctcaaattttacttgaattttcagagcaccgaaaatatttattaaagaacaacaacaattaacaaagtttattaaaaagaaaaagctaaaaataatccccctcctccctttgggccaagtctggcccaaagtctacctctctccccctcggcccgcagtcccagtccctctcccctccctttgtttttctctctttcatcccgggcagcccactccctcctcctccttcctcccggcctgcctcggcccagcagcccggcccaagccaggccgagccgagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaatccgcgcgatttaagcgttggattccaaaattaattggggggaattaatcccctttccttcctctcccttttccccctaatctccccttcaa

SEQ ID NO: 23532 - DNA, 1501 bp, Oryza sativa
acctgggggccggttataccaactaccattttcgccatagataggtaagcctttgtgtgtttcttcttagatctgttggtcttcaatcttcacttcttagaatcaaatcgaatggatggatggagggatgaactgggtggcggttcttgggcatggcttctgctttcgattgaattgttttttggattagggcctgcggattttaggatgtttatgtatatgatgaattatttgatttgagtgatataaaacactatgaattttaggataaagggtcctgtgttttcaatttgctcagcagtatgatcagtggcttgggaagcgaagctggccatgctgttgtcaggtgtcccttgcagatatctgctgcaggtaatgagacaaaaaattaggtgttcagattaggaacaatgtaggaccgttgaaccagagttgtaatttcagaaaataggcgctcaaacatgatgcatctatacttagttagagcccctgctaaccactattaccgatgctttagataaatgctgctgctattttttttcattgggatctattccgcgactgttttagtaattctactaattgaattgaaatttcccaaaagcaatccttctgttaagcttggttggactgaatagcagttttaccttggccatcagtgctcactttgagttgtcagataatgaatagctcatcactgatttttttttcagaaaaaaggtgctcatatatgcatgcatagatctctagaaaaaacggctggataatgaatagctcatcactttcctgttgatttgatgcaggggaggaataagctggttggatgcatgatcaatgggaaatcatgtttagttttctccctagatcatgatgctttgaactcaagccctgtttggattcagctataacaagttttgttgtgcaagtagtcacgtgatgtaacaagttttgcctcatgttacagattttgtaaggatgcttctctggtagcaatttaatatcatgttacagatttgcatacttcagttgaggtagatgtgagaggcgacgtcttgaattcaaattgtagcaatttttcagttgaggtagatgtgagaggcgacgtcttgaactaaagcagcctggtttgagcacctgcaaacaaaaccacacctccggttgtcgatcaatcagcttctagatttgccaaaattaatatatgaaaatcttgcaatggtcgagcacgtttaatacacgtctaataaaaccattttctatatacagacttagaacatattgtttttctcaattttatcaaaattatctaattgattgttgtggtttgtcagatacacattaaaacaaaaccctgctgaaattatctgaacttcgcattttaactccacctgctgaatcacggtaaaacaaaaacatttttttctctgaaccttgatgttcatcgccaaagttgggttaggcagtatccaacacatgggcctaaattatccctttaggcaatata

SEQ ID NO: 23533 - DNA, 1501 bp, Oryza sativa
cgtcctcgccggatcatcgtctcgctgcgccgccaccctcgtcgtcatcgtagcggagtgttccacgccgtcctcgtctccgtgcagctgctgccggctgcctcatcacctccttgccggttcttgtcgtcgtcctctcgtcgttcccggtcgtcgtggcgttcgtccctctgtcaagccgttctcgtccgtcgtccgcgtccgtcaagtgtgccgctgcagccccgtcgtcgtcttcgtcctcgcctccgcttctccaagcattgcgccggctacgtctcgccttcgtccagggatcgccgccgaagtcgtcccctcgcctttcgtctccgtcattcccggccatctccgccgcgcccgttcgttgttgtcgttccctcgcctcgtcacgtggtggtaaggatctctccttcgctgccccgtcctcgtcctttcggtgtcgcccgtgcccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggaccgtctctgtgtactcggtctaccgcggtcctttaggttgacatgtggggtccgcatgtcaacggcgcaaccttcctgtcttttctaggctagcgcttacacatgttttatagttgcaaaacctaattataataatccgcaaatctccatgtaacagcattaaacttcgaatgatcatatcttggtcatacgagctccgaattgatccgttgaagtctcctaatgtttgttataacctaaagaaccctgtgctttctttttatgtattgttattgcttctttataggcttgtagctttgcttgtgtgcttcgcgtagtcttcatcattccggaggttcccgaagcgtggtttgcggtcgtcgccgaaggtttggaaggccgttatctctgagcaaggcaagtcacatcatccttgagaatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactcgtgggtactctattcatggttccactagtatgaatttaggtagatgcttcactgattaattaggcaacattaggtggttttataactttagactttgggaattctcatatcatttggacactatggaatggttggcttatgttggaattggacacacacctccccctctattcaaaactcccaaaatggttttaggctgggctcgaggtgcgtggttgggttttgttagtcgtacctcgggtactgtaaggattaa

SEQ ID NO: 23534 - DNA, 1501 bp, Oryza sativa
gtaaggattaagctcgggcctctgttgcaaagcactaccgtacttccacatatctagtgggtaaggcttagtttgtggctcagtctagttataaacaaaagtacacggatggagatggacgaagtcgggggtcgatggacatctctaggacaaatgaaggctacacgagctgcggcccggtagttgagatgtcatggcacagggctggtgtcctgctgctaggggctcaatcctgccagcctgtcccggaggttccgggcgtaggtggggttggctcggtactcttgtttatggctaggatgggttggtaactatgtcacgtcttccgtccgtataccgtggtggcatgtggcacgtggttacacgtgaggaagatgtgtcttatgggtaaagatgtacacctctgatcagagtataacctattcgaatagccgcaccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgtccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctgaatctttcccccccttcaataagagaagctttggagaagaagtcttaggtggagtcctggcttatacgccagttgagcgcctatgaagatggagccgtaggtccgctagtctgctgctgtttatttttgattgtcaggcattaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacaacttagcaccttgcgttactcggtccatccaacgagcccccgggtgctaggaatcggcccaaaggcaactatccatcgacaaaccaaacggaaagcataggaagatagaactccataactcgataggcacttttgtactcagattatgtcgcaagcaatcaagataaatattatgaaaattgtttaaaaaatatgatataacatctgtagcccccgactcactagtcaacggtgaaccagttgatgtagtgagctaggcagaggaaaaggaaaatgtcatataaagaagaaaattaatgatgacttagctttttggtctttcccttggtgacggcagatgtcacgaccggaattaacccaacgggcgttccttacgtgcgtgtattaatccttgtcccagg

SEQ ID NO: 23535 - DNA, 1501 bp, Oryza sativa
gaatttcgatgattctttccacggttagttggtgcatagtgatgcgtggcatggcggtgcccagcctgctacaacagggcctcatagctagccgaattattgttcttttttaccctgagggaaagctggctagccgaattggttcgataaagtgtctcgatacattttgaaaaacatacaaattttatattttagaataaataaagcatcagatcaatttgaatctctccataattacaatattgtttatgatactcatatggatatgtgtctttagtcgaatcatgagaaagtgttttcatcctctaagctgatatctccttgttttttatgtcatcaaaatagtgataacaaattgaaaaatgtttggtagatcaatatataaaatataacactccacaaacatacaaatttaaattcaacatactccctccattccataatataaggcacaaccacttttttagagattctataatatataaggtatgcatgtaggcatgcatgtaagcatgcaattaaccatgacatcttctccattaaattattattttttaaaatcatccactctcatgttacataatcctattggatgcatgcattatatttattaggatgatccaaactacaagacgataataattatttattggtatttgggttaaggtgattgtgccttatattttagaacggagggagtatacaaatagaaacacaattttatattgtataagttatttttgaacttacatatttgtaaagtgatatatctcatattgatctaccttaccatttttcaactttttaaataaattatgagtggcatgcacaaaacgggaggatattccctcaaggatggtatccacattcgaatcttgtgatacgactgcttaagttgtacttcctgtgttctacaatatagcaatatggtataggatgagaagtgtgctcgcgaaaaaaagtataggatgagaagtatccttagtataaatttattgtattagggtgtgtctaatcctatagtagattgttatatttgaaaagaaaacacttagtaggcatatctattcaaggaatggtttattaattgggtatcttcttttctttgatgatgacgattgttttgtgctcggggactccacagcaaaaccgggtcctatttatgtttgtttcccctgatccatcgaactaacaacggcgcccatgcatgcaaggtggtccaaagtacgtatagacaacagtacagtacagggctactgcaggctacacagacaacagcgagatgatgacagattgacgttttgacaggtcggtggccggtccctcgcccaatcatacctcgccaagacacacggccggacaagcgcgcactggtgtgcctggtggtgtgtactctgccgccctccatccgcccccctccccccgccacccgcacggcgcctctgcgacgtacggcacggcgcacgctcgaccgagtcttgcacggtgacatgcctgccat

SEQ ID NO: 23536 - DNA, 270 bp, Oryza sativa
ggatatgagatgtataatctgtgatgtatttgatttgtgtgtattttttaggatttgtgatgtatttgatttatatttataagtaacttaagatttgggatgttactttgaattggggatttggggattgatttagggatatacatggcactagattcgggagaaaatatagagattaaatctggcaaaagaaaaaaaaagtgctactctctctttagtcccggttggtgttatcaactgggactaaagattcctctcttttttcctagt

SEQ ID NO: 23537 - DNA, 665 bp, Oryza sativa
cgattctgttccgaacaacaacctaacatctcttgaaactctggacctttcacttaataatttcaacaagaggattgcacccaattggttttgggatttaactagtcttaaacttctagatatctcagatagcggtttctatggaccatttccaaacgagataggcaatatgacctctattgtggatattgatttatcaggcaataatcttgtgggaatgataccatttaacctgaagaacctatgtaacttggagaaatttaatgttgctggaaccaacatcaatgggaatataacggaaatattcaatagattgcctagatgctcatggaataagttacaagtgttgtttctaccggactgcaacttgactggaagcctaccaacaacactagaacccttgagcaatttgagcatgcttgagcttggtaataacaatatcacaggtcccatcccactttggataggagagctcagtaatctaacaatgttgggcctcagctccaacaatctagatggggtcatacatgaaggccatttatcaggcctagaaagtctagatttgttgatcttgtctgataataaccacatagccatcaaggtgaattctacctgggttcctcctttcaagcaaataacagatattgaacttcggtcctgtcagt

SEQ ID NO: 23538 - DNA, 845 bp, Oryza sativa
tggtgtgtgctggaaaggtggcagtggggccaagctcgaaaaggttaggtgttaggccaacggcgaggagaagaagaggaggcgacgattagagtttgtgtgtttgcatgaagtgtttgaaacgaaaattcacaaggtattctaggtttttttttcatatgtagagtaacgctagggagtgacggcgaaggtggtggggtcaagttcaagatattgggagctgtggcggcggaggaggagcgggggactagggtttaggtgtttgcacgaattccaaagcgatccgacgtttcagaattcacaagatatttatgggctattttttttctaaatgtacaatagtcagttacttcatttattcgtctcacattcctaatttccaattaagacagggacctaacagcaaaaaggccaaaccctcccgcgacagaacgggcagtcgggcacgaccgagaccctcgcgcccacgcagcaacctccgtacacacgtcgcacttgacttgcgtggactccaacttcccattttacccctccgtgctcaaccaaattgccactaaaccgctcaccactcactaatctatcaggggcaagatcgtattttgccactaatcccactaatccccctgcgcgcttctcgtataactactccccactgctctcttcgatcccctcttctgctttttagcgaaatccgagaaaaaaattgcctgcaaaaaaaaaaatcgaaacgtcgttctgatcgatcggccgttcgagttcacggcggagatggagcacgagcgcggtggcggtggccgcggccgcgggaggggtcgcggtggcgggcgtggcggcagtggcggcga

SEQ ID NO: 23539 - DNA, 632 bp, Oryza sativa
cagggcgagggcgatcagaagattcgactgtactcgaacaacggttaaacgattcaaacccgaattgattcctcttcccctcacacactatgtaagcccaccaccgaattaattcatgcactatataatcccaccaccgaattgattcacgcactatataagcccaccagcgaattgattcctctccctctcacgcactatataagcccaccatcgatagaccttgaacaacagataaacttatcgaaggaccctaattgattcctctccccctcacgaactatactatataagtccatcaccgatagacctcacaatggataaacgattcaatccgatttgattatcaaaggacccaaattgattcatctccccctcatgtattatataagcccaccaccactcatgcactatataagcctaacaccaatagatagaggaaatacaactatgatcacgtgcactattttatcatcggtggtatgtcttcttctgttcctgtgttgcacctctgcttccccagttcggagcacttttgcgtgcacaagtgtttaggagagtatctatacgggtaggcaggtgatcaaatttttggggagcgcttcctagcgcgactgctctgctgcgtcagt

SEQ ID NO: 23540 - DNA, 217 bp, Oryza sativa
catatgtatgtgcaactcagtgataattttgaattttctgatgttcaaaatttgctttacacattttaacatcttgaaaaatgctttttaaatacttaatgtactctgtcctttccaggtttatttgctaccaaaagtttgccctggcaatggattattcttttattcttgtacttacctgagctatattaatcggagttttttttttatttgtagg

SEQ ID NO: 23541 - DNA, 384 bp, Oryza sativa
tagcctgtcaggaatgaataatcgcttgatgataatccatctctgctttgctacgtttgacttgtgctgaagatttttacgttgtattgagttgttgagcttgaattgatgcttgccatgagaacacctgcatcctaattttgaagcctgcaactctgcaaggtgcaagcatgatgatcctgttcttgagctgtactgttgcaagttcgctatctttctccatccaaaaaaaaaattcagttcacacgccgtcgtcaccgatcgacatgattttttttttaattattggccaccttcgtttttaagtctgaaaccatgcttgttcaagccgagccatttcggcgtgttgacctattcctggccgtccgattttctcggcctaga

SEQ ID NO: 23542 - DNA, 245 bp, Oryza sativa
cacattttatgctttaaagggatcacatgattcccatctaaacggcacaagcaactactctacaacatctaaacgtaacttgtgatgcaacacctcaattttcacccgagcgtcctaccgaacaatccaccgatatttcacgtcttcaccatgatcgtcacagaaaatagcaactctacacagaacatgccaatgttgcaatgtagaaacactaatcgtaacagctacacaaatgctaagatttc

SEQ ID NO: 23543 - DNA, 819 bp, Oryza sativa
tccctttggccttgttcttttgtttccctttttctcctccaatgcgcaagagggtgtgcccttttcacagtacacaccacgcagatgaagggctaacaaagtagcaattgcttttgtgtaaatattcttttgttaatatcatcattagaagcacgaggactgatgatactgttagctaagctgctggttgcaatgtttctccggtactatttaggtgtcggtttggtgagatagtgacttttttatggcattctacacgttctaatttctaagatagccgcgaaacaaatgtcctcatcttttcgcttataattatcagaaaatttaaatttttaatcttaaattcagagtttatttttggatatttttttttttttcatcgtagtttattttcaacctttacttttaatcattaaaaacacgttataaaagctttattcataaatttatttttcatttattaatacaacttttcgttttttcctcaaatcagccaaacgagtttgtcttcttttcccactgaagtaatgctttatacacggttacacgacacgtcattcctgcatgaaaggagggcaggggcaaatccgtcaattcacaggaggggagtaacccgcatccgtcgcgggcagcaacccgacaacccgcaccgctaaagtatccaatccatccgatccgtccgtccacattcaaatctccccaccgctcctcatccgaatttccacaattaattccattccaatcctcgtaatctcccccaaattcgcgattctctcatctaatcctcctcctcctcccccgaaatcagcacaccgaggc

SEQ ID NO: 23544 - DNA, 1501 bp, Oryza sativa
gagttgtaagaggctaagagcacgaacgggatggttatgaagcatctatgattctatgcttatcggaagaccaaagacttcatttggtagcagttcggttgtctttttgggtagatgtcctttttactcctttggatatatggatgctgccattgtatctttagcgtgggggatcaggcaggaggctccctatcacgttaattccatatgtgaacaggaagatcgatcagtgtcattgcttggatttttatccaataatcagttccaatgagggtgtgtttagttcacggcaaaattgaaagtttggttgaaattggaacgatgtgatggaaaagtttaaagtttatgtgtataggaaagttttgatgtgatgaaaaagttggaagtttgaagaaaaaatttggaactaaacaaggcccgagtatgaggggatgtgtgacccggtgggggaagcgaatttcctttaaggtttctgaacaattctttgactaaaggagaaacaaaaatattacttcctccgttttagattataagacgttttgactttggtcaaagtcaaactgtttcaagtttaactaagtttatagacaaatatagtaatatttataatactaaattagttttatgaaatcaataatcgaatatattttcataataaatttgtcttggcttgaaaatgttattattattttctacaaacttgatccaaagtcaaaacgtcttatgacctgaaacagagagagtacattcttttcaaaatgtatgacactgttgatttttagttaaaaatatttgaccattcgtcttattaaaaaaataaatatgtaaaagtataagttaaaattatattttatttaatggtaaaacaagttacaagaaaataaataatacttgtataaatttttttgaatatgacgaatggttaaacgttatacgaaaaattgaacgacgtcatacattttgaaatggaggaaatattttggttgccaacatacaccgaaatgcctggtcatcgagaacaagttgaaacgtctcaatgctgtgagagctgatgagctgcgaggaatttcatccgacagctccttgaccttgtgtggtagataggtcagcacgagagttgcggagcggaacgcctatgtgttgtggcgacaagtgagcagatggaggacttcgcccatttggaagcccaaagctttaggagcggctatgaaatctggctcattagcaaacactgccccactcattcgcaccttaggttttgtgctggaatctggatcaaagtaggaatttggatggatcatatatactaccactacaccatgtcccaaaattggcaacaactaatctgtcggcgaagaccacctttaacatcaatagtccgtcggaaaaggcctctggcgatagagaggatgtgtcagtggaaagcctgtcggtacacggtattaccgacagatagaacttctacctaaataagtctatttttgtctttttttgaaattct

SEQ ID NO: 23545 - DNA, 1501 bp, Oryza sativa
tgcttgcgtctgctaactgtctacttgatccatgttggtgtttactgtgcacagcattttcagcgtatattaatcagtttattaattgacaaactcactattgagaacttaagatgacgctggagtagtttgttatagttaaagaatgttatagtcgctcttcaataatggctcttaaaaatatgtgtgaaaaggtcatatatatgcagtgtttgaaattttgggaacgaaatttctggaaatttcggaaattttgccccccaccaaaatgctaacatctcgcccaaatttcggttttttgcaatttttttatgaatttggtcaaattttatttaaatttattcaaaatccgtcaaaaaataaaaaaaattcgtacgaaatttatccgaaattccagaaatttcggttctatcactcagcagcggcagaactgctgcttccgaaatttaaaaccctgtatatatgttcaaacaaagttgaatcgactgccacactttattgatttaaccggtgtagtttaaaagcatatatttgacaaaccattactttttttactgatagaataggcatgatgcacatgagcaggttaatttatgcaattaaccgtgctatcacgaaccacctaataccatgataaattactgtctccatcgctccatggaaaataaaaagaaatgaccaaaggttgatccggagatcaatccagctttataggaaagccaaagacggttcacacaaaatttcaatctcccaaaaacggtgactgattatataattgttccaatagaacatatattctattataagacgctttaacttttttaatcaaatatttttaagtttgattaaatttataggaaaacatagtaacattctcaacgtaaaacaaatattattaatatgtattcaatattatatttaataaaattaatttggtgttgtagctagtgctaaatttttctataactttaatcaaacctataaaagtttgaaaagaaatcatgatgtcttgtaatataaaagaaacaaagaatttactagcaacattcagtagacattagaccatatgaaacatgagacacagaaaggcagtgaaaaaaggaagaagattctacctgtcgatgatcagttgccaactctgatgactgactgaccagtgaccacagccccggttagctggcgatgctgcaagactaatcaagcaaaagtcttgaataatcttttctctggtcctgcttcatgcttgtgtgcatagataaataggtaaaggctggcagaacccagacagaaagcacaagatccgaggagcagatcgaccaaaagtttctgatcccctcttcttctcgcttgcttctctcctactcgatcaatctcgctagagcttcttgcttgctttgatctctcgagcctctagcctagcttagctagctaagctagctactcatcagtgtcctaagtagagttgctagctagctaagcatggcgagcaatggcgaggcga

SEQ ID NO: 23546 - DNA, 1501 bp, Oryza sativa
agttctatctgtcggtaataccgtgtaccgacaggctttccactgacacatcctctctatcgccagaggccttttccgacggactattgatgttaaaggtggtcttcgccgacagattagttgttgccaattttgggacatggtgtagtggtagtatatatgatccatccaaattcctactttgatccagattccagcacaaaacctaaggtgcgaatgagtggggcagtgtttgctaatgagccagatttcatagccgctcctaaagctttgggcttccaaatgggcgaagtcctccatctgctcacttgtcgccacaacacataggcgttccgctccgcaactctcgtgctgacctatctaccacacaaggtcaaggagctgtcggatgaaattcctcgcagctcatcagctctcacagcattgagacgtttcaacttgttctcgatgaccaggcatttcggtgtatgttggcaaccaaaatatttcctccatttcaaaatgtatgacgtcgttcaatttttcgtataacgtttaaccattcgtcatattcaaaaaaatttatacaagtattatttattttcttgtaacttgttttaccattaaataaaatataattttaacttatacttttacatatttatttttttaataagacgaatggtcaaatatttttaactaaaaatcaacagtgtcatacattttgaaaagaatgtactctctctgtttcaggtcataagacgttttgactttggatcaagtttgtagaaaataataataacattttcaagccaagacaaatttattatgaaaatatattcgattattgatttcataaaactaatttagtattataaatattactatatttgtctataaacttagttaaacttgaaacagtttgactttgaccaaagtcaaaacgtcttataatctaaaacggaggaagtaatatttttgtttctcctttagtcaaagaattgttcagaaaccttaaaggaaattcgcttcccccaccgggtcacacatcccctcatactcgggccttgtttagttccaaattttttcttcaaacttccaactttttcatcacatcaaaactttcctatacacataaactttaaacttttccatcacatcgttccaatttcaaccaaactttcaattttgccgtgaactaaacacaccctcattggaactgattattggataaaaatccaagcaatgacactgatcgatcttcctgttcacatatggaattaacgtgatagggagcctcctgcctgatcccccacgctaaagatacaatggcagcatccatatatccaaaggagtaaaaaggacatctacccaaaaagacaaccgaactgctaccaaatgaagtctttggtcttccgataagcatagaatcatagatgcttcataaccatcccgttcgtgctcttagcctcttacaactcttgtgaaattaggttcaacagccaattagttactccaccaa

SEQ ID NO: 23547 - DNA, 373 bp, Oryza sativa
atgggttaaagaaggaagattgctgagcgaaacggcttaatatatatatatatgagctaccacctgaacttcagtaactccaatgacgttaacgtttggtgcagatcccttcacgtgaagtgcagttatcagaaaattttgagcttgccaagcacggagcacaattggaatgtcttcttcgtcacgagctggatcaccaaccgactgccccaacagttcaaatagcaagcctcctgcaactcttacagggacctgaaataagttaaaaaaaagatacgaggtttggagggagagacgtccctccaaatatttttcaagaagaaattgtaagtgtgctggggattgaacacgagaccttagggttgaaaccaca

SEQ ID NO: 23548 - DNA, 1501 bp, Oryza sativa
gtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatgttccgccgcctccgcctacggctccgccctggctgctgccaactccgctgccgccagtctggccgccctcgctgctgctgcagcggtctgagccgatgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctggtgctgctgctggctgagagctcaaccgagcttgggaaggggtggaacaagagatgtttagcctacaggaaagtgtggctctgataccagatgttagaatttcaatggttactctcattgagaagaggatggcactcgaga

SEQ ID NO: 23549 - DNA, 454 bp, Oryza sativa
aacgggtgtaaccggacgaccaagcgggagcaattttccttataaccttgtgcatcataaacaacgaaaaacagagtccctgagtccccatcccctacctaacaagatttcctcgagggtaacaatcgaaaagtacaaaccggtatgcaccgtagattagaatattatagattagtataattagtcccaaccgacgcacctaaaatctgtgcagccaaagataatccaagagacagatgaccgaaagcccaccgaaaccggtaaatcctagcgctaaacccacaacccaacacgcacaagaagcagcgggaaagtgcgaaggacgagcagctctcacccaccaggagagagtcctccgctgctctcctctcctctcctccggctaagtggttggctggtctcagcgacagcgatccctttcggggtactagtagctagtagccgcgacgacgga

SEQ ID NO: 23550 - DNA, 937 bp, Oryza sativa
tctgtgactggtcacagaccgggtaaaggaacgcgctgtactgcgttgcatgcagcgtgacacgcttgaccagactacaataaatgctgttaggtgagcacagctgtgctcacttatcccatatatgtggcgcagacttccttaaggggtcggggtgcctcggccctcggggccggggcaagcgcaacccgacccccccctcgggggagatcaagaggagggcggacacctcaccctcgggcccgacgtccccgaaggtgccaggccacgtgggcgattatgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcgcattggtattggtaactttggttgtccataatgggcggtctattcaagactgccacacctcttgagcagcgcgcgaatctgggtgagcagatttatctcgcccggagatacggtaacgccgcttcggtcggcgagcgtaattaacgcgcgcacgatacaatccatttcgattgccacaaccgcatatccacttcatgcgccgtaagcgggcgaatgggattagtgaaagcgtgggcacgggaaacgagggagcgagatagcgagatacgagggagcgaggtagtgggcgcgagaaacgaggagccaggcccagcgatggcaagggtataaaagcatcgaggaaaggatttgcttccttcctttcgccattgttcctcttgccttcgccgcctgagctctaactctttctctgctgcgccctactttcgccacacgcgctcgttctcaatcatctcttcctccaccgcca

SEQ ID NO: 23551 - DNA, 187 bp, Oryza sativa
tctgtcacccttgctgcccggtcgccattattttcttaatatggagttctcacatttaaaagcagtaaaacagtttatttctacatcgactgaatctcagagctgtgtgttgttctctatgcacacgtggatacttcaagcttcatttttttcccccttcaataacacaagacgtgctgtttgcagg

SEQ ID NO: 23552 - DNA, 831 bp, Oryza sativa
tcgcctcgctgtactgcatgcaagtcgcttcttcgcctgggcgcggatatgtgccttggaagttcatggtgaactgttggcacaaatcttcccaggagtggaccgacgcgggtggcaggttcattagccaaccccgcgcctgtccttttagggccatgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgattctcacgtccatgtcgaggtgacactctggacgaagaggcgccctccgttgcgcggggagtacgccggttattacgccggcgctcgatgttgaggcgggcatccggctccccatgctgatcctcccgagtcgaaggtgtcgacgagggagtagcagccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgca

SEQ ID NO: 23553 - DNA, 697 bp, Oryza sativa
ttgtgaaacgaagggaatagtatttaacacagcagtagctataggccctatttaaagagttcaaggttgtgaaaaacaactactcccttcatcccatagggcagtaaacatttcgtacgacaaatctggatatgcgacatgttcaaattcattatattataaacaacaaatttggataagagacattgtcggtgatatgggaccgggagtatcatgaccagaggcttgaggcagacataatcgcccacgtggcctggcaccttcggggacgtcgggcccgagggtgaggtgtccgccctcctcttgatctcccccgaggggggggtcgggttgcgcttgccccggccccgagggccgaggcaccccgaccccttaaggaagtctgcgccacatatatgggataagtgagcacagctgtgctcacctaacagcatttattgtagtctggtcaagcgtgtcacgctgcatgcaacgcagtacagcgcgttcctttacccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggttagatttataccaggcttcatcctaaccattacaggcaagg

SEQ ID NO: 23554 - DNA, 405 bp, Oryza sativa
taagttagctagcttatccctgcattgcttagaagaagattctgtcaaattgacaaacgagccttcttcagttccccgccatctctgatcaacatttgaaaactgaaaaggcagtacatatagacacatagtgcatgttcaaacaatctaaaaacgacgccttttcaatatttttcaatttgaaaaatgaaaaaggcatgtagaagagatggagaacccgatcccgtacgtctaaataaatgtagcgtaaacgacgtaaaacaacgcgtttttcagaagagtgggataagcagcagccattcggcgttctttttcttcttgtcattaattaattattaacgcggctaaggaaataaataaagtttagtagcactatatatgtaggagtatatatagctaggagat

SEQ ID NO: 23555 - DNA, 337 bp, Oryza sativa
gtgaatctgaatatacgatcaatttttttttgttgacgtcacgtaccatcaacatttttttttctagaggcagggctgcatttagatttcagaaaattcataggaagagtaattccttgcttgaatgtgaatcatattactttagggggaatatcgatctacagattggtgatcccttctgttctagttttaagtttaactacacgttgagttggtgggtttgcttgtgtaaacttgacattctctgtttctaaccactcttccgtttcctttagagcgcattccctacggtgaggatgaaaaagaagaaccaccggcaaccccaattgcttccagt

SEQ ID NO: 23556 - DNA, 206 bp, Oryza sativa
ggcacctattgaacgacgggcagtcgacaaagccctgtcgaacggctggcgttcgacacgctcacctgtcgaacggagggagttcgacagggcccaccacccgcgccgcgaggcctgtcgaaccgggggcgttcgacagggccctccaccgaccctgtcgaacaatgggcgttcgacaggccggcttaaagccccgtccacccagg

SEQ ID NO: 23557 - DNA, 164 bp, Oryza sativa
gccgtgcagcacctcggtcaccgttgttcatcgccggaaacccaccggaacgtggtatctctcggtcgccggtgagccccaccattcctctcctctccggcgtggtattctcgccgctccggtcgcctatttccctccctaaccgctccaataatttccccagg

SEQ ID NO: 23558 - DNA, 1501 bp, Oryza sativa
taagccctagaccgggatgttacaccctcacccccttaagagagatcgacgcccccgtcgatcaaccctaggccaggaacgtcctctcttggccacgtccccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcagctagcgccatcatcaaccaccttagcatgacgagtgacgtgtacggaggaagagagaagatccttccaaattgacacaactaccctgtcttctctacgaaaacactcagcccaaagattagcgtcttccatacattttgctaccattcttaggagtgatttaggcagatcacgaaaaacaacatcatgtctatgaattcataaaccccagaaacagagtagatataaaacttggaagtgtttagcggggagctgcctaggagcgactagacctgagagatcttgcacgcgtgagatgccggggtgaatgttgagagatctctagaattcatcagcgaacggacagtgaagaaaaagatgactcaccgtttcgtcttcatcgctgcaaagcttgcatttgggggattgcacaatgttctttttatggagattaaccttcgtggggaggcgatccttggcaataagccaggcaaagaattaaactcgaggcggagctctgttgtcccaaataaacttgccattgtggcacagagccggcgaattttgggaagaggaatagactgctttggtggtgataatgcccattgcaccgcgcgacgagcgaacatccctagcatcctggaggtattgggatcggcgccaccaagtttctaatcaaggtgcatcggcaaatggttgatcgaagaccctaagcctccttaatttcctcgctgccgtcggcgtcagtactgagaccgtcaacgtcgagcaagcctgtattcctgctgttttgttccttctttcattggcgtcaatactgaggacttgatctgttgttgcttttttctttttgctttattggcttgttacatttgcaattttgcatagttactatttgatatttttgtacttcttgggtgaattgctgataggctatggattggaacatcgtattatggatatgcatttgctttatgcgtttctgccatcttgctggctggcttgatatgtgctagctgcttactgaagtgcagccttgcaattttaccaacgagctggctcgagcttaccaacaagacgagccgagctaacaacttagcgttcggctcgttatcctaacgagctaaaccgagccgagccaagcaggcgcgcgccgcatccggccttacatgcagcactacagcaccaacaccagtcacaagatgatgagcgcgccaccgaggattgcgtccatgtccggcgccgatatgattggcg

SEQ ID NO: 23559 - DNA, 950 bp, Oryza sativa
gctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctag

SEQ ID NO: 23560 - DNA, 799 bp, Oryza sativa
actagttttgttcattatgcgatagagtgagtagtacatactaggagctttatcggttttttaaaaaataagtcaaagcagaaataattttggagttgatttttaagatatttttgatgtagtttatttttttatagacttttaagttattagaaacatatattaaaattgtatacgtacattattttttggacattaataagctcttatgatttgtaattaacttttagacaactgatgagactctcctgcaaggctgcaatccaggcctgtaagaagaaatggttcaaattactacctagataggctagattgcttattgctacctgctcgaaatcgaatacagtagctcattagtactttgcttgtgttacacgtcttattttccaatttggacataacacggggatctaacagaaaaaaggccacatcccaaattctggacttcccaattattcctacccaagatgactccacgcggcaggttgccaacgtccacttgactcgtgtaaactcctcatgtcccactttgtccctcttagcgcaacaaaattgctgccggagcacacagaaacttgccatccgtcaggggcaaaatcgtattttcgcacataattctcgtgcccaagcaaaattcacctgcgcgccctcctcctataactacccctcgctgccatcttcgatcccctcctcctcctcctctgctctagcgaaagccgagagagagagagaaaaaaatccgtcacgaaatccacacgcttctgagttctgatctgtgggttcgagttcacggcggaga

SEQ ID NO: 23561 - DNA, 1501 bp, Oryza sativa
aattgcaaatggttttagggttcatgcaatttacttctaggaagaacatggaagcagtacttaacttatttagagaaaaaaaagtgttattcagggataccatcgatcttttgcatcgcttcttcaccatccaattgatacatgtagctcaacatagcatgaacatgagcttattcaccggattattaccacggattgttttgttctaagctatttctcaaaatatttaagtaatccttataatcaagtagataatcaacgacaataatctggtaaagagtaaaattcactttggtcaacctttatttaccaaattttcacattggactagagttagacttatattttcacttaacaccatatatagttaccatcatttgcactttggaccgggtttcacaaattacacatagtataatgattgtagatctgatctcatttctattttgtgttagaaaacttataattcaacaatttgtactaacactacagttgggtattgtaaaacatgtaatatcttttctagaaaaatagttcttaaactcaatatttctccaattgtctctagtataagggttgtgaatgttcatatgtagtagtaatgaagtcccattaatctgatagcatatcctttaacatgttacaatcattgttcttgcgctaagcatatttgtatggcaaaaatttccatatcattgtttcttgtaaaatgctaagcacctagacaacaattcgtgtaatggtaactataaaaccaggtccaaagtgcaaacaatggtaattatacatggtgttaagtaaaaacatgagcctagccctagcccaatgtgaaattttggtcaataaagatggtccaaagtgaaatttactctctggtaaatgatctgtttcaaactgagtagcaacagtacaacagtacaagtagctcctgacttgtttttatacatagtagtacacatagcaagtagcagcacactaaactgataacctgatgtactcctacatgcaggctgtagccatactccggattgatctggggacgggcacaagtgcattgcttttttcagtccatgattaattacagccaagcgcacaaatacccgaacaaatcgccgtgattagtttaatccaaggaatcagctgacaattaagcatagtaccagcagacaaaggggaggccatctgtatggccaagtatggagccatcggaagtgcctcacagtctagcataggcaaagaataaagcagcttcaaccattaaacaaaatgggtatgtacatcatacatgttccattggccatcctttctcactttcagcattgtcgccgcgcatcctcggttcatgcgtttaacctgcaaagtgacgaaccaatggctcataagaaatatatgattgaacagtatcgctgaaaaggcggacaaaagacaggatattcgaggatcaccttttggtgtgattattttaccacatatatggatctattgcaactctgattgataa

SEQ ID NO: 23562 - DNA, 325 bp, Oryza sativa
acatcaatgccacgtaggcgaaaaaccagttgaaaaaccattcgagggtgtaaagtgaatggtattgaaagttcgagggtgtattatactcggttttgtagtttgggggtgtaatttgtaccagcataagagttcgagggtgtaaaatggacttatcccaaaaaaaaaaaaaatctcttctcgtcgtcctcttctccaaccacgcgctcacgccgccagccggccaccgcttatccccttctccagccgagcgcgccgtctctctcctcgccgcgccgccgcgctctcgtcgtcgccgccggtggcttccggaccttcctgggtg

SEQ ID NO: 23563 - DNA, 1501 bp, Oryza sativa
aaccattcgagggtgtaaagtgaatggtattgaaagttcgagggtgtattatactcggttttgtagtttgggggtgtaatttgtaccagcataagagttcgagggtgtaaaatggacttatcccaaaaaaaaaaaaaatctcttctcgtcgtcctcttctccaaccacgcgctcacgccgccagccggccaccgcttatccccttctccagccgagcgcgccgtctctctcctcgccgcgccgccgcgctctcgtcgtcgccgccggtggcttccggaccttcctgggtgggtgaggagatcccccacctcctccgccgccgctcatcctgctgcttccgccgcatccgttacgcacatcctctttcccatctctctctctctctctctctttacccacgcatttttcttctcgaatttgcgttaaccctagcttctgttctagaaatttgccttaaccttaatactaataacagtttgatggctcccaaaaaggtttgggggttcaactgagcagattctgttcttgttttggcgtgtatgcatgcatgtgcggcgtttttaccagttttcaatctctgaaatggatatgtgacctttatttcttctgaaaacagatagctaaaactgtccgtacgcattgtccgtgagggtaatagatgatttgctagtttggtgaacaggaatttgcagtgatttttttcatggagatacttcacaataacggtatgttcattattgtttcaaatagccttgctttctttgtagtttcatttgtatagctggtttcttatattcaactttggatccttaattcaggtttttgcgttagcttgatagacatcaacagaatcagaatgaacaagttagtgaaggtactgattctattctatatttaaagttaattttctttcagttacaacagggtggtactttggcttgaaaacaattatgaaatcatgtgtaggttagccatattaagttcttgagtatcctccactttgtaaaggaagttactgatcctactaattggtaaccatcagaagtgcagttataacctgtagcataacatgtaggattgtgtaatttccaaaaaatggcatattcttaaaaatcatgaaaatgttagatatctcattattgatatgtctgctgaagaatcaaggatcttgattgacctaatgaaatggtagcatcagttaacacatgctttattttaacttgaaagctctttgtcctgcatccacccaaatatgaagataaatgatgcatccttgtcattttccattgctgatgtctcaggcagttgggcctgttattattgttccccttcagcctgcacattattgttaactgttttattagcagataatctcacagaactaattgaaactatgttcaagaagctagtattctcataaacaatcctattactatggtggcactcaatactgaatatcacataatggagaaattcctagcagttgttcattattctttct

SEQ ID NO: 23564 - DNA, 248 bp, Oryza sativa
tttttagtacaaaacaggttctgcaaacatctttcgatacccaagaacagttctgatgggtagtcgagtattatgcctcctatagcagaaaagaaacgaagaaaataatcaggagaaatgaaatggacagcaagctgtaagttttcatttctatgctggataaagctccaaaatggttaaaacaaagtaaattctttggttccaatcgtgcctctagatttcattttgtaagtcatgctcatgcaaaa

SEQ ID NO: 23565 - DNA, 722 bp, Oryza sativa
acctgggcattcactctgacgcaccgggccgaatgtgttaggcccaccaaccatactgggccctagcccagaaatgtggtttgcaacgagaaatgatgtagcccattcttctctctttctttctatttttcttttcagtcaggttagtatgcctgtatctacctctcgccaaaaaaaaaaaaaaggtatactaccatatcatgtatgaaaagacaaaatattctggtattctcatgtgcatttcattttttaaaaagatataactattttataagagtatctcttactagtacacctttaatttaacacaattccagacaagagccatcaaagcatatactctctctctatattttttttatacaggtcactcctaccaagtaccaaccctcaactatcacattgatgaacaaaaaaaaataaaattagaaaatggagaattaataagaggaaatgaagagcatatatgtgtgagaaaatgacttggaagtcccaactcaacgaccccgcagtatacaggtatatacagccatcctatccccatcaaatccccaaaaagaattaaaaatcagaaaaaaaaaactttaatttccagtcttgctctgcgccgccgccggcgaccaccgcagcaacctccgccgccgccgccgccgtccaggaactgaccggccgagctgctccgtctcgtggggcgcgcgtggcggcgatggcgaggcacgagg

SEQ ID NO: 23566 - DNA, 187 bp, Oryza sativa
gctaccacagttcacagcaaaggaggaagctgtaaacaagttagatcaattagtattagtatttgactaagtgaatccgcggttgcagatttagtatttctcaactaaatacattcatggtgttgcaaagggtgaaaggctcacactgtggagaaccaagaaagaaggatgtatttctctgaaggca

SEQ ID NO: 23567 - DNA, 391 bp, Oryza sativa
caacgaacactatcaacggaaaagtttgccttcaattgagtttaaatccaagtcttagtagtacacaagaataccacaacaaatgaagatgctatttgtgcattcatcacaatttggagtccttcatcattgaatagtgcaattctgaggatgttgccatatgttctcaatttaaagtgtgcttcatctcatgatttttatgcagatgatcaattcaaggtgcgagttcaaagcataaatatatctattatttctcacggtcataagtatggtagagttgtatgaagaataagggtcacgaaatcatggaatatagttcttacagtgatacaagattcgtaaggttaccgagctcctttggaataggtccagataatgaattgatgcgaaa

SEQ ID NO: 23568 - DNA, 311 bp, Oryza sativa
agcaaactaaatatagccatttttttagcaacattaccaaaatttagtaaggttaaccctggcatcaaagtgaacagaccctaagtttcactttgaactactcctaactcaaagttttcacataaaactaggtatgtttacctcttttgcactttgtaccaccctctctatctctttctgctcccgccccagccacccccatttttaccactacctgaagcttgatcgataaggcaccgctgagttccttttctcccacgctggtgagcttctcccagtccggtttctctctcgtgtccacgtgccttagc

SEQ ID NO: 23569 - DNA, 1501 bp, Oryza sativa
tacacaagaccatttcccattcagcaatcaagtgtcaaaagctacttacccccatccatgaccatgaacacgcacgcgcccgcgcacgagcttatcttttgccaacgcttgactctttccccagtttcccctcctcttcaacagccgcaacccgcatcctcatgtggacagagagacccctgacccatcatccccgttccaaacaaaacccaaaatacggattaatcattagtttaatattgcaacaaccgcgcacatgtttagtttagccacttctcgttggccgtgcgttgcatctgggacaagctggggcttcttgcttcttgctcgctcgctgctgttttacactattcacgtttaacatttgaccgtttatcttatttgaagattagtatttttattgctattagatgataaaatatgaatagtacttaatgtttgactaaatatttttaatttttttataaattttttaaataagacggatggtcaaacgttagacacggatatccacggctgcacttaatttgagagggagggaggcagtagaatctctcttttttttttatacagttgacagcagcgtcgccgtttgatgagcagtacaacaattttggtcaattcagaatagctgactgtgtattgtgtgctgcgtgcgtatatattgtctccagtattcgtcgcagcgcgcgtccctttctacgcccgacgatatcatccatctcacccgtcgtcaccgcctcggctcacagcttctcttctcccagaaacggagaagagggggaggaggcgagcagaaggctcaaggagggagacgatgagggtgatgagccatctcctcctccatggcggtgtgctcctgctgcttcttgcagcggcggctgttcaggctcagcgggtagcaaccaagactgatccgactgaaggtgagcacgcgtgcccgcctgcttcgattctgatttctgaatgaaacgagagttcttttttttgggtttgtttgagaagcggttcgtcctgatggagctagttatgagaatctgtgactgtaaggattccgccttcaaattcgactggaaaaatccgccttttcgggagttcttgccttgagattcttgtttttttttgggataatcacttgatgataatccatctctgctttgctccgttttggcttgtgctgaagattttccgttgttgagcttggattgaagcttgccatgagaacacctgcatcctaattttgaagcctgcaactccgcaagcatgatgatcctgttcttgagttgtccttccaaaaaatttcagttcacgacgccgtcgtcactcgtcacccaccgatcgacatgaactttttttaattattggccgttgaccttcgttttttaagtctgaaaccatggcatgtttgttcaagctcgagccatttcggcgtcttgaccgattgctggccgtccgatcgtcgcgacccaggccatcggacggtggagaagttccaaggata

SEQ ID NO: 23570 - DNA, 371 bp, Oryza sativa
caagaccacattatgcacaatgatcaagctgagccgagaaaatgcgcaaaaataaaaaaaattgcaattgttgctcaagctgaaataattaggttacaggcggcttacagcttgatgaggtgagtgaggttcctgagctcttctgggatcgggccgaccacatccagcgtgttgattttcctgatccatcaaacaaatcaacgagacgaacacgatgaacatatgaaaattcctcaatactctctccatcccacgaaaaactaatctagatgaaaatgggacaccacttagaacaacgaaatctgtacatctagattagatttgttgttctatatggtaaaccatcctatttaagttaggtcttttttagg

SEQ ID NO: 23571 - DNA, 1501 bp, Oryza sativa
acgaaaacactggacgaagaaaagtcttctggcttcatcagagcacagtataaaatgtcattccaagctagccatctgctgaatcatatgtactatgtgatggcaacaacacgacgcatgcatgtttagctgctttaacacacactccatcggctacattagttggtcatcagaacagttgttgctagcagctttgggatgccactttgggaattttttttgaaaataatattattttaatggaaaatcgcaaaattataggtcggctagacgaaatcgcaagtttagcgccctgtcgaactgggacagttcgataggtacccctgtcgaactggggcagttcgacagggttctgtcgaacccctgtcgaactgccctagttcgacaggctagttgtagagtcgaaaaaaaataaaaaagtacttgctacagtgcccgatagggacgtatcgaacagggggagttcgatagggcgcgtggcatggacgtatcgaacagcgggagttcgataggcagtgtcgctacagtgtttttccttttttatgttattttattacctgtcgaactggggcagttcgacgggcagttcgacaggtaccctatcgaactggggaagttcgacaggtaccctttcgaactgcctccgttcgacagggtgctaaacttgcgatttcgtctaactgacctataattttgcgattttccattaaaataatattatttccaaaaaaactcccactttggtatagcataaacaaaaacagaagtggtactactagtacgtgctgcgatgcagcatcaccatgcatgattgcatctttgtttccatttgcctaggcactatttgattcagcttagtattattataatctgaattattagaagtaagctgaaacaaacaagtagattattatgctagattattataatctataagccagattattataatccaataatctcctttagaggagctttttccagattattgagtggctaaaaaacaactacccttagatgtctctaataatctagagaaacaaacaactcgtagcttattttatattagtttattataatccagtttagagtaatctgatttaataatctaaattacaataatcttaaactgaaacaaacactacgtaatactctcattactctccctcatctgattgcatccttgtgtgcattcgcctagctaattaatgctccacatcatctgtcagccactctgatccatcatcttcttcggagcaaaatccaagaagaaggggagagagagagagatggatcctaggttgagctactgttgctacctccatggctgtctctgcgagcttgtgctgctgctgtgttcttggacagcaacagatgctcaggctcagcaaccaccacctcacactgatccaaccgaaggtacacaaccacgcaatctaatggcgtttgattagcgaggagatcgaggtgaggtgaggctgatctgtcagttagtttaatt

SEQ ID NO: 23572 - DNA, 404 bp, Oryza sativa
tccctgatgaaaattactcaaaccaatccaaatctcatggcacgtttgaagatggacaacacgatcataatcagaacgaagaatcccactcaaaagaatattgcgagctttgcaattttgttcaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaa

SEQ ID NO: 23573 - DNA, 1501 bp, Oryza sativa
ttagactgttggttctaatggctttgttggattagtgacaccgctttggtgttggttaattaaaataaaccacatggtgggctgtgggtgcatggtttagcaggtcgcacctatggcagttaaggaccagttcgcgggatgccctggaagaacttatcgtacttatcacaagccagcgtgggcaacggctaggcttgtagtgtagctttcctctagtcgacgcatccaggcaagggtgggcgtgatggagcggggcgggcccagcgacggcctctgtcgctttcggattcacctaggcacgagaggggactgcccgttgcccgctggggacgggggtgaaacctgaggtgtggtgtgcttggctagagggggttatgcgaagggtcctgtcacggcctctttccggtgtgtcgtggtggcatgtcggcgcacggaaacgtgtcgaggagcttcctcaccgtgttcgcctggaggtccacggctacgtgggtacctgcctagctaacatggtggtggaggcatctggaggcccagcagatcacgcctgtcaggaggcagcatacctgatgatggctagactacgggagcgccacaactacatattccacgacacggtgtaccggtttcaccctcggcgagccagcagtgatgatgtcagtactttccgtccgacagccggcgagaacgacaccacctttggtcacatgtgtgctgtgatgaggggattggataggatgcactcggacctggacaaggcgaccaaggccttgaatgatgggaagctcatgaggatcgtcgctctgaaggacgagatagcgcgcctgaagagggagaacgctcagttaaagggtcttcccgcgccaggaggagtccggatccgcaccacgccccgcaagacgatgactgcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggcccagccagaggcaacggaggttggttgtctgctactcccagtggcagccacgatctcagcagcagcagctccagtggctcagagtcgggcagcggcgagacttatctgccagggtccggaagtcgctcagagggacctggtgacgagcaggaggacgccttcgactccaccgaccgcaggagccgttccgagcattaggctcgttttccattagtttacagactgtctagcttctgcttgttagtttgtgtgtttaggttgcttgtttggggttagtcgacggtcgatatcatgtgcctatgatatggctgtcttaataaggatttttgcttgctctttaagtgttttaattcagatcagaacaattgcagtttaaattcctatgtaataaagcttagttcctgagcatctgtttttcttcttttcccccgtctgcttttccctccaga

SEQ ID NO: 23574 - DNA, 1501 bp, Oryza sativa
ctctagctacacccgcgctgcgccgctgctaccatcggctctgtcgctccacgccgcaccccggcccctactccgtccttcccttccaccctgcagcaccattcccacctccaaggccgagccaccgctgcctgtaccacctccagccgcacctcgccgccgtcctagccgtcggcgcgccacacgacaacctccaccggcttcactgtctcgaaggcaagcacggccaccacttctcctctgcaaatcgccacccgaaccccgttttcccgtgcaccgatgagcactcccttctcaccctccatcaccggcctcaattcctcgccgttccctgtcccctcgcgctctcctcaccccgtccgctctttccgtaggacattgccgtctccgtccaccgcctccctcccgtggaccgctgtcggagcaccgttccgcctccgtccagacgagcgctgccaccgagctctctccgggttccgccaacaagcccttccggcagttgccactcgtcggtgctgctcggtgagctccccctctcctttcccactaccctccgccgcttttcccgccgtcgccactcgccgttggtggcctcttggccccaggcatcgctgccactccctgccggctggctgtcctgtgcccacccacgtggccgcgccgctcggccgatctgggttgtccgcgtggtgcccaccgtgaccgccagtggctctgtcgcgttggcaccgtgtcggcgccacgtgtcacaggcgcttgacggcaggcacgagctagacaccaaagccttcatcatccaggatctcctcttctgggtttgggaaaaattgagcaagattgagtacaaccaacgtactcaacaagacacacccaccagtgcagaataaatgcaagggagtacaagggagttataatgtaaggggttagggtttgcagtaaacagcaccaaaagacacttagttgctcaaagctattttgtaaatacgatcctagagctatacaatattattaatcaaggccgtgaacccacacgaacctgccttaacccaaggcctacgatgatttggaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcgtcacgtgtaaccacgtgccacatatcaccacggtatacggacggaagacgtgacatagtttccaacccatcctagccatagacaagaataccgacccaaccccacctacggccggaacctccgggacaggtaggcaggtctgagcccctagcagcaggacaccagccctgtgccatgacatctcgactaccgggccgcagctcatgtagccttcatttgccctaga

SEQ ID NO: 23575 - DNA, 1172 bp, Oryza sativa
cagcaagttgaggtttctttcgtaaccgacaagaggggtatagtgaaattggagccgtgaccttcgcactgtccctagaacgatggttgcggcttctggtggtgtaggcatctctgttgcgctagcgcccccacgtgtcttcgttgtagtagacttgcccgtcacccctgcgctcgctgctgcgggatctccccgtgatacggccctagagggacctagagcggctccggtaacgcgggtgtgggcgaccgccgttgccatctgggtcctcatctagtccctgcaccgcactggtctcctgcctgcatggaataggcagagggcgcgagcgggaatgagaaacatcatcataggccccataggaccactcatactgcttatacaacattggccgaggttgatgatcttctatggtatccaagtggataatgaccggggatgaccacccatctttgggccccgaaagatgggggttgtgcatggggtcaatgtcaggcacaggggtatcaatggggaccggctcatcgtccggatttaccaaccccagccaagccatttttgggatggcgtcggggtcgtttgtccaaatccagaggtcgaaggtgcggttgtagttgtggcggcgcgagtactcttcaatgaagtagatggcacatctgggcccgatcaacttgactgtcgtgacctcagtgcgcgcatgcattgggatgccctcgatgcaaagccgcgcccagaaccggtaatgcacatgatgtgcatcctgccgggcatccaaagccttgaggtggtaagatctaccagaagggcagtccagccttggctgctgtaacgccccgattttcgttcgcgattaaaaattaattaatatatcatttctagaaattatattaaaatttaaagcaatttaatcaagtgaaataatgggagagttaaaattttcccttaaaaatcatggccgagggtattttgtaatatccattgtgccctaatgaactctctgaaatttcccacgaattttcaaagctcaaggaataattttacaagcacaaagttcatttaatcaattaaaataaaaaggaaaccaattaaatttccttccttgtccttgggccgtttccggcataagctttctaccctctcgcggcccgcgcgccccctcctactctcaatcc

SEQ ID NO: 23576 - DNA, 1501 bp, Oryza sativa
ctctggtgcatctgctggtgctgctgctgcatctgctgcatcatggctgccatcatctgtgtctgatgtgccatcacttgggctagcgtcggattctcgggaagtggtggcggaccattgccggagttgctgttgggatgcacaccctcagtgcgctcttcgccgttgctgccctcgcctgttgcgcggctaccattcctggtgtagaccatctggagggaaaagcagacgggggaaaagaagaaaaacagatgctcaggaactaagctttattacataggaatttaaactgcaattgttctgatctgaattaaaacacttaaagagcaagcaaaaatccttattaagacagccatatcataggcacatgatatcgaccgtcgactaaccccaaacaagcaacctaaacacacaaactaacaagcagaagctagacagtctgtaaactaatggaaaacgagcctaatgctcggaacggctcctgcggtcggtggagtcgaaggcgtcctcctgctcgtcaccaggtccctctgagcgacttccggaccctggcagataagtctcgccgctgcccgactctgagccactggagctgctgctgctgagatcgtggctgccactgggagtagcagacaaccaacctccgttgcctctggctgggcccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgcagtcatcgtcttgcggggcgtggtgcggatccggactcctcctggcgcgggaagaccctttaactgagcgttctccctcttcaggcgcgctatctcgtccttcagagcgacgatcctcatgagcttcccatcattcaaggccttggtcgccttgtccaggtccgagtgcatcctatccaatcccctcatcacagcacacatgtgaccaaaggtggtgtcgttctcgccggctgtcggacggaaagtactgacatcatcactgctggctcgccgagggtgaaaccggtacaccgtgtcgtggaatatgtagttgtggcgctcccgtagtctagccatcatcaggtatgctgcctcctgacaggcgtgatctgctgggcctccagatgcctccaccaccatgttagctaggcaggtacccacgtagccgtggacctccaggcgaacacggtgaggaagctcctcgacacgtttccgtgcgccgacatgccaccacgacacaccggaaagaggccgtgacaggacccttcgcataaccccctctagccaagcacaccacacctcaggtttcacccccgtccccagcgggcaacgggcagtcccctctcgtgcctaggtgaatccgaaagcgacagaggccgtcgctgggcccgccccgctccatcacgcccacccttgcctggatgcgtcgactaga

SEQ ID NO: 23577 - DNA, 1501 bp, Oryza sativa
catcttgcataccatccctcttatcgtggtagactcgaggagggaagtggatgaagtgaaagagttgatcgagattgtgagggagtatgtccttggcctgaggatggaacttaagaggaaggaattgagagatgatgtcaaccgccaacaagaattggcagcttacttcactaactgcaagcttcagagagttcatatgaggcttgtgcttggaagtgctatgggtttgtgctacaagcaaaagaactttgctactgcagagcactttgcaaggatgctgctggagaacaaccctaatgagagccaagcaaagagggcccgacaggtgcagcaacagtgcagtggaaagaaggatagctgtgagctgaactatgactacagaaatccatttgtcgtctgtggtgccacatatgttccaatttaccgtggccagaaggatgtttcctgcccgtactgtggatcccggtttgttccttccatcgaagggcagctttgtaccatatgtgagcttgctgtggttggtgcagatgcttcaggcctcctctgctcccctacgcagttgagataagtggcgctaggtaaaactcccttatattctttcttgtctctcaacactttgctatgatatattttaccatgatctgtactgattgtaaggaaataagtattatacatggttgagtttttatttcactttctccccatttcccttcttgatttttgtttactgttgttacacttgatatatgctacttgatatatgctcaaggactttttgatcagctcatgaaaatcctacgctcagactttatgtaccaatgtttgattcactagggtaaattttcggtgtcgtggtgtttactttcactagtaactatgctaggtccgtgaatgtaacagttgccaatgaccaacttaaccaattatgcttaattttgtatttcaatccagacgtgtgtggattgtgctagggtaatacaagcatagtttattatttagaggattttgctgttattgaagacaagagatgcatcagttaccctcttcttggtatccttagagcatctccaagagagacccaaaacctgttctctaaactaaattttatgtattaaatctaaaattgtatcaccagcatatctacaacggggcacttttggtgcatatataatctcatgagctgttttttggtgcatacctatgtcatttttacactacattttatcatgtctggtaataatttttgataaaaaagtattcgattgcagatgccttatttccagctcaggaaaaacaattggacctttaatgcttacatggatggaaaaatgggatgttagatttgatttgtgatcagagaaggccattacatttgtgcaaaattttgaaatttaatagttcatacaaaaaagtgtgcaaatccaagaccaggctcaggataccaaggaacctcatcttgcctatgtaaattaactactttgagcagctgtggctagaagaa

SEQ ID NO: 23578 - DNA, 551 bp, Oryza sativa
ctgaatttatcctcaatggaaggactcaaggagtacacagagagtgaaatggatacagcatttgtcaggctgttgtacaagatgacttaagcacaaagttgaagtaatgtagaaaattaatatggaacggattgatgatatatttctttgtgcacaagagaattattagtacgatgtgagagccatgaaagctgctggagatttcgtatgtggaagaaaaagaagggggtttcttcctcatcatcagctgcaatgcatgttcggcagcaagggattttgagagagtttgtttcgttttccacgtacacgctttccgaattactaaacgatgtgttttttttataaaaaatttatatacgaaagttgctttaaaaaatcatattaattcatttttaaagtttaaaatagttcatacttaattaattatgcgctaatagctcacctcgttttacatatcttatcaatcttctcttttccattttacaaatagagccctttacttgtatggatataccattttcaccacggaatccgaaacaaaccgccggcca

SEQ ID NO: 23579 - DNA, 1501 bp, Oryza sativa
ccgagaggaacggggaggaggccgaccaccactggggtcgttttctggagcctctgcctatgcaatattgcatgtaatttgcatttgcacacccggccggtggccactgccggtgcaggtgcagcagcgacgtactactagtctactactactactactactacttctacctcatccccctggatggatagctcatagctgggttcagacttgatctagctacatcgtcatcatcagtgatgtgaaactaacattggcttagctagctagctaggtgcgcatcgcaccgcatgcagcagtgagtggctcatatgtgctgggagttgggaccagaccggtttggtcagaattatcggcaaccggtggtaaacggccaatatcattacaaatttaaatttgttttattattttttcattctcaagtttgtaactgcacggccggatgtgaggacctgcaagtcacagtgatgtgtgaggtttacatacaagaatagagttaaatacccgtccacgaatataagaacttctagcatttaaaattttatccataaatataagcatttccgaagaactacttccccctccaaccacccctcagtaactgtttgcgcagttttatcccaattgtagtattataaagggcctttcccatctcaaaagctagccgttgaggtgaggagctcccctacttatatattaggtccattgccctttcacaaccaatataagactattcaacaccaatcaccccttatttaaccataggcatcatagtcttttcgcttcatttttaatctctctagaagcccttatatttgtggacggagagaccgagagagaatagacaacgctgtcaatgattaatcagggtgtggcatgaattgttcaatgggggtctaccagaggtactaacatgtaatgaccaaaggatcaagtggctggatgatcaagaattcgttgttggaaccttatcatgatcattgatttaattgacagctcacttagagaggagaggctccattaatctgcatggccaaattatttggactgtgattatctataatttgcagaggttcaggtatgctcaatctggtaaattcctggaatcattttctctttctggttcatataagaacactaaattatttccatataatcctctaagataagcaatcacaagatatgaaggaaatattgacacgcaattaaggaatttttcactttaaaaacaaacaattcctcctttttttttaaaaaaaaaagaaacaattccttacctctcatatcatatcccaaatcttcattcataaggtctggcaaagattctaaatcacccctggaatcatttcgttgtcgacagcactatcacctttcacaaattctgcttcatctgtttgtggaaattgtactctgaaagggaccaatacaaatagaaggcagtaagttagtaatcaaccatggcgtgcacattcaacatgttattttcgtgaatccaagtaaa

SEQ ID NO: 23580 - DNA, 1501 bp, Oryza sativa
aaaattacagaagatgtacgaaaaaagtatccccagcagcacatcctaacatcaaagtaggcaccacttattgttgtcagccagtatgccatagtaccctgcatgacatgtgagcatctgtcaggatagcaattagcaagtgctatatccagccagcaaaatcattacaaaagtaaatcatacgcttattattcagttataacatcgacaagcccaacaattagtgtaccaagaagaaggttttttcctttgtctagaatataacttcggggtccattgcaaagcacaagatatgaagtgggtaccatctgaccaagtactggctgattcaccaagaacgcgatacaagacagaacttcaaataagattgtaaacaagtgaaacttttgccagagatcacaataatggagatacagtctgttcattcctcactggtcccatgaaaacaggcagcccaatcagtgcaccggataaacactaattgcagcaactggtaggcatcagaacacggaggctacttagactgagtgactgacaagagattgtggatgatcttattagccattcatctgctttaattagttgagatgaacgtagagaatggatccttcacccccactaaaacaaatcttagttgaacacaactaccaaaagaatatacccaacgattaagtccattgcagattactggcagaaatgacatccatgattccggccgtcctgttcacatttgcacaaacatgtggatggcagtgctaagaaaaacatatgtcagaagtaaatttgactgagattaacagaatgccacttactgatgcacgagttctttttttaacctttgacttgggaaccaatggctactacaaaagtaacaattatgaagaagcatagctatccagaaattaattactagtcacaattgccacttcagcacaaggactggatgcacaacacaccagcaaaacaatacacaccacagactgttcttggttgaatcgaggagagcaccagtccacagaaggagcctgcacattcaccagagcaaatggttggagaggagcctgttggttcttgctcaacagaaggcattcgcaagagaatctatccttgcagatcagctggaaataaattgcttcaggagttaatttgactgcagctgatcatctaccaaaagaagtcaactctgtctcgtgatagaatctgccgacttgtcttagctaacagcttcccacatctcccatctaaaacacgcatgccctgtccgttgttttcctcgtaaggtacaggacacgagcagtttccggttcccttctttttaaaattcctcaccttgaccctgcatgttcatcatgtgcagcatacatatatatatatatataaagacccagcctccacaccctctgcaaacagagttgggtggccaagaacaagaacagcaaagcaaccatgacccaagctcactcaaaatcttgcttccaccagttctgggatggactccaga

SEQ ID NO: 23581 - DNA, 1501 bp, Oryza sativa
agacataagtgatttatactgtcttggcgtactgtccgatctatccaaatcacttagtttaaatgtattctgaggggccgattatatgtttattaatatctacagccgatcaggcgggcctatgtattcttgtgctacatacttccattgccgatatgatctttaccatatcggtctgatattgatacgtcaacggcaatctagccgatcggctatcgtttatagatttaactttgttcttttttgtttcttgttggttgcaggattaaactaattggcacgctcagaacccgaaggcaagtttttttggacctgcactagattaaagcaaatctctcaggccagtgtgtgtttttcacatcaacggattataaaaaaaatatgaaatattagtttgaatgaaatttattaggtattgtagatgttgctaatttctctacaaactcataaaaaagtcaaaacgactcataatatgatgaaacggaaggagtatttcgtatgtagtctctggctctctgctactttctcgttattactccctccgtcctaaaaaagacaaatcctggttttcgtgtccaacatttgaccgtccgtcttatttgaaaaaaaatatgaaaaaaattaaaaagacaagtcacgcataaaatattaattatgttttatcatctaacaacaatgaaaatacgaattataaaaaaatttcatataagacggacagtcaaagttggacacggaaacccatggtttatttttttttttaggacggagggagtatggtttaagctaggtagtcatgaggatgaggggctggctgatccgcaatcagccgcgcagggccgcacctgcgtggtcagttccgtgccctccagtcctctctcctctgcagtataagtatatgtatatcctctatatgcatacatataattttgtattacacgatacaaagttatacgtatagatatatatacatatataattttatacgcatacactttgatgtataaaaaaattgtatacacgtataaaactttatcgtacatacatatttaaaaacccaaaaaaccaagggaaaaaacaaaaaagaaacaccacgtatacaaagtttatatacgtacatatacaaaagtatgtatacaaactttctatatgtatattcacatatacaaactttttatatatacatatcaaaaacggggaagaaatcaagaaaaaaccaaaaaaaacccaaaaaaaataaaactgaaagaaaaaaaaatagagaaaactcacgcatatgaccctccctcgtgctcctgccaccacccctccttcgcacgcgccacgtggctacgccgcggggggggggggacgcgtggatatccgtgaattagcaaacctaggtagccatggtcaataaagttccatgctcacgcagtcatgcttaagggtggatgtcaagctggctcggctcggcttggtctcgcttattaggataacgagctagctcggctcggctcattat

SEQ ID NO: 23582 - DNA, 1501 bp, Oryza sativa
ataagttttacctcttgttgaagatcgaaaccgatgcagctcaacccgaaagcaagaactcgtcgaaacaaaacgaaagcaaaaagtgtggcgatgcaccgagattgtattgaacgtgtgttagtttgattacatggggctcggggtctatttatacccaagaattacaaaacatgtccatatcggacacggacacgattcttatctctaacaaactctaagataccataagtctttgcggcagacttttgcccaaatatatctataagaaaattacataaaatattctaattaatagatacaattgtcttctcatgactctatccatgcatggcaatcatcttaaagcatatcaactcaacccgatgacgtataccgagttgtattgtcggaatcggctatatcaactcacccagtccgactcggactcagccgatcttggtcgtagccaatttggactccagccgattcttactctgtttccgaaacgatcttcgtctttgattctgctccgatctaatcttcatcttcgatactgatattaccaaatttagtcgttaacagtactttatgtacttagagattagttttcaacacaagatgccaaacacagcatatggttcatccaatgtggtatttactttttttttcttgtggacacattctctaattaggactcttttgacgtgcctcatcacagcagaaaaagaagatgacaattagatcgaacgtaacttctctaaagcaaggtcagagaaacatgtgttccttataagtgagatccactgttatgtatttaagcgtcagtgacccacgtccctctcatgtctcacccaagacatgagccaacagctatacaggtaaaatagtggattatgggagacaacagtactaactagctatgtctgctttaagtatatactttctccgtttcacaatgtaaaactttttagcattgctaatattcatttagatgttaataaatttagacatatatatgtatagattcattaatatctatatgaacgtgggtaacgctagaaaatcttacattgtgaaacggaggaagtaattttttcgatgtagttagtgcaactcgagaatatttatgtaagaatagaattatgagttgtatgctaacaccttgtttagtaccaaacttttttaaaaaacttccacttttccatcacatcaaaactttcctacatacataaactttcaacttttccatcacatcgttctaatttcaaccaaactttcaattttggtgtgaactagacacagcctaaatctaatttacttctactctttgaaacggaaaagaaaaaaaaagagctataggagtaataataaagagagaaattaaaaaaaaacagagagaaaaagagagaaaggaagataagagaagaaaaaaaaaagagaaggggcaagtcttccccaagtcacaccatccccgtcccggatccggcgaccaccgattcctcgccgccgccgacgacga

SEQ ID NO: 23583 - DNA, 1501 bp, Oryza sativa
  unsure (1)..(1501): unsure at all n locations
gnnnnnnnnnnnnnnnnnnnnnnnnnctcctttagactgccaactgtgtctgagagtgattggacaccgatctccaacacttggcctcgcaggtttccttcatcaaggttgggtacagacactgagatgtgagcagggccctgcagggaagagaagaaattagcacatggaaattcttaaaattcaatatacgcatacaaaaagaacaagactaacaagaatgtttagtagaaaacaggaaagtggagaagaaatatatcaagaagtattaccgggtgctgagcaaggaactgttctgctggtataagagaagcgtcatctgttctcagccttttaggttctggttcatcaggttgaggtggctgctcctcagcaggtggttgtggaggcaaaggtggtggaggctgaggaatcccaatggggttgaccatggttgccatggttggcatgtgtggcggtggaggcatggagtatggacgcggcgggccaggcatgtagggattttggcctggtggaggcggaggtatattggttggcataggacccattgaacctggcatcctaatcacctgcggctgacctggtattggcggtggtggaggcggatgcatggtaggcatcatatgtggaactccttgcatgagatgaggttgttggtgtgggggatatggcattgcactaggttgaaagcgtggaacattaaccagtggaagtggctgaggaggtctaagcaatggcatgggagggcggggaagtggagctggaccaggaacattcgaagcatcaacctgttcctcgccgcccatagacagagcctgtgtggcagtacgacctatgctaccagaatggccatcccaaataacctgctttggctgttcatcctttttcttctcaatttctgccttgacagcattagagacctcttcctctgttgttccaaagatgtctggcctggtacgggcaagacccacaatgttcctggagatttcatcatcaggagcaagtgttgtctccttaatttttgccaacatccgctctttctgctccttatattttggatcaataagcgagatgcgcatgtgctcctccatctcactaattggaatgagctccccagttattggtgagacaacgaatttcgttgggtccctctccgcagggattctctcctcaggcctcttgtagttcttgacaatcctcataggcggctcctcatcaccagcaagcttaacttgaactcctccttcattttcctcgagccttgctgcacgcattccttcctcaacaagttgaatctcctcctcgtccatctccatctcaacatccttcgctggctcggccaattccatggctgcctcctcctctcccaggtcctcaatcctcttccgacgcttcaactcctccagcgtaagtggcacagggagtccctcgcactcatcatctgcaaactcgatcgtctcgacaacaacaaaatcatgccaatcgatcatctgcatctgca

SEQ ID NO: 23584 - DNA, 1501 bp, Oryza sativa
aaattaccatgtttaggtttgtgatgatgttctccaagagcatttcaattctcctagttgccccaaaagacgccaaattgacgatattaatagaaacagagaagacatcgaacaaaacaatagggcaagtggactgctcagcacaaacagcacatgcaacctaatgatgtaattaggtgcgcactcaacactaattatcatgtccgtagctacacaacagagttaaagtaacactattgctccactcttgcaccagagaccgtgacaatgtccaaaacttagtataaaaggtaacttggagatgactataagagcaagtttaatagtatactggttccaaattatatatagctaatctaatagcctattcatacaatagttaactatagaaatatactacactattaatacccggtcccacttttcatacacacataacgtcttgaagtccgtgttgcagccggctacaaatctgtagtctgctttcttctctctcttatctttttttctcgatatgtgattatagctgatttatagcttgctattgtacctgctctaagaaatgaactctttcgatgatgtagatttttgggccaaattctggtggtgtacatgaaaaatgcataattagatatagtgcacaaattgaaaatactctacgcgttcacaaataacagttggttttgactttgagttatcctatttgaccgaccattattttctaataatgtaactatttaatactaccagagttgtatcattaaatctgtaatcgttatctaatgtattacattcaagtctattcgctttaacgtctcggtaaacgattgattttgccaacatatacgtagagtacatcagtaatccaccttggttgtagctctttaactaaagcctaggattatattccattatataaaataacatcggtagtgcaccttaggccatgctcttttcagctttttctctagattctcgtcacggattagttgctccacgcttctaacattacgatttctaaaaataaaattactttcaccgtattatttagatcactttgttacagattttgggaagtttatttcttattaaatattgtgctaaccaagtaaacaatccaacgaaaaagaatatgttccaaacaacccgtccaaataaagtgtttcataggtacctagccgcgaaaaaggccgctcttcacgagattcccaaacatcgtcaatttcttcaaaccgatccacccccgatgatatcgcctttcaccgtcgcatacaaatagagacgcacccccccccccccaccacctcacccacacacccacactctctacccccaaacttgccctccaatctatctccgccgccgccgccgcctccgccgcgagagggcgtcgccgagctgcgcgggaggctcgcctcccgcagcatctggccggattcgtcgtagtcgaggcagctgtaagcgagagagagggagatggccgcggccgccgggaaggcgg

SEQ ID NO: 23585 - DNA, 383 bp, Oryza sativa
acgacagatttacaactagttttttttatactagatttaaaactagttaagatgtcgagacccaaaactaacaacttggatccgactgagattaatgtatcaatccctggatcagtaaaaattgatacatacaatataactggttcttcattgcatacgttaaagtcttacaatatcaagggttttacaataataggtactcttctaactgattaatacacagcggaagtttctatacattctgactagtgaggtataacctttagggattttctaaattatcgaggtcttcgtagtaatagtcataagggtcctcttgacccaaatctgaaaaagggggttataagagcaaggatgagtattcacaatactcagcaagttat

SEQ ID NO: 23586 - DNA, 700 bp, Oryza sativa
acattccaaaatgcatataatcctttcattttaaatagttgtgacttgagtgttagtgctattttaattttgatccttaatcactttcaaagtataatattttgatgaatgaaatttatacgcggcatatataatttgattacatggtacaatttttttttataaattacatggtataatcttaactagatgtagttaaatctagtataaaaaactagttgcaaatctgtcgttaaaatagtagtcaaattaagtgtggatatgaataacatgtagtgacaattattttatactaatgtagtgactataagttatattttggactgggaatgaattgttaccaaaaaaattatgctactgaatatatcatgataattaattaagccctcttattgcaatagcataattaatgttttagacaaattatatggttttagagatgctgaacatttttatcataaaatttgatacctcactagcgagtaccacaaaaccgctctttaaaatactacatctgttccaaaatataataaattttaacaataaaactgcaaagttctttgtacctcaaacttatagccaaatgatatatttttgaatggaggtagtatgtattttctctgtacaatcatagatgcgtgcatacatatactacttatgtacatgacatgcctgaatttcttgctgctggtgccgtagg

SEQ ID NO: 23587 - DNA, 1501 bp, Oryza sativa
cccgccgccgtccctccgctccgtcgacagcacgccgtccgccgacgcgatctggtcctggagcccgacgtcggagagcgcgaggttgtcgagcacggcgcccaccggcgccagcgcccggaacccggcgaggaacgtgaggtactcccgctccgaccgcttccgcgggttgaagaactcgctgtccgtgccgttggtgcccttctccaccttggacaccagcctctccttccacccctccggcacctcgtacacgtactccgccgcgtccttcttgctcgcgttcccgccgtacccgccgtagttcgccgcgctcgccgccgtgccgtagtacaccttgaactccgcctccccggccgccgccgccgccgccgtggccggggacagcgccaggagccccgccgcggccaccgctgcgagagtggcggcgagcggcttcgccggcgcgagcctgacagccctcggcgacgtggaagaggtggtggtggtgggaagaggggaaggggagaggagggaggcgaggagcatggccatggtcgacgtcggagaggccggggggaggggaagatgcggtggttggcgcgcgttttcttgtgtggttttttgtgtcggcgagaggataggagagatcggcgtggcttatccggtgatgagacgacatggcagtatggcacttgccgccactgcctttcgctgtattttgttgggatcacctgtacatttcttcacaaatttttttttaaaaatttaacaaatataattatagtataatcatgatgtaattatactataacttacatgtaacttttaaaaatctctccataacatactatttcggtgaaatggaggtctgggaacgaatcctctcatatatatgcatgcagcgactttttttccttcttcacttgtacgaatgttgaaacaaatataacggttcaaaattatgtgaaagttatatgcaagttacatacaagttataatgtaattacatacaagttacagtataattacactacgattatactgtagttatatttgttaaatttttagaagaaaatttgtcgataaatatatagcaaaattgataaacttaaagttgtgccattgtttatttctgttatggttaggttctgagttaaaaatttgtagcttcacttgaagcaaacaccgggtttcatatccattatccaaaaaactccgtccccgtacaaacatgttttttttttctcgaacatttttcgccgctgttttgaccctgaaaagggcaggattgcacgagaagttagaaccccagaacgtgtcactgacgtgcggggccaaccaagcccatgggccctcatctcgggtgggccgagcgctttgcgaccactattcatgggccgaatactccttgtcggccgcagcctagtatagcccaaaaagagactggaagtggaagcgtactcatcagagaagtcagaaagggaggagagccgtcgccgccgtgggatgtcgccgtcgt

SEQ ID NO: 23588 - DNA, 1501 bp, Oryza sativa
atcaaatcaaggaaagataaattaacagtaacaagagcagtaagatgtttttggctctgaccttatgagcgaaaaacatagtggcagaaactgttgttgcaccattaccaccagaggccacctttcaatcagtaaaactcgttacaggaagcaataagacgagaaacatatatcaactgtaaagttttagtgcagatataactgaacacattggaaaacattctgaacgaccaatttctagtgtgcaaggtactcacaacatgtgcaatatcccttctagccgtcttctgaaactgtcttccacttacagccaagctcttcaattgctcgccgctaaggcctatcacattacgaaaattatccggtgttaattggagaataattcatagtagctagcaactacggatcacgcctccagcacttgaacagttgaacatgtatctgatctccgagtcacaggaaaaatcacaggactcaccaacatgtggcacgccgttcagaatggctatggtggcaggaaccgccccgttctccctcacgacggcctccacctccatggcggtctggagattcttcgggtagggcatacctgggatgggaagaaagccaaacgcgtcccccagccgcgggcgcacatcgccggagtgagccatgtaatccgggagggagacggggtggggaggaggcggcgaggcgcgagcttaccgtggcagatgatggtggactcgagggcgacgaccgcgccgccgcgcgccagcgccgcttccacctccggcgacaccgccacccccatcggccccgtgctcgacgacgacgacgacggcgacatcccacggcggcgacggctctcctccctttctgacttctctgatgagtacgcttccacttccagtctctttttgggctatactaggctgcggccgacaaggagtattcggcccatgaatagtggtcgcaaagcgctcggcccacccgagatgagggcccatgggcttggttggccccgcacgtcagtgacacgttctggggttctaacttctcgtgcaatcctgcccttttcagggtcaaaacagcggcgaaaaatgttcgagaaaaaaaaaacatgtttgtacggggacggagttttttggataatggatatgaaacccggtgtttgcttcaagtgaagctacaaatttttaactcagaacctaaccataacagaaataaacaatggcacaactttaagtttatcaattttgctatatatttatcgacaaattttcttctaaaaatttaacaaatataactacagtataatcgtagtgtaattatactgtaacttgtatgtaattacattataacttgtatgtaacttgcatataactttcacataattttgaaccgttatatttgtttcaacattcgtacaagtgaagaaggaaaaaaagtcgctgcatgcatatatatgagaggattcgttcccagacctccatttcaccgaaatagtatgttatggaga

SEQ ID NO: 23589 - DNA, 1501 bp, Oryza sativa
gtgttgtgtgggtagggtagacggtctactagatgatatgtgaaggacacaacatcttcggtttcatgtaaaaaaatgaacattttatttttaatatgtaagatcatttgtgtttgctgaaacaattgtattatttttttacctttgccgccatatgtgtggccattgatccaatcgtggccggtagataacctggcaaaataaagaatcttgaaagacattcgatgttagaatgtgtctcatgcatactggctaagactatacattggtgttattcctatcccaaccatcatctttgaccattaattacactcgttacaatcgaaccaacatccaatcattaattaaggtcgatatccttcatcatgtttcctattactaaatatttatgaaatcaaccataatgccctaaacctatcagtctgacttcgattactcccttagtccacaaatataagggattctaggttgtttagcaaagtttaatgttaaggttaaattactatgatgcccctaaagggaccttgaggattttgatgttgcctaggggatgaatagacatttcctaaattataaaaactttgcatcttaattagaactagttggagagtcctgtcatggtctggacaatacgaccaacacagagagaatgaaaacgtccttgtgagataaaactgtgacatcttggcccaattaggatatgacctatgtggcccatgagagttgtatgtacatatttagtaccacattgctagtttagcaagagtgaaaccaacttataagggtttgtccctccaaccatatcactcccagattaactctcatacacgaagcgatgacaaaagtgtaagtagggtagtatgtcgattggccttcaggctgagtgggtgaggccagcctactgaccttgcttcttgcatcggtcaggctagggtgccgggcttggcctagccctcctagcttcctggtctccagcccaacagttcggggcgagctgtcctaatgtaacaccaattgcttggtcggcctaggcactctggactagtcagttgtggttcctcgagaactcgtgcatttctaacttattttgactgacacttgcaaaatactgaggagattgttagtatttcttacattcacaaatactgaggagactgttaatattttcttacatttacaagattaatttgcaagcacccggaataccgttaaaaccattttaaccattagtatttcccaaggtattggatttatatttttcccaaggaaggtgatggtataaagatatgattttttttatgttccttaatcaactaataattaattcaccatagtctaaacatgggttaggataataattgataaggtagtggacacacaggagattcacctctaaaagaatatttaataggaaattagcattagaaccctataattcatatgtacttctatactaatcatatctagtatacacttaaggtacacatgtttacaacatagg

SEQ ID NO: 23590 - DNA, 242 bp, Oryza sativa
acaccattaggcagtaaaacccatccccctggcttagccggcctacaaacagagggttcactcacctcaaatctaatcactctcgtcagtgaaaactgagcagtaaaccgtttgtgttgtctaaaactctgagcttgtgttaggtgtgagtgtgatgttgcatatttactagtgtgtacgcgtgttcaccatgttatacaaaaaagaaagaaaatctctttagtaattaatggaggatgaga

SEQ ID NO: 23591 - DNA, 1501 bp, Oryza sativa
ggattgggtgaactgcccacgtatactataatgttatgccgtatgtaagtgtgtatgagaaagagagaaattatatactccctccgtactcataaagaaagttgtttaggatagcgatacggtctccaaatcatatctttaacttcttatttctataaaagtatttattaaaaagtgatatatgtatacttttataaaattatttttcaagacagatctattcatataatttttatattttcaaactcaactgcttgagagttattcatgatttatatccccaatgtttgacttaaatattgtcctaaacgattcctttataagtatgaagggagtatgtattgggaaaggaaattggtgcgatgtggtgtggagttgaggacgcgtagcttcattcactaagatttaattcctgatgtctataaattttacgcacttaatgtaagtgaacttttaacagaaatatagctgagattagaaatatgcctgttagttttcgtcttctttaaacgtgtattagctgttgtgtaggtgagtatggcgttacgctgttgcgtatgtaatggtgtgcgtctaccgtgtaatagtaaaataaatgacatcgtgtacatggattatcgctaatgacgccattggattagtttaggttgcccatggagcctaaggtcccctaacaccaaccctaaacccgtaatttaatatcctctcgtgaatgacagcacggtgacgctgtgctgcgtaggaaagccactagctggtgccgtggtgcagcagagcagcagcatcacgccaatgactcgaggcattacacaatcgattgatacgctgttgccttcttcacgtgcccgcgtcgcagcgagcttcgcctttccacacagagattttgtggagatcgcattctcctctcctgtgtaaataagtggctgatcacatgaacgacaatgggtggcaatttggcaactggcaaagcatcgcaaatttgcagtgctgcattctaggatagatatgctcgtatcaccaaaaagagagactttaggaagccgacgagttccaaagtagggactccctatgtttctaaatgtttgacgccgttgattttttttaaatatttttgaccgttcgtcttattaaaaaaatttaagtaattattaattctttttttatcatttgattcattattaaatatacttttatgtatgcatatagttttacatatttcacaaaagtttttaaataagacgagcggtcaaacatatttaaaaaagttaacggtgttaaatatttagggaacgagggagtaaatgactacatgtatgcgcagtagcattagatctcatgcaatcctccttccccgctgcattgatacaagaactgaaaaccaaagcattagaaatcacaatgcagtcacaacatagatcgaacctgacaaaaactttgtttcaaaatactccaatcgatagtatttcgtttcatattatataagactctctaatattgtcta

SEQ ID NO: 23592 - DNA, 1501 bp, Oryza sativa
agctcgtcgacatcaatgggcctcgctgatgccctcgcacctatcaacctaccaaagatggatgaacctcatctcagatatatgcatccggtttacacttgcctgcatatattttattttaccctaacgaacaaccataatttaacagggcacaaaattgtatcgcacatatcgcacctaaaattgcgatttcaattatgtaatcactattttataattaattttttattaaaatagtgctatttaaaaaattcgggatgcgatcaggtggagagagcggagaggaggtttaatagtatagccaattactagcttcaatttatctatagccaatctaatagctcattcatataatagttacatactaaactattaataactggtctcacctgtcatacacacactgcgtcttgtagtttatactgtagctggttataaatctgtagcccgttgctctttgctatcataattgatagcctgctacctgctctgaaagcaggccccctcggtcagctcgacacgctgcctcgacccgtcaaccgggcgcaccgtacaccagctaaattatattgcgtcgccctttcgccaacgttacgtggttggcttgctggccgcgccgccggagctcgcgccggtttcgcaacgcgcgtgccgttagctagctagcgatcgacccaaaaagagggagtctccgtggcgcgcgtctccgtcgatctcgtgccttccggaagcggccgccccgggtgccacgtcgcggtggcagctagagccacatcggtgagcaggacgcctacactttgagccacgcatcacctgtgtacagtacactactactagtagtacagtacgtctacagtaaactaattgaggataggagtagtactctctactagtcgttcaaaaaaaccaatcataaagctagatacgcatgtgttagtattgaatatgacgtgtttgtattgagtattttacagatgaaaaaagtataaattatctctctaaactgtaacgagattcaattataccttaaactacaaaaccagacattctttgcccttaaccccagtttaatccgcggtggttttgatactacgtggtagtcccgtcataaatttttttcccctcatcctctctctcgggcgtcattgggcattggtcaagcagcggcgcgggcggtcgacgcgcacgatagcacacagaggcaggcggcgggcgtggcgcgggacgcaaaggtgggagtggcgaactccgggagggagctagagaggcaacaatgagctcaacagcgccccggtactcaacagctgcggcctctccccaatctgatgttgccggctatctatctgacggggacgacaccttgaggagaaggccagggaataggaggactgggagaggcgcggctgactgccggaggaggtggtggagcctgcctgtgaggacgggtctctattggagcgacgttgttgatctggatcctcgccaccggtcggtgggtatg

SEQ ID NO: 23593 - DNA, 531 bp, Oryza sativa
tgttctatgggctagaactcgagcccatatagttttgtgatctgactagtcagagaaccgaatatgtagcattttttgtgtcctctggatcttaatctaacggtaggaaaaaatctgggtgattttgacccaaggatttgtcgacaaagacatagctagtttttgaggcatcggccgtgtttaccagagaggacttgtcagttaaggccgagtttagttccaaacttttcttcaaatttttaactttttcattacatcaaaattttcctacacacaaactttcaattttttcgtcacatcgtttcagttctaaccaaacttttaattttcatgtgaactacacacagcctaaacaatcagcttatgggcagataggatagtatcttacactaataatcctcacgtgctgtgcgatccgatccaacccaagcgctttgcgtgtgtcgaaacctccggtgtcaataatgaattcgccgatgcaagcaagatcgatcccaggagcagcaaacggttagcgatctatgggtgata

SEQ ID NO: 23594 - DNA, 395 bp, Oryza sativa
ccggcacacacaccttacccctcaccgcatgcgcagatagaactgtacccctatacatggaaatggctataaatgactatgaactaatccctaatgcctgcgaatattgtgtacatgtgagtgtgctttcaatatgagttctgtgaggtaagaatatattttccacgggcctccatctcgttaagcttggattaggacttaggagttgcactcactcttgtgtgcgtgtagtatacgtgcgtagtggtatgtatgcatgtgcttctttgatgtaatagaaaatggctaggaatttaaaactagcctgaggaatgtgctgatgtcttgacaagcaatatcaatcaactgaaacatcccatgttcccactcatagtaaaccgatacggagaaaaaat

SEQ ID NO: 23595 - DNA, 423 bp, Oryza sativa
tcgtaaatttgtagtactagaatagaatgcggaagtttgtttaactcactcgccggtgcgatgacacacagccacagagatggaaacctgtagcgcataacgagggcctctccaaacatttacatacgcgacgacctgacacgaaccaccgcgcaacggatcggcacccgttccacgcgtctacgcgggcaggaaaactcgccgattcccaactcccaagcgaaccaaaaccctacatatgtgatgcatataaacgagcgcctccgctgccacttcacaagcaacttaactcgacagccaacaatttgaagctttgaacagatagcagatcgtacactccgttggtgtagaagccgggttttacaacttttcattattaaaagaagtagagcagagtagtctccgttcctggccgatccacca

SEQ ID NO: 23596 - DNA, 670 bp, Oryza sativa
tggtatgttcacttcctgggttgttctttacaactgaagcaaatttatgattggagctacatttggagtcacttttttttccttgtttcatagtagtataaaagttactccaatgtagtttattttctttgcaaattgtttgtccgaaacgtcatctaattatacatgtcatgcgaaaactacaagttacttaaataaaatctatttttcaggtttaaataattataactcaattaatcatacgttattttcttattttatctgcacgcagttacattttcagcagattcaaaagggacatctagtagcataaacactcacatactcagagaaaaccattgacctgagtaatgacccggttagtcactaaccgggtccccgtaggaccgtaacgaaccaaatggagcagcgtcccacgcggataaaccacgtcgtccccgtcgatctccacgcgcggctgccagagtcgatcgtcacctcggctagctcggtctcgccggtgacctcaccgtagacgacgacttgacctgacgaaactggaaccaacccaacccaaccaacataaacgagctcaccccgcgctgtgtgggccgccaattcacaaatcacaagcaagaacacaccaagaacccgaactgtcctacctcgatcgatcaccagcagccagcca

SEQ ID NO: 23597 - DNA, 1501 bp, Oryza sativa
atctcgatcgactgcaattgcataattgcatttcactcgtgcgtggaaggatcatggagattaaattaaaacgagaatggtgagccagaacattgtgggaggaactgcggctggaatcagattccttttgctgcagatctacctgcttcaggtagcaaccagatgcagctcatggcttcacctcctttgcatccgctgctttgcctcccaaaacaactctggttttagcatccccagtctgaccactcccagttagcctaaaaggaaaaaaagaaaagcagaaacacccaactagaagcaacatataaagaatgaaatactttgcacgaaatttttcacatgatccaagcacttggaattgcttaatctgttataatcagtttagtatcagcatggagcacgctggattaattccgctataagcaaccctcccaagaactcacttgttttacaagtatgtcagcgtcacgtttaagcagagagtaagaaacagtgacgcacgcagagaattccattccaaccccaaaaatagaacagaaaaattgctaccttccgtggcaaggaagaaatgaccaaacccacagtgccagtacatgcggtgaaaagcagccgagactgtacgagatcggtctaataaaagaatgatttttcaccgttctacaggtctgaaagaatgaattttcaaaattcaaaaagaaaaaaaagagagaatgatttttcatcgtttctacatggaaccagcgaggattttttttaatcttttgaacttttatttttttcaattttaaaaatagaccttttcaaaacttctttctataatccgaaccaatcgacgtgatatggcaaaacaatactgacacgctacacgcagtggacatgatagttttattctgtcatgccagcaaggatggcgtggccacgcccgtcaaatcggcgtgaccaaataacgcggagtgacaatgttgtttttttacaccagttcggctagcgtagcccaaaaggttaatatcttgaaaatacgttttgaaaaatgtttatttttaaaactaaaaattaaaaagttcaaagaaaaaaaaattcaaccatcaatgcagcagcggaaacagtaatagtactctctgccaacttaccaagttgctgcgggggactcacccactccgctttttttgagtcgtttcgtggccggttttgacgccgttttccgcagccctcggcgtcgccgtccgtgcgtggtttcgtgccgcgcgacacggtcaaggcacaagccacagccacagcgcctacatatctcgccattgccggtgcagacgcttcctcaactctgtcctctcttcttcttcttctttacaagctctggtactcgctgtctccgtctctgcatttcgggctctggctctctgctgcttcgtgttcgtgggcgattggtttatcttggcttcttgttcatcttggatttgatcgattcgatggctgagttgcggacgtcgtggaagtcgatgct

SEQ ID NO: 23598 - DNA, 170 bp, Oryza sativa
ggaaatctgcaccgaggagagggagatcgaacgagagagagagaaacatagagagagaggaggaagacgagagagcgagagaaacagagagagcgagcgacggctctctctcggctcgcatgcgtgcaacgcacgtgcgagggggaaagatgatgggctgggaggggaga

SEQ ID NO: 23599 - DNA, 359 bp, Oryza sativa
ttcagctctgttttctttttatcacagttatctctctcgttttcattttttcaaaaaagatgataatagtgaatattattccctcatttcttgacggcagcattaacgcattggatgcggtaagcggattgacctgccaccgtcctaatacttttcttctactactactatttctctgcaaaaatggatggattatactgtgactctgtgagccgtagcagctggcacaacgactttgaaccgaccttggatagtggatgcattgtaactgtacaatacaatttgtacaggaggagtgtatgcttgtaactgtacaatttgagctgcatgtctgaaaagatcgccgggcacgagagcca

SEQ ID NO: 23600 - DNA, 495 bp, Oryza sativa
gtggccgcgctcggcccaatggccggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgattgactccgttcagcttccagtaattccgtaaaattgagatctatttaatggcactactaataggtctaaataggatctttcttttggtcttttgtttaggttttcgattatttgcatatagttgcggttatcggattttcgtcgatcgcgggttttctcgaagattcatgaagctttgtgaaaaccttgaaccaaggcaagtcaccctttgatcaattgcccctattaattaaaaagtcattattattttgtttgcaacttgcattactagaatcacacacttaacttgtttggcctcggtttgcg

SEQ ID NO: 23601 - DNA, 443 bp, Oryza sativa
aaattgatagggctaaaattattccctcccatctaaacaccaccttatttttcatgtcttatccattgtggagcgcaaacaatacgagtgcatgactacttcgatctggtgtgttcttgtcaaatgttcagatatgctgacttcttgcgttgcttatgcgtcatgaatatacagatttttgcactatctgaagctcccaacatagtagtacatggctacctctgaaggtgtcaaactgtcaaggtgatcgaaaaggaatgctaggctgctaatttagcttcgacgcatgttcagttcgacagacatgctcaacgtgtgtacacatcgaacacactgttgtcaacgtgcatgaatccgaaaatcgcatgaatataatgcatccatcgttaagttggcagggcggcagggccctacgctcgtatgcatggctgcccttcctcagc

SEQ ID NO: 23602 - DNA, 178 bp, Oryza sativa
cgcgacgttgacgaggatcccgacgcggccgcggccgcccgtcgcgccatcctcctcgccggtggccgcccattgcagagaagtcagaagtgagagagagagagagagacaaggaagggagagaaaaagggaaagagggagaggaggctgacgtagacacctgacatgtggggccaca

SEQ ID NO: 23603 - DNA, 223 bp, Oryza sativa
catatgccaatgcatctcacctggaccatcaatactgaagcttctatggcgtttactttggttaattcaatatttcaatcagagttcctccaccaatcttgtgtttttgcctgcttactttggttaagtggtagatgtgtatatatccatgtgctgctgcctaattgtttcaaaaatcaggatgtaatttccaaaatatataatcggcaaaaactgccataga

SEQ ID NO: 23604 - DNA, 243 bp, Oryza sativa
ttcttttagcagcgcatcgatcggagtgggccgccgccgtgaagctgacgccatccgccgtcgccaagccgatcccgaggtcgccgtcgtcgtccaagcttcaccaagtcacgagctatctcgactctcgagtaagcacctaagaacgccgaccctcttccccaccgcgtcagtgacgccgtcgccgccgcatcggccctcctctccgcatcggtgatgatggctgtagccgcgcgccgccaa

SEQ ID NO: 23605 - DNA, 1501 bp, Oryza sativa
ttcatttctgttgcatcctccacacgtggaaacctccgcttttccctcctcgagctccacacccaatgctccgatcccttttctgcttaattaatcaagaaattaacaatctgcataaataatactgtaacagtttttttttataacttcatccaagttacagcttacaggattagtggatcaacgacgttgtctgttctattttaatcatcaccagaaaaaggaaacaatcatctctcttttacacattcacgccaagggggatgcatgcattgtttagtttgttactcccttcggttggtgcggagtactgatgacatgccattgtgttcttagatatgaactttagaaatgatactgatacatgagtagcaaacaaacagtgaaggctccatcggttggcttttttttctaataagccaaaacggcttattaggaaataaaaataaatttgtaggtaaagcttttatatatatgtgttcttcgtaacttaaaagccaatgctgaaaaaaaattacgttgaaaatatctcaaaatcaatcttaaaattaagtttgaaaattcaaaatttggcttattctttggcttattaggtcatctgatgggagcttgattaattcttctatttattactggagagatggtttgagacataaaatctaggcaaatttattatatatatatattaaggacttttattagtagctccagagagtagaaatgaccgccgaaatatttaaggaaaaacagctagactgacatgtatccagataaaaacaaccctgtaatgcaaataaatccaagaaacaaatcgactattttagttataaacttaaaaaagattacattagtggcgttcttcttgagcctaaaattaacatgctaccactaaatgggaaggaaattgaaaggacaagctagtatgtaagctattgattgattatggatatgcacatacgattctataacgtgagctgctttctctgtcccaaaatattaacatgtacgtattggcattaactttgaaaatgtactaggaattcagttagtttacaaacaagataaaactaattaatttaaagcactgaagtacttcctccgtttcacaatgtaaatcattctagcattttccacattcataaatagagatatatgtctagattcattaacatcaatctgaatggggaaatgctagaatgacttacattgtaaaacggagtaagtaaatcattctagcatttcccatattcatattgatgtgtctagatttattaacatcaatataaatgacttacattgtgaaatagagggagtagcaaagttaagagagagagagagaaatagaaaaaaaaattaagcatgtccatgtcagcttgggggtcctcttataagtcgtctcctccaaaccctcctcgcctctccatcctggagccacagccttctcccctattcttagcccgcctcgccgcctacgtcccggcgcgcgcgcggccggccgtcg

SEQ ID NO: 23606 - DNA, 967 bp, Oryza sativa
aagacttcagcataagagaatacttcgataagcttcaccagccgccgccgccggagtcggagagctcctcgtcggagttctcgtcggagttctaatctatctaacgtggctgctgcctctgtactcctcctactttttctttgggtcatttttcggtttggtcctcgttaggttactattttgtaacgaaggggctgagggtgcgtgtatatacgtggagaggggcggcaatgtaaattcggtgtagaggctgtggagatgtgcaaaacaacatttttggagggctgtcgcacgtgcacgtttctgtatgaggctgtccaagccattttttttctgtatttttctcgtgtccttttttcagtgcctggcagaagaatttaccaaaattgtcacactgacagaaaaaagcttaatagtaaagaattttttttttcaattacatggattacatggaggacggaaagtcattttgtttacgatcttgtttgtcctttcgaaattgagtggtgaaaaaccatttcccatatatatagaacactaaaggtaaatgataagcaaaatagtgaaacgggttgatatacaattgcatgagttttaaaatatggtcataagttacaaatcataattaattatttcaagttagtaatacttttttttgaagttaattagtacatgcatctttaatcatataaaagacacattcatcacataattaaacacgggtttagtatattgtctttgggcgtgcttaactcctttgtttcgattttgtatattgcagaggagaatatttataattacctcccgtacatctctacaatgattgatccacgagcgctggtggttatatacatttatcatgccaattgcggttcgtacacatgcaactctgattaattaggctatgttgtttctgagctgttggtggttgaaatccttaacatgctcatctctcctggtttccaga

SEQ ID NO: 23607 - DNA, 1501 bp, Oryza sativa
acgttatggtactactgagtaagccatgcatcttcttcctaaaagcattaataagttgatgaatccacattcggcgtgaggttgcatgcatttagcagaatatgcgtgtctgtaacacttagtttttctttcaaaccaacactttggttttttgtggcacaaaaaagttcagttgtgttggtagccacgttcaggtatggttgaaggccccagtccgctcattaatatcaacacgtttgaaattagacagaaaaacatatcacagagatgaactaataggtctggctcggttaatcatttttccaaaatttagaggagatttatttcactcctatttgaatgtaaaattaattaaccatactcagtctcttcctatccctttctctaattagggattaatcgacaagggctagaaggtaaatctgatgaccaatttctcttgtttaattttgacaagatttttttatgaattaagcaaaataattttcacaggagaatttcctgcattattacaaacgggtctggtctgacaaaggtgctagaaaattaataagctgtcacactactaggtcagttatctataatattacctggcaatcatatcagcttattaattaacttgatcttgcctactctgtctcagctttgtccattcctttgttgtgcaagcatatctagattgagttttcagtaaattggaaaaatcagctacattgagtttaattcctaagctcaccacttcaccgtgtgatgcattatgctgacaatatctttactactgctgatgacagatcaggtgaagtcgatctcggacgccgactgttcagcacacacaaccatatctacattacactgaacattcatctcttttgatctgagatcatatatatatatatatatatatatatatatatatatatatatatatataggggtcacttcctggggatctatatcagtatagtttctttgcaatacaactactttcagattggctactactttactttcgtaaggtactgagaatctttcagcaccaactgatcgaacagctggttcatacatgtgccacgtagtcttctgatgaaacatggagatgtgtatgtatgggagctcgacacttgttccatttttggtcagtaccctgcattcatatacccactgtgtcgatcgtgaattcgtgatgcagtcagtctcagataatgacggatcgatgtaagtcattgcctctaaataaatccgggccggggtacattgaatccatctatatggacttttggcttcagatgataatgtcaacgagattccaattttcatattgtctcttcggaaaaaaaaagagagagaaattgaagccatggaattggagaaaagaaataaaaattgctagcaaaaacagagcaagttcatgccgaaaagggtagtttaccttgaaagtgttggagtagctcacgcccagccaggcgtgcatagaacgctggcgtggtacttgccctgacct

SEQ ID NO: 23608 - DNA, 630 bp, Oryza sativa
  unsure (1)..(630): unsure at all n locations
ccatttttaaattatttttttagtggaaatgacatgtgggcccacaaattttattattttacaaatcaaattgccgcgtaagccgccacgtcattgccacggtcatatgaagatcgacctcaaataaggtggcatagggcgcaacggtcagggaaaagcgaccccatacaaaatgtaaaanaccccccccggtcctaaaaataggtccaagtttgcgcccggttcaaggtctaacgtttgaccgttcgtcttatttgaaaattttttaagattagtattttatttgctagtagatgataaaacatgaatagtattttgtgtgtgactattttttaaatttttttcaaataagatgaacggtcaaatgttggaaacggagatccacggatacacttattttaggatgaaggtagtatgtgttagttctcaatagaaaccagcatatatgtactttcacatgtaccagtccttgaaaaactggcactaatgatgccactactctcttgtgctcttttgtatgtaacatttttatgtcaagtcatatgataagaaactttgtacttgtttttatctttatttgcatttcttaataggcctcatatgccaatatacgaaaaaataagaaaaagt

SEQ ID NO: 23609 - DNA, 904 bp, Oryza sativa
ccccgtcctggaggacctgcggctcatccgctgcgccacgggcttcgccgagattgtgtcgcggacgctgacgaggctgatcatccacggcagcggcggcgagctggccgtcacagctcctcggctctcctccctgtgcctcctctctcgctggcctccgccgtaggcctcggagccgccgtgcttccctgcttcagccgcgccgacctcctcctctcccgccgcagagaaaactgagagagagagaggaagggagagaagagggggagagatttgacgtggcatcctgacatgtggggtccacgtgggtcccacgctgactcagtcgccacgtcggataaaaccggcgccaaaaccatctaaggacctattatgaccggttttaattagttgagggacgccggatatctggttttacggttagaggacaattttgtaactcgatgacaagttgagggaccttcggtgtactttttccaaaaataaattggtattgactcaactgccaaacggtttattttttgaaccaattttctgtagaaaagttgtttcatacaatcatattaatctatttttttaaaaaaaaatagctaatgtttatttaattattttttaataagtcgatctgcgtgcggaattcccaatctaatgagctgcctaaatgtagaattaaaataatgcaacgcacatgcattttgctagtgaaggagaaaaaatgtaagcttgtaatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagtta

SEQ ID NO: 23610 - DNA, 225 bp, Oryza sativa
tttaggtacctcgaggtatttttttaaggaccataacttttctctattttttaatataaattttgatacctcttaatatctctgatggtaagacataccaattttgcaccaaaaattttggtatctctcgatatgtctcaagtattgttgaatttgtgttttgatagataatcatcagatcaaattttgttgttgaatgatgatgatactctttcttgttgcagt

SEQ ID NO: 23611 - DNA, 363 bp, Oryza sativa
cgaatccgattgtctcaaattagcatgcaagtttttttaaacagatttcttatatgattccttctatattaccaaagtgaagatcttaaaaaccgactcaaatacagatatgtatttcaaaaaccaaacgaacttaaaaactgactcatacacgaatgacgtatcaaaaaaccagcaaaaccatcttcaatttttataatagtagagaagagatatagattaaaaccaaaaaataaaattaaaaccgactcaaacacgaatgacgaactgcgaaaacatcttcaatttttataaccgactcaaacacggatgacgaaccgcaaaaacatcttcaatttttatagtagtagagaagagatggga

SEQ ID NO: 23612 - DNA, 870 bp, Oryza sativa
  unsure (1)..(870): unsure at all n locations
gcatgatctgaatgaggcggttantttggttgggtgctgcaagttgcnggatggcataagaaaaanaggaacgccnaatttggcacttttcctctgcanaatagagaatgcaataattntgtatggtgggatggagtatctgctgaaggacgttttttttctcctaaccgctattttctcgatggatgtttggatggcatatctgttgaggatgctcttactctgctccatctcttctatcttcagccggctctgttttgagaacctttggaagttatagctatttcaaaaatctctagcttcatgaaacaatctatgttcttatttcaaaatgtaataggtttagtgaatttttttaggggtgaataactaatacggtccttgatatttcatttcgggctcagtttagtccttgagatttcaaatcgtccaaacaaatcccccaaattaattattgggataaatatagtcctttgacccacaaaaaatgccacgtgagcacgttaagtcatcttcgcatcaagcagaatgaatgaaatgaccattttacccttatataccatatagaaaagaaagaaaagatacaaacagaaaaagtaacatgccagcccaggcccagcattgttgcagatgggtggccgacaaatgaatttacatgatcagtcctaagtgacagttccaaaacgatcatacacgtgtgaaacatttaccttcttacttttctttcttttctatatggtatataagggtagaatggtcatttcattcatgccactacatgagagaatgacttagcatgctcacgtggcattttttgtgggtccaaggactatattaacccaaatgattaatttggtggacttgtttgga

SEQ ID NO: 23613 - DNA, 1375 bp, Oryza sativa
gggcaggtgacgtctctcgcccccggcacttgaggtccctagacgtgggtggttaagaggaatttttatttgaagtataggtggataggatttttcatagatgaagtagtagcgctgtgtagtcatgtccaatattggatgctgcctttcaaaaaataaaagagcaattacaaatttaccaccattttaatttgttatttcagaaaaaaagagaaaaccatacttctaaaaacaagcatatccatatcagatatcgtatcaaacacaaatgcgtatcgggatactctcgaatgcatatcgaacatggaaaagctaatgggcgattgatcgctaagggcgatcagggcgacaccccctcctcctcaacgtggttttcttttttggtaccgtattacttttctatttttagtaaatttatttatacatctaaaatttatacacctcaagtttacacatctaaagtttatacacctaaagtttagagacccaaagtttataagtcaaaagtttatatatccgattcaaatttgaatttcaattcaaattttttttatatatagtattttctatatatctaaagtttataagtcaaaagtttatatacccgattcaaatttgaatttgaattcaaattttttatatatatagtatttctatacacctaaagtttagagacccaaagtttataagtcaaaagtttatacatccgattcaaatttgatttgaattcaaatattttttatatataggattttctatacatctaaagtttagagagccaaagttatatatcctattcaaatttgaatttgaattcaaataatttttatatataggattttctatacatctaaaggttattaacccaaagtttataagtcaaaatacccgattcaaatttaaatttgaattcaaatattttttatatatatagtatttctatacataaatttttctaactgtttttttatttttaaaaagatttatggtgtagtaggaagagaagaaggggagaggagccatataggggggatggggtcgatcacctggggcgatcgatcgcccattagctttaccctatcgaacacatatttccgttgctttttaaacaaagaaattaatttctgctactttttcaatatttagtccatacattgccaatactcctagtataaatatcatcataagttacttaaagtttgacattccatcccatttgaaacttattgcattaaaccatgcatttctgcttttccttccttctatattgtgtattttataatttatatatatgccccgtaaccgtgattttgaaaatatgactcagagcatctcacgatttaaacagcaggctgtatcagcctatgacggatca

SEQ ID NO: 23614 - DNA, 204 bp, Oryza sativa
gggcaggtgacgtctctcgcccccggcacttgaggtccctagacgtgggtggttaagaggaatttttatttgaagtataggtggataggatttttcatagatgaagtagtagcgctgtgtagtcatgtccaatattggatgctgcctttcaaaaaataaaagagcaattacaaatttaccaccattttaatttgttatttcaga

SEQ ID NO: 23615 - DNA, 408 bp, Oryza sativa
cctatactgaaataatatgaagagagggatccactcatcacccctgggttcgtgcggtactagagaaagaaacaccagctggaatggagggccgaaccctcaaaaaatatttgtggatagatggggggggaataaaaaatataaatagtggtgacaaagctcctctaaaatttttaccgaaagtaggcaaaacaattttggggccgggaaggaaagctgctacaaacaccttccctacaaaaacctagaagagggacttcaaaagcggcaccaaaaggaatttaaaacagggccccaaaggcagaccaacgtcaaacaaattcgcggcccaccacatactcatgctaaaaatgcttacggaacctgccagggccggcgaagggctcccctcccctcccctcccccagg

SEQ ID NO: 23616 - DNA, 276 bp, Oryza sativa
cgcgtggattgatatacactcgtaccccttcgtagacacctgcgaaaagtttcgaccaagcgccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 23617 - DNA, 1395 bp, Oryza sativa
ctcccggcgctatttaatcgcttcccgagctccgctcctccgtttccgccgctcgccgctcactctccccgtcggaatcgagcccgcgccgtcgtcctctctctccgccatcgccgccgagctccggtcagtcgccgtcgtcgctccggacctcctcccgtttcggcgtcacccccttcggcttcgccgcgtcctcgccgaccccgtccgcccctccgcttcgctcgccgaccgccggaacgccgccgtcctcgtcgacccgagcccgcgccgccgtcgtcctccgctccggtcgccatttccgccgccctcgtcgtcccggggtgagccatggaccgccgttcgctttccctcttccctcctctctctcgggtgccgctccgccgcgccgttggtctccggcggcgaccatcggggcgcgggtgcgccgcctcccatcggccgtgccggcgaggccgccttcgggcgcgcccgcggctgccaggtgggcccggccgtcagccgcccgcgcccgtgggtgcggctaacgcgtgggacccacggcgccggccgacgccagccgcgtgcgcccggtccaccgtgggccgtgaggctgccgcgtgggccccactcccgtggacccggtccgcgcgccctctctcccggctgacgcaataaatccaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttatttctgctgttatatggagtttattagggtaatagccttttcttttccgttggtcgtgtagacgctacagcttcggaagatccgctcttcgtggaagttgaagccgatgtttgggaaagcgagcaaggcaagtcacatcatctttgaacatattgaatcccagtttgtaaaattatgttgatttaaattattgcattatcactttatttaaattcccgcgttatcactgttttatttagccatgcctattttcctttgttatgaccttattattgttattgttaatattaccttgttcaccctagaataaacaaaaccccaactagtggacactctactcatggcaccactagtttaattttaggtagatgcttcgcaagttaattaggtaacattaggtggttttacaactttagactttgggaaatattcaagtcacctggatactttggaatggtctggttatcgtggaaccggcttcacaccgctccttctattcaaaatccctaaaatggttttgggctgggctaggggtgcatggttttgacagtagcacctctgccatataaggaccggt

SEQ ID NO: 23618 - DNA, 190 bp, Oryza sativa
atgggtcatggtcaagctgtccgcgcacgtaggagatcgttccggagtgccactgccgtctgaatccaaatttgtgtatcagcaatgtaatttactcaatagagtaaataatacggaaatgctaaacaccggtataccgtcccgacgggataggatagacaccaaccaatccactcttcttctatctagc

SEQ ID NO: 23619 - DNA, 1501 bp, Oryza sativa
cacaatagtcccggttataaaaagaaccgggactaaagatgatctttagtcccggtttaaaaccccatagccattctatgatatttagtcccggttgctaacaccaaccgggactaaagatgatctttagtcccgatgatctttagtcccggttcatcccctgtcagtcccttgtcagaggggtggggatctttagtcccggttggtgtcacaaaccgggactaaagatcaccactttagtcccggtctttactcccggttagtattaccaaccggaactaaaatcacgcctagtatataatccctattccctatcctctcccccacaaccggcctcaatctcctcaacaacaaccggcctctcctctccttagatccatctcctctcctcctccctctcctccccttccgcctcccatcccggccctctcctcccccttctcccttcccatccaatgcccagcaagggccacctcctccccctcctcccttcccgaacacgtcaggcggggccgcgcccggcggggccgcacgtggtaggcggccggcggggccgcacgcaggccgcgcacggggagcaggcggcgctaccggcatccattctttttttctttttttttacaatttgtgattcacttagatgtataattttgtgatttgttgtatggatctgagatgtataatatgtgatgtatttggtttgtgtgtatttttttaatgatttgtgatgtatttgatttgtgtgttgaagtaacttaagatttgtgatgtgaatgttttgggatattactttgatttagggtttgatttaggaatatgcatcccactcgatttgggagaaaatacagggattaaactctggctaaaaaataatgaaaagaaaagaaaaagagacctaatgggactgccgctaccctctctttagtaggactaaagataggtaccaaccgggactaaagatcgatctttagtcccggttatttcactcgagactaatggtagcgatctttagtcccggattcgtagtcccggttggataaccgggactaaagggcggttacgaatcgggagtacaaagggtttctccaccagtgatatagatctgccatggaaagtactttatgtatggtgatacatgaaaatatagagttgtgtaaacatatactttgtaaaagtaatgcatgagacatgcgctataatgcaagtgggctgacctgcgaacctacatttatgttaaataaggggtaatctatggatttccgtgtaatggctcggcttgccccgtcgtaaagatgcaagtgggtcaacctataaacccatttgtaggtcaaattagtaggtaacccacagtttacccactaattttgtctataagcgggttcgcgggttggcctactttcatccctacatttttagggttatatatatggttttggaagactttgtgaaaatatacgcgtacaacagttcaaaaatgcgcgacaggttgtttcccgtggca

SEQ ID NO: 23620 - DNA, 504 bp, Oryza sativa
tctcgacaaatggcatagacactatgttgtcgtcacagttacaggtgaagcaggcagttgcaacagtatgatatgttcatgctgttttagttttttttttccttcttttcttttcgggctgggtgcatcctcactagatgaagagagcaccggatgtaacttcactactcaatgaaatatctagtatctaaagaaaatgtaaatcttacgtgctggacattactaaaactggtgcttgcttgcagtttgaactagctagaattcagaaaaatgcaatgaggaagtcaaattaacacaggcacaccgctagcaattgtttgatcatgtttttattatttatactgattacaaactaagaattgaggaatggtccagacaatggcaaatattggtagatacagatcctgacgatattacgctagctgtcagaattcataaacctcccagaattcttcctttctgattagccacatggatgattgatcatacaatccatttcgtaga

SEQ ID NO: 23621 - DNA, 1501 bp, Oryza sativa
tattttctagagttttctgggaattatttgagcaagggaagtatttttaataattgaaacaacatttcacaaattgttttattcaaaaaagttcaaaaatccccctcctaggccgttgggccgatttcggcctaactctctctttctctctctccccgcgcgcggcccatgccggcccaagccgccgccgcccgcgcccctctctctcgggacactgacatgtggggcccacatgtcaggcccttcttcaacctccggccgccgccgagaccgagcccgagccgccgtcttccacctccgattccgcccaaatccgagcccgattcctccgggtttttgaggggttttgttcctctcgttctcctctttcttttcccccaagaatcaaagcgaatcgttgagtattctctccgaatcgagttcgttttgattttatccctaaaaccgagtttgaattcttcccgaatcgattcctctcgtttggagctcgatctcttcaatccaatgccatatatagcttcctctcgttgtcctcttccgtttgccccctctcccgagctctcccgtgcctcctagcgccgccgcgacgtgttccaagtccgccgccgccgccgcccgtcttcggcgtcgtcgccgcgccgtctccgccgtcgccgtcgcttgccgtcatcgccaagaggtgcgccgtggtgagaggaagctcgtgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacagcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattatactataaagggttagggttgcagtaaacagcatttaaagacatttagttgctccaaagctattttgtaaacacgattctagaactatacaatgttattaatcacggccgtgaacccacacggacctgccttaacccaaggcctacgatgattcagaccgaactggcaacccgaccctgggtcccagctcgtcccaagccaacccaggccaaccattccacattttagttgataagcaggttttaagacttagaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccat

SEQ ID NO: 23622 - DNA, 1501 bp, Oryza sativa
atccagattgttcggatgtcatcttctcccaagttgactcccgatccatcaccggcaacgctctcccgagacatcaagaccacctacacaagcatcaaccaagaaaccatatccgagcataagttctcactaacttgtctcattgttagcaaacaacagtattacatacgcatagtattcatctcgaagtcataaacacgaattatccacggatatcgaacaaatcaacccgaaacctaaaccgacacagagtcggccggtcagaccgtgggctagccagtctgaccgctcacatagctccggattgaccggcagcacctgcccggtctgaccggtccaaataaccagcagtccctgttcatcacttgtaaaatccaatcatctctaaaaccacatcgccaataatctccaaatatctaaaccaataatctcatatgccaattgtttatcatagaataataatcaaacacacgttgatttgcataccatggccacactctttttcagatgtacgctatgactcaccttagaatagagcattttaagatcaatgattcatcataaatcatatcatttattactataaagttataacccactaatactatagctctacatgcaaacataccacctcatcatccattagtaataattacatacaaaacttatgtaagcatgaaacatcatctataattcattgaattctataaatcaacatccaatcatcttgcttcatattttttttcacaatatttttaacatatatacatccatcatttttataataattaacatatattcatccatataatcaaagcgtgggatatcatattttatctacaatcacatacatactactaaatttatttctctcctaacatatagtttgacaaaccagttttatttgttaataactaatatcatttttagttttagctcaaatattaaaaaatattaaaatttacttagtaatttccgcagcaaagcgcggagattcacctagtaggctagtactattagaagatatgcgcgcgcgcgcacaagcttctctcccttaaaaaacgctcatacaactttaagaagaaaaacatactggcattaagacttaacattgtggtagtgtaattagtaagcattcacatgaaaaatcagttgcatgacactggtaatattaaatcgcaagaaaagctgaaacacacatgcaggagcaaaacaaaaaaaaaaagagcaacaaacaggaactaagtgatcttgtaagtatcacgtcacacattttcatccccagccaaggtaaagccatcctcagagaatggagcaacaacatgttgatcaccgttgtctccgttagcataagaagtcgatggtccagcaacctgctcttcaccagaggactctctaacatggaatgtccgcaaattacctgagtgtcctctgttttggaggtctcctcttgccagcttctctgccaaggtctccatccccatgtaatgcaagagtagcc

SEQ ID NO: 23623 - DNA, 1501 bp, Oryza sativa; identical to SEQ ID NO: 19181

SEQ ID NO: 23624 - DNA, 1501 bp, Oryza sativa; identical to SEQ ID NO: 19178

SEQ ID NO: 23625 - DNA, 361 bp, Oryza sativa
  unsure (1)..(361): unsure at all n locations
tgcggaanaaagaaagagttgattaagaatcgatttcttctcgaaacataatgacctattatagattttttgtgttnnctgncanatacnccccccccccccagaggntttgatgtanatcgcctgctgccagcaggcgactctagaggatccccaaatatgatatatatatatatatatatatatatatatccatttttcaagtttgtaataatttaaactcaattaattacacgttattaccaccttttttgcgtgaaacacttacaaacaccacctaaaggtgtgttggagaatactacctccgtttcaggttataagactttctagcattgcccatatttatatagatgttatatat

SEQ ID NO: 23626 - DNA, 331 bp, Oryza sativa
cgctggattgatattctagctcggtacccctcgttttccgttagcacgcttttcaaactgttaaatggtgtgtttttgacaaaaagtttttacatataagttatttaaaaaaacaaataaatctatttttaaaatttataataattaatacttaataaatcatgtgtggatgatgtttctcgttttgcgtgcaaccaaaatctgtctacaaaaccccacattgaacggggccttagttcctattcacaagtccaaaacaacttatgcttaggattagaggacgtagaagtttacaaaatgttggtactgattagaattatctgctgttata

SEQ ID NO: 23627 - DNA, 1501 bp, Oryza sativa
aacaaactgactgatcgaagtcggtaagagagaagacgctcacatacaaaacattggtctgtaaatttaattcattttcagttttccatacatattataacatgtcaccctttgagcattcgctcgggggctatttctatctaatattcttttctgagtattaatttcaggaaaattctattcgacattgttgaagtctccatgtctctatggttttataccaagatcgactaaggcgagtacgacaaatgttgacaaggctccatcgcagactctgcgccttctcgatcactcgagaacgattggtggatctcgacaaggaatacggaatgaagagagggtgtacccgccgagataaaatttcttgatttcaatccaaattctcgattacagcaagacaagagacttagtcgtatattctgtactttcttggttgacgttggagattgactcagacaaaccctttaggtgcccgcacgaggctgataaaggaagtctaacattatctctgaactcatcaagaacagtcacgtgagcacgacaacagttactctagggtctgcggttgagaatatgaatttgttcatttgcattgaagtcgggggctactgtcagggttatggataccacatacctaatagtagttgactaaatctcagcatgacccaccacataccatgtcttccgaactatccgagaattatccgatccgaaaagtatccgtatccgtttttgtccggagcggatggaaactatccgctccgttttcatccctagctgtatagtggtagcatgcttttatcctcttctttgttactataactactgtagctgatggatttttttttcacttgagggacatcctatcgtttgtccatgtagtataaaagtcatcacaaaatttttaaacgattgataaaatagattaatatgtaatatattattatacaaatatataagttttaagtacgacctatataattagagtttttttttaccgttcagcactgagagacgggaccaaatactgatcattgatcggaccaaatccaacggctgccagtgtacagtaccgcgaggtaccacttttgtcccttatctagtaccgtacggtgaagagaggtgaaaaggtaagatagtaatttcgcttagtagggatggatgaggctgaatggatgggtgaggggttgaggtgggccaaaaaaaaaaatcctagaataggattggatcgaactcgccgctgctatgtttatcctccaccgccgttcccctattcttcttttcttgctcgtcatctctctttccctcgctgccgcgccaccattttgcaccctgctgccgcggcgctacgaggggatggaaggggagaagcggcgcaaagggatgggtggcgtgcgctgggaatgcgaaaggggatggaaggggagaagggcgcacggggaatggaagcagagaagtgacggcggcgcgggttgggaagggcgaaagggcgaggcagcgc

SEQ ID NO: 23628 - DNA, 1501 bp, Oryza sativa
gcaaggcaagtcatacattccccttgagcattttgatcctactttacaaatgttttaccgtttgcaaataaatatgaattgttttgcttattacatgggatctgggtattacctatctgctcgcttgtgccatgtttacttgatatatatcctttgtcaaccgtgggtaatagatcgactagctcatgttacttatgtgacatagctagaactatatgcttagtcatgcttaattaccactagctcagttgatgggataattgcagtattagacctttttagtatcagaacgagctgtgtgctcgagacacctgaccatgttgcattggtcgtaattatccaactaaaatgcgactgaatggtgggctgtgggtgcatggttttgctggtcgcatccatggcaattaaggaccggttcacgggaaaccctggaagacttacagtgcttaacacaagcgggagcgggtaactgcttaatctgaagtatagctcgaccctttcctaggcaccggtggcaagggtgggcgtgatggagttgggtcggccggggagaccggttgtccagctgccggattcaccacggcgcacgaggggactgcccgctgccttgcgaggagtgggggtgaaaccttagcgtggtgtggatggttaggggagggttatatgaagggtcttgtcacaatcactcgacgtggtgacatgttcatcatgggcacatgatgacatggtgacatgccggtggattgtgtcttgtgggtacagttgtgcacctctagccagagtaaaactattcgaatagccgtgcctgcggttatgggcgatcgaccagattcaccgtgattagtctcacacttaataaatcgacccaatgcactgtagttcaagtgggttggttgggcctgttcaacgtggtgtagcgttgatatgtggagatttaatattaccttaattactcaactgttttactattttgctcaatgaaatgttttacaactgcctttacgcaaatagccacaagccattcttgtatccccttgcacgtttgcatcattggtgtggcttgctgagtacggtggttgtagtcagccttgctattattcccccttttcagaagtgtagtacttctgagctgaagacaaagttagaagaccaaggcttagaacccagttgagttttgcctatggagtggagctgaagccccgctaggatcgcctttttccgctgctgctgttttcttttggtgtgaggactaagtgcctcttctataagtattttacgctttatttatgtttggaactgtttattatttgtcgttttgtgtaccctggctggtcctggatagggatttaatacacaaaatagtctggaaatttgggttaaatttctgggcgagacactggttcccgaaccagtacgtagtaatctctcgcaccgcaacttccattggtgttcgagagataattctactcgctcgctggttctcgaactagtacgtagcaat

SEQ ID NO: 23629 - DNA, 1501 bp, Oryza sativa
tcttatacctctctgtgacctactatcttgcagttacaccacctatgtttgtctctattcgttatatctccattttaatgactatctactaatccttatctgttaatgtggtacaatgtggaggctatgtgggacacatgttatatgctatgaatgaattccgtttgggtagtaactctctcattgttaaatatgtgcagatttattctctggtgaatgttctatgttaatgtcatgttctagagctgtctattttaaggatgccgtgtgatgtccttgtgtgtcggttgttcctttattcttttgccctgcttagtcccataatgatgatgaaaaatgcctctttgaatttcatgtctgttattattcatatgtgactgaccctgcttttagattctgctatgttaaattcctttgttctattttcatatatttgcccactgggattagaactgttgagtatactattagttttttcatttatttgttcctgaagtgcatgtgcatgataaggacacaactagctcggatataaccatgactatcttatttattaatcaaccaaaggtgcatatgttctacattagatttacttgttatatatttaaacaaacgttgctacataatgagttttgtgttttttcgtttgcagaggtacttgcttgggtgaaagaaaagagaccgagcgtacgaaatacatggatgattgaagaagttgtttggggaccaaaccaagacctccatgtcttctttcatatcaccacaccacttttggtccatagaagacaagagataaagttgtgcgcgttttggattcggatttggcctcctgatagcatcaacttcaaacagacctagctgctgatctagaaggaatttaggggcccatgagtacttgttgaaaagcttatggagtctacttttagatggttttggtcccacatcaaaattcctgccaagctgccggaaatctgcaaaacaagccatgtatctcatccagtccgaatctaatttgggttttggggctttaaattgtgttgtgggcttagcctaagggggtgtgcgccctagggaaaccctaggacatccctaatcatatttattcagtagccgttatcgtttaaagttgggttttgcttagattaatctgtcaagaacagttcgccgctagattggtttgtagaaccccaaattcgagcgcttaatcattcatatgcaattgtgttgcaatctatcttgttcttgcttgtattcttcgattcgcatgcagggattagccttctcggcgaggtcaaccgggtttcggcacggttgataaccagaggacatgtggtgctgcaattgcggggctcagtagcgtgttcgttcggaaactggatcgagttgtgtcgcaacttcgcccaaattgactatttattaatacctgttggaagatcgggacctaactccctcatcagtgcatcaaatggtttcaattccagtggctttagtattgaatttt

SEQ ID NO: 23630 - DNA, 1309 bp, Oryza sativa
tgaaaactagaattccgaatgggatctttgcaagttgttggtgaaaagacagttctctcagttgcatcattgccagcaacccaccacgctggtatttctcacttctacagtcctactgtttcatgttcacaatgcctaaccaaactaactgtatgaatgcacggtagtaccaatttccatgcaatttgtaacgcaggagttcccggtgcctcataggcctactatagcaacccaatggactgatttttatgatcactcttcattagcttgtggaacttgcagttggttcactcacctcatcttttatggagcagaaagtactccctccgtttcaaaatgtttgacaccattgactttttagcacatgtttgaccgttcgtcttattcaaaaaaattgcgaaatatgtaaaactatatgtgtacatgaaagtatatttaacaatgaatcaaatgatatgaaaagaataaataattacttaaattttttgaataagacgaatggtcaaacacgtactaaaaaatcaacggtgttaaacatttcgaaacggagggagtaccacacaatacatattgcttatctcatatatatcttttgtgatgtacacaatccattgcttggcaattatatattcaagtgctgtaggtgttcaatttgcagctacagctgcatgcttaatctcaaccatcaaatgctggactgtaagatttttgcagttgtccaatgaaactattagtgtttttctccgagcctgtagttatttggtgctctttgacaaaaagttttccctgcgaattatccaaaacctgcagttcagtataacatgcatacatgcacatgccagcaagttttgttcagttagttcattctagacctggaagtgtagacgacgctgcatgaggcagccattagattaagccatacaattctgagaacaatttagacggccaatctgaaaatgaaaaatattataataaattgttttccattcaaatgttacccaattagtagttgttagcatcatataaatttttaaccgtggtgtggctcaataactaaacgatgaaagaaaaaacatctcccaagaattcttgtatcatatgacacaaacatgaaacattaacttagtcgtacatattaaattcttaaaccatttttgtatgatgcatacaagatttgtatgagtatacaagacatgaatatcaaaggaaataaaaatgataattagtggttttctagaagggatccaagaggaaacagatgttgcaatggccccaacggtttcctttggttgcattctctctgcacagg

SEQ ID NO: 23631 - DNA, 1501 bp, Oryza sativa
gaagtttgtcgagctcttctcatatgtcttgtttttaatctggtgcaaatctccgtagtttttgttttactggcttggcgtcgggtcgcaccatgagtttgtgctcaatcacctccctgggaacccccggcatgtcggacggctgccaagcgaaaacgccagcattgtcgcggaggaaggtgatgagcgcgagttcctatttctcgcctagtgatgccccgatcttgacggtcctgtcggggttagcactggagagtggaacgatcctgattgcgccgtctggtttcggcgtcttgtttgttttgctcactttcttgagtggctcagctgtggcgggtgggctgggcgtgtgctcgaccatgtcgaggctccgcttgtcgcattgcactgccagcttagcgttcccttgaatagtgattgttccctttggtcccggcatattgagcacttgatacgcgtagtgagatgcggccatgtacttcgcgagtgcagttctcccaatgatggcattgtatgctgtatcgaattcagtgacatgaaaggtgatctgctccgttcggaagttacttgcttggccgaaagtcacaggcaacgtaattttgcccaatggttcggacgatgactggggagtgattccatggaagggttgatcggttggtgtcaattcgcttcgtgggatccccatcgcgtccaatgtgctggcgaagagaaggttgattgagctgccgccgtcgatcagaactcgtgcgaccttgatattccgaatagtaggttcgaccacgatcggatatcgccatgggatgacggcagtcttggggtggtcttcttctgagaattctatcttctgttcagaccacttcatcttgggtgtagccccctgccacgtcgaacagacttcacgtttcactttcttgtattctcgctttgaggagtatgccgtggaacctccaaagatgtgcgagacatggagatcggagtctgggtatgatgagtccgattcctaagtagccgtctcagtgtccttctctaccacacgtactcgcttgcttttttccgatgccatgtgctttccgagcgactttttgaagacgaggcaatcttccagagagtgtctgtccgacttgtgtatagcgcaccatgcttccttcgcgtcactaccttgtaggtctgggcgtttgggagggtccgcgtattctgctgcgagaacttccgcttgagctttctttttcccactcttgtgatttttctttttgcttgactcaggtgcgtccttggctggtttcttctctcctgcggtcttcggcttgtcgttcttgcgtctcagtgcgtcatctgcgtgggcgcatcgatcgacaatctcgaataatctccaagtagttgtgatgcgcctcgttgccaactcctgggtagtatagcgatctctggcaccggacttgaaagcgcggattacagaagcgtcggtgatttcggggattgtatttctgcactcattaaagcgctg

SEQ ID NO: 23632 - DNA, 1501 bp, Oryza sativa
tggcatagtagggtttcatttgcataaacaacatttaataaacatttcagaatttaataaaacggttaagtaataattaaacaatattaatccaacgctatacaacataccctgttgcataggcccaaccattctgaacaaccatcccagctgcagagttctatctccaaaccaggaatataccattccaaaccaggagctaatcaaattattaccagttatagcatcttttattatggtgagaaatgtgaaactaatcacgaaagacattattagacctgcccataaccgcaggcacggctattcgaatagttttactctggccagaggtgtaccactgtacccacaagacacagccccacaacgtcaccatgcgcctcaataccaccacggtacctcagaaaggagctgtgacagtacccctcgcacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaactgaaactcgtgaaccggtccttaatcgtcgtgagcacgaccatcaaaaccatgtgctcacaacccaccattatcaaattttagttggcaatttaattaattaaccaatcacgattgaccatcgtgagctatcattaagccatcattaaataatagtgagtcataagtatcccatttatatggactagtgtttctaagcatggctaagcaatcatatctgatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaagagaaaagagcaaaatcaccaaaacagcacataaacaagcatgaacagtatatgttgatatttttaacatctagatctcaattttagaaaaatttagagacttgaaccaactaaatccgagctaagatgaattagttatgaatttttaaagattaaatcggattaaaacacttatatggattttaattgaattatgacgcaataatgaattatttttgaaaagtaaaagggaattattgcgtcagcggctagggttcgcggtgaaccgggtgcacggcggcggctcacggaaacgaacggccgagatcgattcatccaaaacggacggccaagatccatcggtccacgaccgggccacggggaatgacgacaa

SEQ ID NO: 23633 - DNA, 1501 bp, Oryza sativa
acagttgagtaattaaggtaatattaaatctccacatatcaacgctacaccacgttgaacaggcccaaccaacccacttgaactacagtgcattgggtcgatttattaagtgtgagactaatcacggtgaatctggtcgatcgcccataaccgcaggcacggctattcgaatagttttactctggctagaggtgcacaactgtacccacaagacacaatccaccggcatgtcaccatgtcatcatgtgcccatgatgaacatgtcaccacgtcgagtgattgtgacaagacccttcatataaccctcccctaaccatccacaccacgctaaggtttcacccccactcctcgcaaggcagcgggcagtcccctcgtgcgccgtggtgaatccggcagctggacaaccggtctccccggccgacccaactccatcacgcccacccttgccaccggtgcctaggaaagggtcgagctatacttcagattaagcagttacccgctcccgcttgtgttaagcactgtaagtcttccagggtttcccgtgaaccggtccttaattgccatggatgcgaccagcaaaaccatgcacccacagcccaccattcagtcgcattttagttggataattacgaccaatgcaacatggtcaggtgtctcgagcacacagctcgttctgatactaaaaaggtctaatactgcaattatcccatcaactgagctagtggtaattaagcatgactaagcatatagttctagctatgtcacataagtaacatgagctagtcgatctattacccacggttgacaaaggatatatatcaagtaaacatggcacaagcgagcagataggtaatacccagatcccatgtaataagcaaaacaattcatatttatttgcaaacggtaaaacatttgtaaagtaggatcaaaatgctcaaggggaatgtatgacttgccttgcttcttcaagcaatcttccgaactcttatcctcgcgaccgcgaacttccgaaacagcgaattctacacgctggcacgtaaaatgaggaaaagctctcataaacaacaaggaaacagtacataaaaagtaaacaaacatgtagatctcaattttagatgaattttgcaagttgaatggcctaatttggagttcgaatgaattagatatgaattttagaagttttgagccattttaatggatttctggaattattaattatttatcgtgcaattattaaatattttctcaaaggaaaagaccatcgctaacgtcagaaaggagcggccggcgccgacacgtggaccccgcacgtcagcgggcaatggggacgggtgcatggttgactcggtccaccgcggccggggcagcaccgtggacccggaccacgggagtggtccacgggaccgacggcctaggcagcatggctagggcacggcacggctcaaagccggccagccgaacgacggcgatgggcagcgcgcggccactggcggtgtggaat

SEQ ID NO: 23634 - DNA, 1501 bp, Oryza sativa
cggcagccttcaccgccgaaacttcattgggtttgtcttcccggcagttagattgttttctaactacagattaacctcgtgttactctcctgtttttgcatgccgaccgagatcaagaccaatggctatcatctcgatgcgtctgcccaatgcctcgtgttccccgatgcactgtgggactataggcagcgccgcctacagcttgcacacgggatcaccagcagccaagagcaattcacatgcatgtgttgatctatcgacatgcacgattcaactaacaggacacctcgccaggatcatgcatcaattgattaattaattgagcttgcctgcatgttttgcatgtacatacattgcttatatttatatttatatttcgtggtactaaacagattcatatgttgattgatctattttgcatgtacccgtgtcggccacctttgttgttgctgactgatttctttgccttcacggttggcgttcgccgatgccgactggtgccctcgcctacacggattggatggtcacaccaccgttgttgggcgtctacattttcactgactggcttgcctccgtcgccgctgactggtgtctctgtctacacggctggcctattatgccgccgttgttgggcgtttacgacttcaccctcggcctgcctccatcgccaccgactggtgtctctgcctacacggctgacctattatgccgccgttggtgggcatcttcgctttcaccgtcaaccgccttcgttgccgccgaccggtgtcttcattgttattgatggacgactttgttcccacattggccacctctgtcatcaccaaggggaatattacaaagctaagtcatcatttatttcattctttatatgacattttccttttcctctgcctcactatgtcaactggttcgccgttgactagtgagtcgggggctacagatgttatattatattttctaaacaatttttataatatttatcttgattgcttgcgatataatctaagtacaaaagtacctatcgagttatggagttctatcttcctatgctttccgtttggtttatcgatggatagttgcctttgggccgattcctagcagctgggggctcgttggatggaccgagtaacgcaaggtgctaagtattattcggaataaatcaaaagcatagagataagataaatttattttctgctcttaacaattgcggaagtacccgagtagtaaattctgattcgtgaaactttgttccattaatgacgaattcatgtcactcatatgcatgtttgggaagtgcttaggccgactcccggtgcatgggggctatgactagtcgggcagagtgtttaaacataaggagtcatccgctcggggaaatcaaaattgacaagaggagaaatacatatttataaacattttaaaaatacttgaattttcctcgagtattatatcagatactactcatcctatatatttgttctgcaggatccagatccag

SEQ ID NO: 23635 - DNA, 1501 bp, Oryza sativa
gaggggaccccgccggccaatgccgtgcgcgaggagtaactcgtcgatggcggccgaacatcccaatgagcccatcgggagtacctcggtagctggcggttctcgatggcgaccggatgcgtacgctgggcaagacatcgactgctgatggcttacgcgaggaggagctcgccgacggcggccacccatggaggacctcggcggccggctgcgctcgacggcagccagatacgcgtgtgtacgtccttgctggccggcggagcgctgggaggacctcgtcggccgatgggacgagcgagctgctccccgcccgatggacgaacgacagcgcttgcacggaccaattgacgggtgcggcatcggatggacggagtgtcacggaataaaacaattcgcgtctctggtggtatgttctgaaggtgttacgaattaagtggcaacagctgaaagtgctgcgaataggatgacatatactgaaaattctactacgggtggtgtacgagtcgtggaatatagaatatgccagtatgtacggtaaagctccatatacgataagaaaatcggcatgaggttatggaaataattcttatgggcaagtacatagtagagtactactcgaaaaggattgagactagatataccatatcgtgcaacattcacatggatgatagaacgctttcagaagcataagaacttaacatttgccttctgcatcactacgttcagtcaaaaatttatgaacattgctgcgtatttcatggaagcttagcaagtaggtagtgattcgattttggcacaataaacaacctttttgttcctacgctaatgcaaatgcaagaacaaacagcacctttgtccgacccgtcctcctgctccaggcgccagagcacgaggcggccgtgggcgtcggcctgctcgagaagaggcaccaccatgtcgaacaacccggcggtctctacgatgtggagcacccggagcctccgggacgcgtcctcctcattggcgtcgagggagaagagcgccatggtgcccgcgcggtcctgccgctcctcaccctgctcctgcagcgtacgtgtaggtggtggcggcgaggacgtggcggaaggggtggtgcgggcagatccaccgcgtcagcattgccgcccaagtagcacgaccccaaatccatccctccaacgacccctcgccttcccgcacgacgcatctctcggtggcgatagcgccaggagggcatcgtcattgggagaagccattgttgcctgcctcggcgagaaggagaggagagacgcggggagaagcacgcgagggaagattgggagctcgctctccctcaaatccaccgagcgaagaaaacggggaagagaactccaaaacattccaccgagcaaataaaacaagaaagggaactctaaaacttttgtggatatgttggatccgaatttttcaaaaaaaaaatccctcaaatttaattttgggaagaaagtaggatcattggtgatgc

SEQ ID NO: 23636 - DNA, 1501 bp, Oryza sativa
cgcgcgcgcacttgggccgcctccttgggccggccggcccattaagctcggccaagccgtcctttctctcgggccgcgccctagccgcccgaggaaaagtctatttcccctccctcttttcttttcttttctttttcaaaaaggatttaattaaatcctttttcctttagatcaaaaatccaataatcttagaaattcaatatcttcccaaccataaatccgtttgactccgttcaacttccaaaattcctcaaatctcgagatctatctaatggcatgctcagaggtcattaatagggctttattttcgccgtttgttgagttgtcccgtttcgcgtgtagtttcggagcccgaagacccgcagtgcgaggatttcgaggatcaagctctagatctcgagcaaggcaagccacctttgaacatcttgagcctatatttgaaatttaattatgttgcttgaaaaatattatgcattgataggatcgcacttaatcttttgtcccgtctgcaagacagattggcggacttacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagatttggaaaacccgacacctgggtcggtgcttacgaactaaatgaatttccaaaaccacggaccggggaacgtatcgggtgtacggtttcccgctcttgcacttaaggaccgatttccttggaatttcatccaaacataagacaagtacgaccacatgggtggaatgggacacctctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacaggttgggtgacccgggttagtaatgtcgtgtgggtaaagtgtaccccctctgcagaggttaacaaactgttcgaacagccgtgcccatggtcatgggcggatgtgaggtgattcctagcgtagttttgtttgactactgcttgtgaaattgctgttgtgaaaaggggttcgatgtttgaaaaatctgcagctgttgggattagctaggcccgggtggctgtttgaaaagttgtaggcccgggtggctgtttgaaaagttgttggcccgggtggccgtttgaaaagctgttggccgggtgccaaccttgttttaattctaaagactgatacattgcacatactccgaccggacgagacgcactatctcatccgtgtcgtttgagaagcactcacttagttgttttt

SEQ ID NO: 23637 - DNA, 1501 bp, Oryza sativa
  unsure (1)..(1501): unsure at all n locations
ctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaagaaggcgagccgtcgcgaacgaacagggcgcgtgtgtttcccctcttctctccaccacacatgcttcaagtggctaggaaggcatcctcccttttaaggaggtccccctcttctagaataagcaaggtggtactaaactccacatgcatgccatcgcatgaggtgggcttttgtgattttcaaagaattaatatcgagtgggctaaggcccattcattaattccaacatcaactgcttgaagaagaacaccttangaacatttcagtttgacatatacacagcaggctaccagttttgtccaattcatcatgtcagacttacttgagaccatcactccatcagtttaggtggtttaatctgaaaaaggaaataccataaaaaatgtccatccaaaatattaactcctgactcaatttatagcatcacctgaaattctgaatttcagtgaggttcttatatttttatcttcatgatggtcatataatgaagttcctcaatttttagtatcttctaaatgttatgaagttttcaactcttctagctcagtaattaaaagatgtaaggaaagcacaattcgccactagcctgacacaccaccaccaattggtttcggttgccacaggcccacagcaggagggttgaggacaccaagattcatccgacctagtagccttgactcagtttcaccaatcccgtgacaacaatgaggacatgcacaccatccttgagtgcttaaggcaagctgaattattagcccccaccaagcggcggcgacgatatcttcaccgcatatctactatgtcgactgtcatggtgacagcgtgtggatctatatgtgtaatgtcaactcctgatgcctcctaaaccaagcatccatgcgtcaaagcaccccgctgcacgcctacaccctagcgtagcccgatcagtctggaagaaaatatttttgtatgacatgtgctgtcttgcaccttcatctggtctttgatttgtacaacttttcattcgatgtaaattattcaaccgtgtcattgcagaagatgagtggaatgcaacacctaccacc

SEQ ID NO: 23638 - DNA, 1501 bp, Oryza sativa
gtttaatgcaggcttcaaggaaaggctgttgttttcgcaatttattttatttaaactcttttctaaaaacaactaagtgagtgcttctcaaacgacacggatgagatagtgcgtctcgtccggtcggagtatgtgcaatgtatcagtctttagaattaaaacaaggttggcacccggccaacagcttttcaaacggccacccgggccaacaacttttcaaacagccacccgggcctacaacttttcaaacagccacccgggcctagctaatcccaacagctgcagatttttcaaacatcgaaccccttttcacaacagcaatttcacaagcagtagtcaaacaaaactacgctaggaatcacctcacatccgcccatgaccatgggcacggctgttcgaacagtttgttaacctctgcagagggggtacactttacccacacgacattactaacccgggtcacccaacctgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccagaggtgtcccattccacccatgtggtcgtacttgtcttatgtttggatgaaattccaaggaaatcggtccttaagtgcaagagcgggaaaccgtacacccgatacgttccccggtccgtggttttggaaattcatttagttcgtaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaataaagccctattaatgacctctgagcatgccattagatagatctcgagatttgaggaattttggaagttgaacggagtcaaacggatttatggttgggaagatattgaatttctaagattattggatttttgatctaaaggaaaaaggatttaattaaatcctttttgaaaaagaaaagaaaagaaaagagggaggggaaatagacttttcctcgggcggctagggcgcggcccgagaga

SEQ ID NO: 23639 - DNA, 1501 bp, Oryza sativa
  unsure (1)..(1501): unsure at all n locations
ccggtaatggatggctattgatgaatcttaaacatactgcacagacaacgccagttaattagccatcaacactccttcgtcttaattttaactgagcttaaaattatatgagtaattaactactgagatatctcaccccatctgatcaccggcccttatatacaggtggtaggtgttgcattccactcatcttctgcaatgacacggttgaataatttacatcgaatgaaaagttgtacaaatcaaagaccagatgaaggtgcaagacagcacatgtcatacaaaaatattttcttccagactgatcgggctacgctagggtgtaggcgtgcagcggggtgctttgacgcatggatgcttggtttaggaggcatcaggagttgacattacacatatagatccacacgctgtcaccatgacagtcgacatagtagatatgcggtgaagatatcgtcgccgccgcttggtgggggctaataattcagcttgccttaagcactcaaggatggtgtgcatgtcctcattgttgtcacgggattggtgaaactgagtcaaggctactaggtcggatgaatcttggtgtcctcaaccctcctgctgtgggcctgtggcaaccgaaaccaattggtggtggtgtgtcaggctagtggcgaattgtgctttccttacatcttttaattactgagctagaagagttgaaaacttcataacatttagaagatactaaaaattgaggaacttcattatatgaccatcatgaagataaaaatataagaacctcactgaaattcagaatttcaggtgatgctataaattgagtcaggagttaatattttggatggacattttttatggtatttcctttttcagattaaaccacctaaactgatggagtgatggtctcaagtaagtctgacatgatgaattggacaaaactggtagcctgctgtgtatatgtcaaactgaaatgttcntaaggtgttcttcttcaagcagttgatgttggaattaatgaatgggccttagcccactcgatattaattctttgaaaatcacaaaagcccacctcatgcgatggcatgcatgtggagtttagtaccaccttgcttattctagaagagggggacctccttaaaagggaggatgccttcctagccacttgaagcatgtgtggtggagagaagaggggaaacacacgcgccctgttcgttcgcgacggctcgccttcttcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 23640 - DNA, 1501 bp, Oryza sativa
gaaaatgcaaaagatggaatcaataaaaaaatagggccttaaaactcccttattactcttatcctagtacgaattctattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgatatatatgtggtggcttaagattttttattaacaaaagcggtagcgttgcagcgatcgtgatcacctaagatgcctcagacacgatactttgtcacacgtgcgaaaggcaaaggtgtagacgtgcattgtgcagcggaccaaaaagagaactttggacactttagttattaacaatagatctgttgatttaaataatgggtccaccggttctagtgtaaatgtaaattagttaatatatattttaaattgttaatttaatgggtacacaatatgatggtgtagaatttattttaaaatagtacattatttgagaataatagtctaaattaataaaaaaaatagataccatgatttaaataatgggtccatctgtttaagtgcacgtataattagttaatatagatcttaaattatttatttgataagtacacattataattgtgtaaactttattttaaaatagtgtattatttgaaaaaaatagtacaaataataatgagtacactggtttaattggaaattatattgatttaatgggtaaacatataatggtgtaaattttattttcaaagattgtagagctaatttagttaactgtgtttataaagaattatatgatggtatattctttgtttgtaaattatgtttatttaaaatatatatatcaattatataaatggaaaaaagaagagagaaaaaggaagaaataattggagggaggcgtacatactacatacgaaaataattggaaggaggcgtacgtactgcatacccatgtacgtacgtgagttaggtgggacccatagtatttggtttattttaggatcaattttatctaacggtgtataatattggacccaccaatttaagtgaaaatcaagaggtagatgttttgcttttttcttagaatttacaggattttctctaatttattagagtgtcatgtggtaacttgagagcgtttgtaggaagtttaatggacttttagtatataatagatagatagattacgtgggatgataatttaattaatgcttgcattttaaaactctaaaacttaataaattagcatgcttgcatgagatttgagatatagtaaatgttagtggatgatgtggcatctttgtatgttgagctttacgatgtagtgggccttaactttatagaaagataggataaatataaactaatcgatgtacacaattatgttt

SEQ ID NO: 23641 - DNA, 1501 bp, Oryza sativa
gtgacacttctacaaacgctttcagaccatcatgtgacgctctaataaattagagaaaatcatatatattctgagaaaaaaatctatccatttagttccactcaaattagtggatccgttattttgaaccactagattacgtctattaaaaattaattccgtcctaattgatttcccgtgtaagtaagagataaaatacctacgcatagcttcacatgaaaataaacctaaaacacattaccccttgaacttcttagtattaaaaatcaaccaaatctaaatagatagccacatataatgtcaaattacccgtagcaaagcatgtgcattcaactagtttacatttacatttatatgctcctaattgtcttataattaagtgccttatatatgtcgccttccactttggcgtgcagtgtaaagtttagttctgacttgattaattaggcaatttcaatattaccaatcaataattgtatgttatacttgcattggtttaaaaccgcataaattttagtgaaattcaaagttcatcttggagtcctcgtttagtttttttatttaataactcaaattcaaaattaacgattctagctagatgtacactagatgtagattgaattgttatgattcgattagggcacattatttttctagttacgttgtttaaattatcaaatgtttctcttttagaacattagtatcaaataactacgacatgttctttcttagcagataatggataatccggctttgacttaagaacaagctacccccacttcctatgaagttttcaactgaatcaacagtaaatatgcatactaatgaaaaagatgacaagaaggagaaacattattaggaggcttcctattggtgaatcttcatccaatgttagtgaagatttgcatgaccattttctccaaactctggcgtacaatacatatatgagttccttgtttttatcacacttttatagttgggcccaaaactgcagccaataaatataaaagtacttgcatataagatttaaaagtagctctgtcaaacaccatatcactcatggtaaaccaaagaacctaacataaaatatatggatctactaaaataagctttatggttcttacgtcaacggcactaagctaactcccccaaaatgtgaaacattatttggtggattcaagccaaaataaatacggaccaatctccaaagaaatttagcaaagtgacaatcaaagaatatatgttggacagtttcaatatgcatacaaaagcaacatttttttagtactagcccaatttagtcttgctaaattatccctgtttaagatatcccctttaattaagcaaatatcacataaatatttttattttaagaggaatcccattttgttcttctcaatatatataaccattgttgattgcagctaagtacataggatggatagagaacataccattttgatgaagattccatcaaaatatatctttatcctcatttaga

SEQ ID NO: 23642 - DNA, 1501 bp, Oryza sativa; identical to SEQ ID NO: 20487

SEQ ID NO: 23643 - DNA, 324 bp, Oryza sativa
cagtgtcaaacattttgaaacggagggagtatgacttaaaactgtctatgtcaatatatatcttgcttccaagtattgatgtgtataatataatgtgtatgaccaacttaattagaagtactatctctttatctatttgaatgttcagtgaacgtgaatgtggctactaatttgtgtccccacatactgaaaagaaatatgctagttttgcatgggcatgaattgctccatagcagctagatttttatttttttatttttgttataatacaacaatgcaagcgtttagatccgcctggtgaaaagtgtttccactgttaaatgt

SEQ ID NO: 23644 - DNA, 1501 bp, Oryza sativa
cttctccagctaaactctactcgttctagaggttgtgttagtcatgtcagtagatagctttgttgctttcggttccggtttggtttaatttgatggttgccaagcttaattaattaggctttgacctcctacctgtttctgcagaggcttttgtatctacaatagttgttttatattataaagatttttgatagacaatactagttgaaaaatagatcatttgagatgtgactgataataagtcataaaaatgctagagcaattttaggggtaaagtcataaaacttggaggtaaaacatttttttagggtaaacggcaagagctctgccaatttcattatagaagaagaagaagagatatatagtttttacaaactatggaaaacaagaggaaaccatagatcccccgggaaacaagaaaaaacggatgggaggattttcaggcaatgcatagcaaccaaaaagaggaaccgggtactagtcatctaaactatgagctccgttgtaggctttgcgcatggcgatgatagagtcaacgacttgcggtagtgtgctgtaggcaccattgaagatccttgcattttgttgaagccaaattccccaggctgtgtagatgaaaaggccatcaaaacttcttctttgatccttgatcatttctcttctgcacgctgtccaccagctaagcatatccccattaaaggaggaagccataggcatatgaagcccggctttctgccatatggatctccagaccagttttgtaaaaggcgcaatccatgagtagatgagtggcggtctctggctccactccacagagtaggcaaatgtggctgttatcccagccgtggaggaggagcttgtccgctgtgagaatctttctatggaccatgagccaaccgaagaacttgcatttattttcagtcttgaggtaaaacatttgtatccgtgttattagatgtttaaaagcgaatgttgaaaaataaattacaatggaagaactctaaattcaattttaaagttaattttttttgctggagctaataagctaatccatctaattttataatttttgttgttttgggtaatcttgatcgagatcaatttctttttaactttgactatcaatagttttcaaaatatttagtataatgacactagaaacatatatagattcttttatgaaatactataataaaaataaaaatttattattatatatatatatattaatgggaaaatgtattaaaatatattttaaagatcatatcataatttaaaacgttaagaattataaagagaacatcagccaagagggaaaaaaattagtagacagcattgataaaacggtccaaccaaccccagggcaacggaggacaaaaataaactactgaacatactggaagcagctaccgaaaacggggtcagtaagcagatcctgctgctctgtatgcttttgattatatttagggctcgtttggattgaagctaattcttcgtttct

SEQ ID NO: 23645 - DNA, 690 bp, Oryza sativa
atatgaatattattttcatacacaatatggtttcgttataggtagacaatttgcatttctctacttcactcaagttttttctgaaaatagattcaggtaacgatacctaataattatatgctatcttatcatgcataataaaacaaaacacacatattaaacaataatcacataataaacaataatttgagttgtattcagaaaacatggtgttatgcacaaaatatgtaacagtgctatgtgtgacagtgaggtagagcaaagggaggtgaatggataactaataaatgattgaattggatgaataagtagcttcttgatccaatggttattatctttatactaatatgatctaatggcttaaaattattgataatgtggcttcctgcattcttgctttataggagtagatgccccttagtgggttccaactatataggaagatagggtttgggagattggttcgatttagagtccaaaacaaaaccatgtcctcccaatttcatgttgaattaggtccccgactttgcttcctccatgcatatggctggtaggactcgaggtccgagtctattccctgtgcctgcacaagccgagtcaatctcctacaaaatcctgactcgaacagagtcattctgctacctctagactctagtcatctctatggtctttggctttgacatgcgacca

SEQ ID NO: 23646 - DNA, 335 bp, Oryza sativa
tctaacaaactctaaaataacaataagtctttaagacagacttttgcccacatttatctataagaaatttacataagatatcctaattaatagatacaattgcgttcccgggactccatccgtgtgtggcaatcatcctgaagtacattaacttgaacccgatgtcgcgtacaagtcgtattgtcggaatcggccgtatcggcttgcttagcccgactcagacccagccgatcctaatagtagccgatctggacttgagccgactcctgctctgtttccgaactcgatctccgcctcagacttcgctttgatcaaatcttctgtcctgacacaga

SEQ ID NO: 23647 - DNA, 1501 bp, Oryza sativa
cgccggctgcctctccctccctctctcgcctccaccttcctagaggccgggcgagctcaagcttgtacatgctcgctatccgcctccctcgttgacaacacctgagctgcgtgcgtggttcgaaagaaaaggaaagaaagaagtgggcgctaacacacgggccctgcatattttttcttctcacttgcacatgggccccatattttttttattttctttttactaactaggatgccatatcaacaaaaatagatatccatgctaccatgggacccaatttaacttggttttataagttaaggggttataaaatttctagtattgtgctttaggaatgtcgattaaactcggtgtaaagataaggaagggcaagtagacttatctccttacaggtgtaaccaacaatttagtactgtatagtccaaacggccgattgctacagctgacatataaacaggggctagcccaaaacgagtccatctacacatgaaaacctgtggcaaccgaacggtatatgtctgtaggaaaaagtacaccgaagatacctcaacttgtcatcgaattacaaaatcatccttgaaccgtgaaaccggatacaacgcttccctcaacttacaaaaccagtataaactaggtccctcggcggttttgactccggttttatccgacgtggtagctgactcagcgtgggacccacgtgggccccacactcagggtgaccacatcatcatgtctttcctttcttctctcttagttttctcctcatcccggccgcctggtggggcgatgtgggacagggaggccagcgacgggcggtgcggtggcgtggcgacgcggcggcggcgggccgggagcaggcgggggaagagctgtgcgtgggcgacgggcgacggaggaggagcggcagaaggcggagcgtaccccggcctgtgctgctgcttgtctctccctcttgaccgcatttctctctggctcacggtgtcgctgctgttgcaggtggcggagcagctacgggcggtgactgcgcatcgccggaagacggagcgtgccgagggggaggtgctcgccatcctggagtcctagggcctcgcccacttctccgacgccgcggattccggttcaggttccgacgatgaggacgacttctagtctgccgagagcggcggcaaggctcgcggggaagcggaggatggatgccggggtctgaacttggaagcagtgctactgcggaggcggcggccagggggctgtcgtggaagggccgcgccgcgagccacgagtcgcagaggcggcagcagcagcaactgcgtcgataatgatgccgccaccacgagaaagggcatggtctcggcttcatttccggtttgtccgtctagctaagaagctcatcaacggctgcaacggtgcgctcacttgcgcccagctgcaacggtgcgtccatcgcctgtagccactgcgccaaactcatagtgttgtcacggtgcgtccacctctgcgtagt

SEQ ID NO: 23648 - DNA, 1501 bp, Oryza sativa
ttattaaaaatatatatatgcaaacgagtttccacggtagatttcaccataactaaaacgtataacaaaagaaaagacctaaagaaaagaactacgccatgagctagctagctccatttatgcaaggaaggaccgaaaggaggtagctagtgagcactaaccagtgacagtgtgacgacttctacagtgaggctgtgctggtgcacgtactacggctttagctcctggctcgatcgtgttgtgatcaacttaactcgggctggctttgcagatactcctgcctttggccggcgacaataatgccgcccatattctgttcgtgcaaccaccgcgtcggggcgatcctattacatggccccatgtcgttgaggcacagcttgtgatttctgaatgactctgttgtttgtttgttagtagctataacgtacggcaagaaggtgaatccgccgcatatactgatcgatgtggaggttggacagatcgatcactatggatcaaacctgatttaacttattcgaacccgcagaattcttcttggcaacaacatggtctcatcgaaaatcaatctcttttcagttttcaccatgtcttcagcttttggacacgagatgtgtctgtagtctggagtgtgaccacacttgccagtacagctacatttacatagcgttgtgccgctacggtgagggccacctatctgacgagcatctgagggagcttgctaggggcagaacagtgcacaccaagaggagaggctccctcaccctctcaaccctaaacaccagcctgttccgctgtagcatttgtcgtcggtcatgtccctgccatgggtgcacactactgtatacgacaccctggaaggatttgaacttctagttgttttagcttatatgaactataattaagtagagtactaggtagcctataggcatgttttgatatgtttaggacgtcatctttgctattcatccgtcgatgaaatttggggtgctcattctctccatcttagatggcgtgtatgtgggtgaggcaagaagacaggagatcacaaagggaggaagatggaggcctcacaggcgatggtgatggcaaaaccgagcattggtgctgatgagactcctgttagagtttgtgtcgaataaaactagtcatttgagttgtgtagatccagaatctaaagttgtgattttggttgggtctatggtggagcaggtccaatgtgactagggtggtcttccgttggtgggtttggctgtgcattctaacaaatggtatcaaaacctgcaggagatccattgatagaggcgtgatgaggtgccccacagtgcgccgctcgcaggttatgcccagggagggacatgtgcacaaggtggagcacgtcggcggatctgtggatcgaatacttcaggtggcgatttgaaccgttcaatggctgccttcaagcttttaacagtgagatgactagaagcaattgatgacacagaagcaattggcaaactgttga

SEQ ID NO: 23649 - DNA, 1501 bp, Oryza sativa
atacttaaatcaagtgattgggatagatcggtcaccatgccaagacagtataaataacttagatcgaaatatatatcaataacagggttatatatgtttgtagcatagccgatcagatagatctagcatgtatcagctaatactccgatactactttatatcaagatattaaagcaagtataatatatcgagcaaaagcctaacattcttagacacagcaatatcttaatataaagggctgatttaacatatcattgaagcatatagaacaaatataattaaatcagatacgatcggctgaaactccgatgctattctaatcggcaactagaaggcagactagagatcgatattctaagcacgactcaataggtcaaactcaactgatacagcattaagtatgaaaagaagaacaatatttagacaatcaagccgctagaagtttcatagaatggtagatatctcatataatctagatcaacatcaagatctaacttaatcggctgccctctgtgtacagatatttgccgatagtagattaggtggcgatattgctagagattatgtaagatatatgataactcgacgaattatataaacaagattagagtatcacaaagatggaagcactaatcctaaaaacacaatccgtcataacgagttttacctcttgttgaagatcgaaaccgatgtagctcaacccgaaagcaagaactcgttgaagcaaaactaaagcaaaagggtggcgatgcgccgaaattgtattgaacgtgtgtgttgttaaattacatagggctcggggtctatttatacccgagaattacaagatatgcccataccggacacgactattatctctaacaaactctaaaataccataagtctttgaggcagacttttgcccacatttatctataagaaatttacataagatatcctaattaatagatacaattgccttccccggactccatccgtgtgtggcaatcatcctgaagtacattaacttgaacccgatgtcgcgtacaagtcgtattgtcggaatcggccgtatcggcttgcttagcccgactcagacccagccgatcctaatcgtagccgatctggacttcagccgattcctgctctgtttccgaactcgatctccgcctccgacttcgctttgatcaaatcttctgtcctgacacagatgttaccaaatttggtcgttaacaaaggggtatggaccgaaaaggagggggagacctaggaaaacagataaaagatgagagttgtattttggaatatcagagattgggggcttctgggaggcagagacagttaagggagatgatctttgaacaacaggtagatgtgatttgtcttcaagaaactattaagcaaaccttttcagaaagagaattgaggaatctggtgggggatcattttgtgtggagatatgtggttgctattggacactctggggggatcatgactggggtgagagatctaatgtttgata

SEQ ID NO: 23650 - DNA, 359 bp, Oryza sativa
ctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttaga

SEQ ID NO: 23651 - DNA, 423 bp, Oryza sativa
ccctcgtttttgttcggattgttcaggatttcaaattcataaacctgtgcatgcaaatcttgtagtagtttgttactccttaatcctacgtgacctatggttcacatgaatgtttatactttgtgtgatatgatgcaaaaatctttatgtacaatgcttttctttatctgttactatttatttggaaggtgtggaacgcgcagattttgcaggaatccgtgtccacggagtctgggatgtgtggcacaactgtgcaagagtggaggatttcgcaagaggcgggtggttttctccccgtagtctgttccttttactcgaactggaacacagagttggcctttcccctcggcaatttagttgccgtgttctatgtacttgtaacgacactcctgccctgtctaaacaagaattcttggccggcat

SEQ ID NO: 23652 - DNA, 872 bp, Oryza sativa
ggtgagatgtctggttttatgttttaagggggtaatttaatcgaccgtgatagttcgggagggggtaattaatttgtactttttcctattataatactccctccgtctcataaaaattacatttctagctaatttaggacaaaacagtaggattgaaaaatgaccacaatgaccttatttaatgaacccattgcatgcacatatttcatatatacaaatgattaaaagtaagtttagagaattaacccatataattagcatacctaaattacaagctgagagaacttaaggaaacttatctagatgaatcaatttgttgggacaaagccttagagctagaaatgcaattttttttgggacggaggtagtacaatggaggagtgagcaagagacagaaagaagcaaagcaggtgtcatgtgttagccatgtcagcaccatataggggtcaagatatctagttttgtggtgcatgatcacagagtagattatggtcaaagtggacttattccttcatatagtggcctagggttggatttgggccgctctaagaataaatgggccttgagtgggccaaagcccattacctgtcagtattaatttgccctagccgatgatgatgatgtcatgtccccttctcctcggccgcgccctcgactccccgtttcgttcgcccgccgcgccgcgccgccttcccactgcatcccgcgccgcgccgccagccgccggtgaggtgaccacccgtacccacgcccatcctcttgctcactcctcccttgtagatctggaagcttttctctctcgcctaaccagcctctagtaccaatagcagcatcttaggaaggaggggagcccgcggcggcggcggcggcca

SEQ ID NO: 23653 - DNA, 244 bp, Oryza sativa
agtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccatttta

SEQ ID NO: 23654 - DNA, 392 bp, Oryza sativa
cagatgataaacagggactactggataattggaccgtttagaccggtcaaggtttgccggtcacaccagaggtatacgtgtggtcagaccaaccagcccgcggtctgaccattcgactatgtgtcggttttagtttcgggttatttcattggatatttgtggataatttgtgtttatgacttctagatggatactatgtgtacgtaatactgttgtttgctaacaatgagtcaagttggagatagcttgtgctcgagatatggtttcttgtttgattcatgtgtaggtgatcttgacgcctcgagatagtatagcggattgggagtcaacttggagataaggagacgtccggacggtcagatattatgtgggatacttaggctaaagatcaa

SEQ ID NO: 23655 - DNA, 485 bp, Oryza sativa
aaacgagttttgggaatggcattccaacgaaaccgttttttgaacgtggccaaatgtccatttttctcattttaaatactagaaaaataactatttttaagaggaaggtactccatccgtttcacaatgtaagtcattctagcatttcccacattcatattaatgttaatgaatctagacatatatatctatttagattcattaatattaatatgaatatgaaaaatattagaatgacttacattttggaaaggagcaagtagtacataactaatacaagattagtagattacacctcaatttgctagtttgctcacgagaggtcctgtcttcccgactgaactgtgaactcccagcacttcgaaattaacaatagacttgatttcaaatctgaacaaacgatgattagtgaccgggaggcagctgttggccgctgtcccggtgtcccctacattcattcacgcgcggccgtgcggcaccatgaa

SEQ ID NO: 23656 - DNA, 1462 bp, Oryza sativa
cccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaataga

SEQ ID NO: 23657 - DNA, 1038 bp, Oryza sativa
gagtcttggcatataccccagttgagcgcctgtgaagatggagccgtaggctgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaagtggataaaacctaaggacatattttataaatgaaactatttgcgaaagctcctctttttctccttcccctaatgctatttgcaaaaggtttactcttttcttccttcaaatttcaactagtactagatggtcagctttgctaagaagaagatatcgccaattgtttgccgaagctccggaagactgcaggatccgctagcgaagcaaaggaagcagtgaagccagatgtgaagcaggagtgaagatcttggaaaacccatcgcagaacctaagccgtcctctagggtagagtcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctttctctcccctttgttttccctctctccctctccaaatctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaa

SEQ ID NO: 23658 - DNA, 1501 bp, Oryza sativa
ctgcggcccggtagtcgagatgtcgtatggcagagggttggtgccctgctgctaggggctcagttctgcctgcctgtcccgggtatcccggccgtaggtgggattgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaattttgctcaacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtacccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcccttgtaataatgtaaatattatcgatgtaataaagatgtgcctttcatatcatgtttgtatggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttctttcttcggatttcaactaagtactagatggtcagctttgcaaagaagaagatgtcgtcagttgtttgccgaagctccggaagactgcaggatccgctagcgaagcgaaggaagcagtgaagccagctgtgaagcaggagtgaaaatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacctgcagaataagcaaaacaaacaacacatcaacaaaaaaaagagttagttcctttaaggtcttgtctctagttctggtctattctctccttgtatgcttcccctctcaacctctaccttgtgacagatggataatcctggtaaccaaggctatgggaa

SEQ ID NO: 23659 - DNA, 1501 bp, Oryza sativa
cgtaggattgttcgttggatttctgcggtcttggtcaacaacacactgagttggcaatccttgggcacatggtttgttccttcgcacagaaaacatgtcaccttgcgagtgggacactcccctggtggatggtcttcttcatagtgagtgcagagtgtgagacacatgctagcaacgtgtccaatttctccacaacgggtgtaggcctttgatccgaagaagacacatctgaaactcttagtccaaacaaatgtctcttgggttaatcacttgatttgcttcgccatcaatcgctaggttatttgattcataatagattatgagcttacggaaatgagaccctaggtctccctaatcagcaacaaaatgtacacaactcacagcacttgcaatcctaacacggatccctcaataaacttatcaagctcattcattatctcatgtttctctgttattacatgattgacggggaacaactataaaacaaaagtatttgaacactgatataagagtattatggttgcttctgattagcgccaggcttaacaggtactgcatttgctccagtgaccacttggcgatgggcatgtccgcttccttaacaggtaccacagttgtaacagacaataactttcttatgctcgggttctccatctggtacttgatttcttggctgctgtgctggaacatccaaaggtacaatgccgatactggcctctgtcttgtcaactgatggctggggctgaaagtgagcattgacaccttgtggtaattgtcacgtcctgataaatccattccaaattaaaatccattttctaaaaggaataatagaattaattaaaattcggaaagaaattggcaaacactaaaatacgtgcaagaaaaattcaaatgtggcccggagaatttttgttaaattctccttggtctaaaaaggagccctcaaattttacttgaattttcagagcaccggaaataattattaaacaacaaaaacaattatcaaagttcaataaaaagaaaacctaaaagtccctcctcttcctcctttgggccaagcccagtccgaagtcctcctctcctcccttttttctctccctcctcctcttgggcccccttcccctcggcccacctccctcttccctctccctcccgggctgcctctctcttcccctcccctcccggcctgcccggcccaggccgcctctccctcctctcttcctgggccggccgccggcccaagccgccccagcccccgagccgctcccctcccgcacgtgccgcgcgcgtgcgcgcgctgacgccgccgcccgaccgcgtggggcccgcgcgtcaggcgggcgtcgtcttcctcctcccgcccggctcctctcactcccgtggaaccctagctcgtttcctcctccaaatccgccccggatccaaccgttccttccaaattaattagggggaattaatcccctttccctcctcttcaattcccccttaatttccccttgaa

SEQ ID NO: 23660 - DNA, 1501 bp, Oryza sativa
tgtctcatctggagaatgtttttagtggccacagcgacgcccatgatatacatacaagtgtacacataatcattacctggtactagcacaagtggcgcccaatatgcgccccttcaatggcgcattagatgtagacagacacacagtagttgtgtgcacagcgggaggagcatcacctcacatgtgcctgtcctgccttttgatgagtaaaaaagcgtcgccgttaggttcgtgttctttcgccatgtctttgcagcagcagtacactacactacactactacaggcacagctagtagaggaaagaaagtggtaacaaaggaaagaacaaagcgaaaggtggagagagtgtacctggacccacgcacgagtgtgacccgggtgagaagagaagaatatgtatcaccttgcctccgagctggactgcaccatgcgacccacgagagaatatgaccgaattttttgtttttgtggccggctagctaggctagctacggttttgcaaccgccccgtcgtggtgctgtgatccacgcgtgagagagatcgcgagacagcgccgtgggcgtcgcacgcttgggatcattcaccgatggcgagaggaggggaaacgaaacatgggccctgtttagttctaaagattttttttaacttttaatttttcatcgcatcaaatcttgtatacacacacaatttttctattacatcgtaccagtttcaaccaaatttttaaacttcagtgtgaactaaacacagtcgtgggtgatggtccaaggagaatggggtgcttggctcctgcaccagcaaaggcgacagcgtgagcgggtgtcccgctcgtttcgcatcatggctggcttgggtgtgtggtgttggtggggcgagtggtcgccaagttggcgatgggcgtcgttcgtttcctcgccatgacgacatctctcatcagtcatcacagccgcccgggaggatcgttccactcgtttggtcgaccagcgatcagcgcatgcatgaattgggtccgtgtaataaacttaacggaaacctttgacttgggcactaatcaggcgttagttcatttatttgcgttgatcagcatatgtggcgggggagtaaaaattcctgatttcgccgtcgccgtcgtcgagtgacgattgaggtggacagtggagtaggatatgccgtgtggcttcagataaggattgagatcgatcgagatctttcgatagtggtggccggtgttgggtctcagatcggaaagggctatttattcagcgtagcatccattaaaaaaaaaatctaaatataagtctagctagaaatctaaacacacataatatgtgtccagatttatacccaggattaatctttttttaagacggggtaggagtagtataggaatgtagcgcttttgatcgtcctctctctccactacagagacatgcacggctgttgcattacctgttgggattggctggcgactaaacatatattattttttaaaaaaaaa

SEQ ID NO: 23661 - DNA, 299 bp, Oryza sativa
gctattgaacagtgcattcatggggtgtattttctcatcttgtaattgtacacttggtgttgtaattttagttcaatccgtgtttctttcgaagcctaatgtaagatgatgagtttcagatacaatacatttacaggatatgacatttcatggtttcagtcatcaagtttttaccctgcactgtgatcaatttcttccagatgttgcccattcagtatgtacatgcttctccttgtgagtgcaagtggtcaatatccttgccatttaccagtccaaaatatatactcattttatgataa

SEQ ID NO: 23662 - DNA, 1501 bp, Oryza sativa
gcgccggggcaagccaagccaaggcagggccaagtacgcgctgccacctgacgtgtcgtggagtgacggaacgccgttagagagtcccccgacggaacggaaaaggcgcggtcagcttgacccacccccaccaccgtaccgcaccgcaccgcaccgcagcgcggataaacaaaagcggcccgagcctgtagccttcttccccacacccgccttccctttcctctcttctcctctactcctcgccttcttcttcttcttcttcttcttcttcttcctcttgctgttcttcgctcgcgcccgcccaccactgcaactcctcgtctccccctccgccgcgttgccgggtggagttgccttgcccgagaggagcgggcacttcgggtttgtgagagtgagagctctgtgcagcggacaggtttgaggcggcggcggcggggctcccactcggccgaatgtgagtgctcttgtctggcttacctgatttgggcttggtttgtttgcggttctggggcttatggttgttcggtgagtagctgcctcggtggaggagggctgggttttcgggaccttcttggctggccggatcggtacatcgtaggggtgcgatttggtagatatggtgttgttcaggagaaatttcgagaggaaatgtgaacttgcgggttttctttttctccttccttcactgtctctgtcacagttcttgtttttctttgccggtcgcattgcagtagttgacgaagggaagcgtatttagttaggcctgtatctaagcgtagaccatatcaaatttatcaacttgtctataaaaaaattggagataaataatggatctttattatattcctagtctagggtatgggttgtcatgtaaaccgcaagatttccacctcgaaatgcaacagcaatctacaggcgattttaatatgtgtaataatgttctgttgctcagtcctcttccatggaaagttctttattttagttgcagaaggatgtgtcatgtggttggcaaaccgtgttaatttcagtggtgggatagcaatttcctcaatttgaaaagaatcatagttttcttgtgcccaaagtgatgcttggtgtgtatatacgtaggaggaaagtatgtgctggtgatggacttgattattcccctttaactgctggctaggataggtgtacttggttgttggttgttacaaggtctaggttgatttagcggtatatcattctaagcatgtgccagtcaaattcatctagtacatacttcacatgttatctaatcaagaatcttttgttttttgcagggactgctagtagcggttgcttctatgtgtacagtatctaaccttctaaccattttcaaaggaggtgtggtaaactcttgctcatttttctaccaaagtttagttaaatggattgttaaccactctttcctatttgcaattggcaggtcatattttgtagggcatcgtatgccttattatctggcattggctggtttaga

SEQ ID NO: 23663 - DNA, 828 bp, Oryza sativa
tgacttatgaatcaattgtggtggtcattctgaatcacatgctctacactctcactaagtaacatgactcgaaagcaagttttttttttggccactaagggatacagcatcgcagagactttgtcggaaccttttttttttccgattagtttcattctttctggtgcgtgcaaataagccaatggcaaagtggactgatggtctgatgtcaatgttgtagtgagatgtttctccttgtctttggcaacagagtatcctgtgttttatttcctttccgctgctggagtagttgaatctgaattgccaatgcttatttttggccgctcagttctgtacttgtgcagatcgtgtgccccctttacaacttttgttcagagttttatttacttaggcattgtttcaggagagctagcaataatgcttagtaagatttttgtgattttcttgatctaatgaactggggcctattttgatctgtcagttcgacaaaaaaaaaaaaaaagaggaggaacatacttgtggaatttagttgtctcgggtgatattaagccaccacatatcccttatgtatgttttaacggaatttgtaagtcttttgccaactgcaaagcggactaaaattacattctgttcgaaggaactagaatgatttatattggcatgattacagcgcaatttgatgtcactggccttctgaaaatcattcccttccaggctgttccatttggtcctgcttaattgtttgtttctgagtgttatggcaataattaatctactgcgttatggaaaaactgaaaagaaatttagcagttatatatacctttcagt

SEQ ID NO: 23664 - DNA, 182 bp, Oryza sativa
tttatgacctttaacagattactggtcccatgcataaggatgccgcaaactgttgccggtaacacattagcttatttgtttaggcatctggcattttctagatttctctttttgtttttatgtacataagtcatccataataaaatctttggattttaatttgttttccctttgactgaagg

SEQ ID NO: 23665 - DNA, 1501 bp, Oryza sativa
aactagtttaaaatcatatcgttgtgttgtaagtgcatttgctgcttgcactattaatttcttggagatctgcatgcatgctgacatctgatagaaaatgaaccacttcccttcagcatttgctttgcttctttggtctgtgttggtttcgacttcctttaaagtgaattctatcagaaggcctgtaaaaatgatttttataggttgatgtgttgatactagagatgttcttcactgagatgtttctgtcagaatgctcattgaactgttagatacttctcttagttttggaattggtttcacaattgtttgaaagcttgaagcaataatcaacacagtagatccaaataggcgaaactggtaatgtcagttgggttaatgtgagtccacatgtctctatgttttctgaattcagaagcttatgttcattccttttttttttttggaactgaacttatgttcatcctttgcaacaacttgtagagtgtatgtacggcacctacttgtacatgtgttgtttcaaatgattcgaaactgaaaactttttctagtgtaattctgacttaaaattaattatattttcccctgttctgtttgagcattatatgctatctgtagctttgatgcaaaattccatatggaggctgtcaatctgctctgttcgttaggtttgtacgatccttggtgcttaggacagcatttttttttcgtagacgggttcatctgaaccatatttactgaatggtgtccataaaagaagtccttttttttctttttcgagggaacaacactgatcaccgatcaagtgaacagtataatgcatagtatttgtatttttatagagatgtttaatggcccttacttctggcgacacatatggaggctgcctctatacaaacagtaaaccgaactgtacggcaacactgtttgttctctactgtagcgatctatcttagttcattcgctgcaaatccgacgcctgaaaataccccaaagtcacagatacagtacacctcctaacttcaccgtggatcccaatcccacgccacatcccacgccagcacaggagcgtgagcggttgcagcgagagccgctcgcgtcacttccccgtccatggacggtgctccaagttatggaccaccccgtgcagcatcttcccaaaacgcaccgaccggcacaatattaaccgtgcaaagagccagaatttggccacgaagcgagcaatctcaagtgtggccgggttccgcctcccgcgtcgccagttgtcgatcaggcgcaacggcaacggcaaaggcaaagcagtcgcctccgaggaaaagtccgcatgaactcgcgagaagcggcgggccgtggcggggctacgtggtacgtaccgcctcccgccgcgaccgcatatatgcggtgcgtgcgcgcaaacacaacagacgccgagagcccgcgacacgggagacgggagtacgggacgttcgtgtacacccccacacgtaacacgcgtgcgaaa

SEQ ID NO: 23666 - DNA, 490 bp, Oryza sativa
accacttgagactgattgagttaagaaatgaggtgagctaataaccgtacctctaacgtgtttggtgataacaataattgtactgttgtttcagccttctttgttgatgtcctgagcaagttactgtatctaggttgataagctgtactgcctgagttagttctatcttattggcttctgagaaagtttcttctttacctggatgtttgagttttataagtgattggctggggaattaacatttagtttattagttattataacattttcagagggaacacattggaaatatatagatcaatacaagttcggattcacagtttgaaacccatgtcatgtgttaggattgctgccatcttgtgctcataggtatctacatcttatcctacggatccagctttcttcagagttttgttccattttgcttgatttgagacatgcttgaaatgtttatttcaacatcttcccgacatagttttgtatggaataa

SEQ ID NO: 23667 - DNA, 249 bp, Oryza sativa
agctaccatatcggataaaaccgggatcaaacccatagaaggatctaaagttgacggttttgtaagttaagggatgtcgtatatctagttttgtggttaggacacaattttataactcgttgacaagttgagggacctttggtgcgtactttttccaatcccggacgggaagtgatgcgtgcgcagccagtgtacggccggccaaggtcgcgtgggtgatggaacccaaggtcagcggtttcacgcgca

SEQ ID NO: 23668 - DNA, 1122 bp, Oryza sativa
tccgttcgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaaccctaaccctttatagtataactcctttgtactcccttgcatttattctgtacttgtgggtgtgtcttgttgagtacggtggttgtactcagtcttgctcaatttttcccaaacccagaagaggagcccctagaagatgaaggctttggtgtctagctcgtgccagccgtcaagcgcatgtggtcgtcgccctagtcttccgctgcttctcgtttgtctttgtgtgtgctgggccttcgctgcccatgtaataatttaactatttacgcttccgcttgataaactctgaaatgtatcaacttttggtgtaccttgcctcctgggacaaggaataatacacgcacgtaaggaacgcccattgggttaattccggtcgtgacaattttcttgccaaaactcatttttgtttgaatcaacttttaaaatacctctcaattaggtgaaggaacccttttgaacaaacaaaaccaagttttcacaactaactttatagatttttactttttaaccaaaatagaattttgaagactattatagcatcaatttaatcaaaacacatttaagggatgcaaatgatatgagaagttataacactccccctaaatgagataaccaaaacattactcaagatcaaatttgccaatcaattaagcaccattaaaggatagacattatacacaagtaataacctacacaaggttaggatatagaaatttcaatgtaaatacttgt

SEQ ID NO: 23669 - DNA, 1501 bp, Oryza sativa
catcgcttttctttacttgtaccatgttgtatggtttgtattcttggatgtgtattttcctcgaagtcaataaagatgtgctttatttccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagcttgccaaccgccactgggttcgctttcttccttaggacaagatggccaggcaacagctccgtcggtcgaacttttttgttgtaagttgccgatgtgcctgtggcgtatttgcgcatgtgttcaagtgcttcgactctcaccccctccaagagttcgagcgacacttcgcgcccctcttcgcccccagagaacatcacccttggtgatgaaagatctatgtactagaattgccttgtaaggggagattggaatatctatgatcctaagagtgtggtgattgttttggtgattaatgacaacccattgttggaactaactatttccatgagttggtgagattaggttattccggcatcaagttaaaagattgaagctagaagatggacattataccttgatgaggagtaagtgaagacattgatgatgcgggggtatgaaatggctatctatggcaaaccggtgaagagaaagaaaggctcagctagaagatggacattataccttaatgaggagtaagtgaaggcattgatgatgcggagtatgaagtggctatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaa

SEQ ID NO: 23670 - DNA, 1501 bp, Oryza sativa
ctttggtgtctagctcgtgtctgccgtcaagcgcctgtggtcgtcgccctagtcttccactgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagtggtatcagagccacctttgaccctaggacgagccgtagatcccaagccttagcaatattttcaaaaataaaaaaaaatcctgtcttatttgtgaaaatcctctagtctctctctgtcctgttgcttcatttatcgccaaaatctgacctttaaaatgttgtttttctttttgtttttgtttgtagatggccggcagcatcagccgtcgtggtctggacctgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaagagaatctgcagctgaagaaggaactagacgcagtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtattctttctcgtttgtcttcttgttggagtcgtgtggggcatggttatgccggtgtgtggtataactgtgtcggagcctgtctttattttatttgcttaagcaacttgaactttaatgaactaatttaatagcagtaataaattcaagaattatggtagtcgtgggtggttagctttaattgtcagctctctctgtttgctggtcctgtgtggggttttcagatggtgacgaccagga

SEQ ID NO: 23671 - DNA, 1501 bp, Oryza sativa
ccctcggattcgttcggaaactttccccctaacctcgccgacgcatcaatggcggccggatcttccgcgcccgtttccccctcatccggccgctctctccccctcccaaccctatataaacactccccgtgcctccctccgccgtttccgccactcgccgctctctctctccgccggaatcaagctcgcgccgtcgctctctctctccgccgtcaccgccgagctccggtccgccgccgtcgtcgccccggaccttctcccgcttcggcgtcgccttcttcgggttcgccgcaacctcgccgacctcgtccacctctccgtttcggtcgccgactgccggaacgccgccgtgcccgtcgacccgagccgcgccgccgcctctctccgctccggtcgtcgtacccgtcgtcgccgtcgacccggggtgagccgtggaccgccgattcgtttcccccttccctcccctctctcgggcgccgctccgccgcgccggtggtcgccggcggcgaccatcggggcacgagtgcgccacctcccgtcggctgtgccggcgtggccgccttcgggcgcgtcccgcggctgccatgtggggcccggccgttagccgcccgcgccctcggatgcggctgacgcatgggacccacggcgccggccggtgtgagccgggtgcacccggtccaccgtggaccgtgaggctgccgcgtgggccccactcctgtggacccggtccgcgcgcccctcccctcggctgacgcaataaatccaattttaaattaaaatttaaatgaagaaattcacaaatattcatttaaagagcatataaccttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatagttttaggctgggctcggggtgcatggttttgatagtagcacctcggccatataaggaccggt

SEQ ID NO: 23672 - DNA, 375 bp, Oryza sativa
aactaactatttccatgagttggtgagattaggttaagttccgccatcaagttaaaagattgaagttagaagatggacattataccttgatgaggagcaagtgaagacattgatgatgcggggtatgaaatggctatctatggcaaaccggtgaagaaaaagaaaggctcggctagaagatggacattataccttaatgaggaataagtgaagacattgatgatgcggagtatgaagtggctatttatggcaaaacggtgaagggcaagcaaggctcggctacaatggaccatgcgtggggtgaagggcaagcaagaggcttggcaccgattcaccgaatccggtggtgaaggacgagtgaaggctttgtcatga

SEQ ID NO: 23673 - DNA, 1501 bp, Oryza sativa
atcaatcaaacctcagtggaagaaaaagaatccagatagagaagacatttggcttataccccagttgagctgcctgagggagtggagccggagcttcgctagaccgtaattccgctgcagttttcttttcttttttaagtatgtaacattgtattattgatgaatctgtatattaaattgtcagtttgtgtacctcggctgattcctggacgagggttttatgcacaaattagttcggaaattactagtgaatttatgggcgtgacattcaggaagttgagcaagaaatcaatcatcagctaaagaagacgaagccaaagcaggagtggcgtgttaagattcaagttcctgcagccgatgaagccacagccgatgaagcaaaaagattggctaaaggaaaaagtgtggtgactgcatcggttaacatggttttcacgttgcccgctgaatttggagtcaaacaagccgatgttgataaagttgaagaaaaatcggctaaattgattttattaccagaacaagcagtctttgagaagccagaagggatagagaatcggcatcttaagggattatatgtgaacggctatgtcaatgggaagccgatttctaagatgatggtcgatggtggggctgcgttaaatttgatgccttatgctacatttaggaagctaggtagaaatgctgaggatttcatcaagacaaacatggtacttgttggcagtatggcatgaggcccttcgaccaaacctgccgaaaccatgcgaccagtaaggattcaagcctaagacgtcaagatcggttggggcgaagcccccatggcgaagactatggagcaaagacggcgaagggcggagaatcgtgcgggtgcctcgtagagccaaagacctcttaggcgaaggatgtaaggcgaagagtgtatgtcgaagggagacgacttcgccatagcaagttcggcctcacgaaggcccagtggcctttgggccaacgatcgcctgacggaccattaggagcccatgtacctcaattacactgtatacccacataaatgtccctttcataagggcagccatgtaaattcccctgtataacctaaaccccagtagcaagaacttgtaatgaggctataaatattctcctagggtcatgtaatagggggatcccaagaaaaattctccattcaatacactttactttctttccaaccactgttgagtaaccacgtctttcgacgtatgcagttgtcgtttcgaaaacagctggcgccgaccgtggagacctccaagcgaaaccactgagagcgaatgccaccgaagagagtcgtgaaggagaaggttacaaggcgaaaggaaagcgaagccggaggggggatggccgccgaaaagggagcagagccttcggcgcccatcgccgaagatggcggagcgccaccggcttcggcaccagcgccgctactaccgtcttcggctcctgccgcctcgttggggcaggtgccgaacacggc

SEQ ID NO: 23674 - DNA, 951 bp, Oryza sativa
agcacagtggcgctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttttgtgaagaagggcgagcatgtagattgctaagctgacacgtggtggacaagaatgaccgacgtgactggtctgataccagtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaaaatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtaggggctctgcgagggattttctgagctctcgcactctttcgtgtgcgccaagcttttcctgttcagcccaa

SEQ ID NO: 23675 - DNA, 1501 bp, Oryza sativa
ttactcgcacatgcctctgaattgatcgacaagtccacagggtaagtacttctgttaaagtctttcttttttttcccccgcggtgcccactaagcaaagaacaaaaatcacacagactgaaatgacggcgacccgaaatatctttactattaaaattccactgcgcactgtcaccttcctatataaacggccaccctcgccgtgcgacgagagaactcttctcccacgagaccaacgttttctactgtgcacgtgcgtacgttggtttcctcttggagttttacacgaaggaattgaagtgagctaccaaaacatggacgtcgaacagctgcagcagcatgccaggaggcttctgtcgaacggcagggtggtgtcggcggcggcggccgccggcgcgtcgcctggtccggctgggcgcgtgttggaaggcggcgcggcggcggcggcgcgtcgtccggcaccgttcagctcgctggacgcgacggtgatcacggtcctgtccctcctcctctgcgtgctcgtcgtcgggctcgtgctccacgcgatcgcccggtgcgcgttccgcgtcacgcggcgcatgtgctacggccaggagccgcccggggatcacggcgacgaggcggcggcggagcgatgcgcccgggtagccaggaagaagccgggacgcgccatcgcggagaagatcccggcgatcgtctgcccggccggcgggctcgatcggctcgccggctgcggctcgacggagtgcgccatctgcctctccgagttcgcgcagggtcaccgcgtccgcgtgctgccgcgctgcggccacggcttccacgcgcggtgcattgaccgatggctcgccgcgaggcagacctgcccgacgtgcaggcgggagccgtttgcggcggccgcggccgtgcagctgcaggtttaccctgacgccgccggcggccagcacgagacgccttagcaccaacgtgactcaactgtacagtaggctatcacagtagttgggaacacagtgaacatttttttgcttttcttttgtcatccgagatactgtggtcattatctctgttttttttttcttttctgttatgttcatgtcgaagtgacccggttccgatgaaatgaaggtgaaaaccacccgagtaaattttactgaaaactgcaaaaatatgtaccatcaggttgtgatttggttcaggcttgtaaacccatttgcaaatattgcacggagagtgccaacttttgaatcgtctgaattgtttcagacacgatgggagctgcatctggagtgttttttttctactttcgagaggtataatactctactaaaatattatatatacaatagaactgaacaaaaactcaactcaggagtataatatacatactctctctagtcaaatttattttatgttgagtttagttctcccaacgtcaaatatttttactagatcaagtatctcttaatatattctaaatacaaaacaaaaaaaaatccatgaaattg

SEQ ID NO: 23676 - DNA, 525 bp, Oryza sativa
tgatcactttcagcattctccaacggaacaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagtttggttcaaattggaacaatgtgacggaaaagttggaagtttatgtgtgtaggaaagttttgatgtgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgta

SEQ ID NO: 23677 - DNA, 1501 bp, Oryza sativa
gcgggagccgtttgcggcggccgcggccgtgcagctgcaggtttaccctgacgccgccggcggccagcacgagacgccttagcaccaacgtgactcaactgtacagtaggctatcacagtagttgggaacacagtgaacatttttttgcttttcttttgtcatccgagatactgtggtcattatctctgttttttttttcttttctgttatgttcatgtcgaagtgacccggttccgatgaaatgaaggtgaaaaccacccgagtaaattttactgaaaactgcaaaaatatgtaccatcaggttgtgatttggttcaggcttgtaaacccatttgcaaatattgcacggagagtgccaacttttgaatcgtctgaattgtttcagacacgatgggagctgcatctggagtgttttttttctactttcgagaggtataatactctactaaaatattatatatacaatagaactgaacaaaaactcaactcaggagtataatatacatactctctctagtcaaatttattttatgttgagtttagttctcccaacgtcaaatatttttactagatcaagtatctcttaatatattctaaatacaaaacaaaaaaaaatccatgaaattgacgatatattgtgtgatctgttccacaatgaaatgggcaacaggcccattgagtaaattcggcccacggacgtactccaggagtgccagcctgctacaacactagtctgacgttgtgactctacattgtactgtacatacgagtattggtatagtagtagcagaattagaaaaagaggaatcggcctacggtgtatctcgtactataaaagatggatgtttgtgttgtggatttgtggtggcgtgtatctccctcgtagtctgaaaaagttaactaagaacgcatatttgctaaccacgggtaattccagattcccttgctactggttaagaatcgttttgacttgtacggggttgctgaattttctttgccgatgagttatagatgatgacggccgactgatgaattggtgacttcctgaagttcaaagcaggtacgctgaataatgcgatgcttatcgctgtttctgaagacatcattttcccctctgtctcactgcaaagtgaatcacaataccatgtgccatattcgattgtttgctgcaaaatgaaccttccggggaggaaatctagtcaatttatgaatagtttagcgcaataattagctgaaatggggaggcatgaagcacgctttttgactgcaagtcggttacatcttcattccgtcttccccccggccgtccagagtgggagctgcagctaccactgccacaaacctttccgcctcactgaattattggctcacgtaatgggttctcctgaggccttccactactggaagctgcaaagcactgtactatagctagcgtgtgcctcgttaattatacttttctgttgccaataatgcagccactattgcccagaacaactgaca

SEQ ID NO: 23678 - DNA, 444 bp, Oryza sativa
attatgtgtggtgcgtttgtaggaatacctgaatctgcagtcaagggtgagcgccaaaaaatgcgcacgtggtggtggcgggggtggcaaaaccgcgtcatctttcctcaaatccagtaccactacattgctgcacaatctcaaccaggcggagaagtcgtcttatgtggcgcacatcaacacctaccttcgtgaagacccgtttctgaagaagtatttaccaatcgagcctaccgacaaccagctgttcgatcttgtcagggacggtgttatgctatggtgagagatggtctttacagctaaccaaagggtgcatatccatttactcgttgaacagaaactgcccttgagtcatagctgatatttgctcatttatggatcatttgctcagtaaattgatcaatttagctgtacctgggaccattgatgagagagcaataaata

SEQ ID NO: 23679 - DNA, 1475 bp, Oryza sativa
aactttacatccttatgcactctaggcgtcatacgtttctaacagtgagaggagttctggcgctcccgggaagggaaaaacacacacactcctacgttgcttcttgttgttgaacccagtccatcatgattgttctcttatgggtatcctcatgtagtattgccaagccagcctctgaccatccgaaacgggcatccgccatccacctggccatccgaaccgggcatccgccagcagactgcttgccacatcacacacctaaaagaagaccactacgcatggatactgcctccgctcagctatctactccactaggtctatacccatatgagaagtgcggttgtacgggggtcgtttcatgcttaacttcatggctcggtccttaattgaccagggacagcactagcattttccggataccacccaaatcctccagccaccctagtcgaaaacagttctttaactttattttcctttcacaaatcatgccaccaatatcatggcaatgtggcgctcatgtctccacatgccacatctcaattaccttcccaaaggtaattgcccaagcatatagcatttgataaatatgagtatgcatgattctagaatagcatttctaagcaattgtcataattgactagagacttatacgtaaacatggtaaacaataattaaggcatggcataatcacaagtaggatgttcatcattgcatgcaattttatttgtaaacaaaataatttcgcaattgggatcaacatgttcaaagaatagtaatgacttgccttgctcaaagtcttgcggatctcgaccttcgcttggatccgcaactccctcgggctctataattacgtgcgaaggaataatttgaattcaattagaatccaaatgaaatccaaataattcacacaaacatcgaacgcgaaacaccctttctaaattgacaacaaagttcgcggaatcgctcaattcgaattgttgggtcattttaacctaagtcattttgtgatttgaaattacgtcctaagaattcatctaattgtttagttcttaattacatttaaattactaccgcgaattgattacttaaagagattaccaaaaataatctataagaattcatctaattgtttagttattaattacatctaaattactaccgcgaattgatttcttatagaaattagaatagtctataataatctatgattatagtattattttgcaaatactacactttagttaatcctataattaattcctaatattttaaatatcctaaatctcctcctaatttcctatttattttccttttctttttctccctttctttttctttttccttcctttctttttcttttctttttccttttttctctcttctctcttttctctctcccggctcctttctcccttcctctcttcttttctctttctccctccctctctcttggctttttgccctcccggcggcga

SEQ ID NO: 23680 - DNA, 1501 bp, Oryza sativa
aaatgaattataaacacgaagttttcttaggtaaaggccatgaacaaaatattgatctctatctgaaataaacacctgttcagtacaggagcattgctcgcctggaagctggagccaatcaagaactgtggcatcgctttgaaagcaaaatgaccttggacgtcagggtgtcaggtgttgcccggttgagttactactggctgtcctaggtgtttaaacatccagaaacatggaaacaaaaatcccatcatggtaaaagtaaaccgcttccctagggctagggatccttctgtctttgcttttttaatctggaaaatggcaagaagccaagaacacacactctctctcagtatttttcaacggttggtaagctgtaaataaaagcataaacaaacagcaaatgactcctcagtagtagtactagtacaggagtagcagtactcccttcgtcccataataagtgcagttttgcactattcaccgttcgtcttgtttgaaaaaaatttatgattagtatttttattgctattagatgataaaatatgaatagtactttatgtgtaacaaaattttttaaattttttcataaatttttcaaataagatggatattcacgactacacttattttgaaacgtaggtagtattaaaaaagcttcatgagaagaaccaaatctctctctctctctcacacacacaaaccccagccagtgcagctgctgctgctaccccagaagctattggagcccaaccatccagaactcccagaccccagagcactagttgttcatttgtagagccctgagtcctctcctgcttcctgaacaccacatcccaatctttgctgaaacctcccgatccgcgggtacttctggcatcgcaaaccgaatattaccgccgatccattggatacccagcgtttcttttcctgtagcacctgcgaaaaattccatcttttttggctaccaaacatgaagaaatgggatgcatgatgctgcttggagtggacgccagctatatggaaggtgagtttcttgcttgtcatccgtggaaagaatggttccgatattgaatcggtccttgttttatgtttcttgttctctatcgaaaaaaaaaatccttttgttaaacttatcttgatagatgcgtattgcttgctgttttgtatagttttcatctggatatttatgttgcttgatctggatttgcaacttctttattgatatggatctcaatagacctcaaactttattgcttctgcaccccaagaacccatttcatcatgaactagttagatgtaacagcatgttgttcttggtattacgactgcagatttctagcctatcttcttgattggattgtcgccatcgcgaggtatctcggtgaaatattgagtactttccttccaaatagcaactagagaaaaacatagagcaacttcagtagagcctgcagcttcagtgattgtctgaataaatcttgtcactgctaagttggataga

SEQ ID NO: 23681 - DNA, 315 bp, Oryza sativa
aaaagatatctaagaattgtttagtattgcaagttgcatctcatcccagctcgcgaagaacaaaatagaagaaaacaactcagaaagaagatttttcctacttgattgagaaggcagaaccatactatagcacgtgtttgaccaattaaataattaattatatagttgtgtttgaccaattaattataacaagttcaatataaagataaccaagtagggtgtggaagctactatatttagagaaataagagacgaagatgtccattgcatatacatttcatcagcactgaaactgtagcatatcgaacccaacta

SEQ ID NO: 23682 - DNA, 396 bp, Oryza sativa
acccataaagttaggattatacgagacatacacctactccaatacaacaaaataccgaagactaattaatacatggtcctccacaataattagcagcatttctcttaacctctgcttgatgcaactgtggtgcacttttagttcgttcaacggagcattattattggtcaatagtgaatggatcgatatgcgaaacttgaacggcaatttacatcgtttctggatatgttttctagcttgtacgaagtggtcactggacaaatttacaactatctgcatgtttcattttcatgacatcaaactgatttccgtttccctaaaccatatattcatatcactactcactgattacagattagagaggttaataattgtatattcctattcgcccccaga

SEQ ID NO: 23683 - DNA, 463 bp, Oryza sativa
ggcgccaaaggtccgtgtggtggagaaagaagttaccccagccctagcgaatcctccggtcgtcaacgtaagtgatgatgaaggagaagaatccaagcgcacccattccaagatcgagtggggagcaactcaagatgatgaagacgagccgaacgagccttcaatcaactccgatgcccggaagaactagaatgccttgtcaaacagttgtcttagatcgttgtgttagtttgcttgttttaagtttggttgtgtgtgtctcgcatgtgatttacatcagtggtgggatgtaagtccatgcgtttgtttgctttcgagtgttaggtagttggtgagtttagtggtgtgagagtctttagttttgtaataatgaaactcacttaagatcaataaaagttaaattaattctctgtcctaagtagtttttcccggtttctcttcttgtgatcctgcccatgccaga

SEQ ID NO: 23684 - DNA, 312 bp, Oryza sativa
tgagcgattttcggtcagcaaacggttttgtgaaccttatgcatctgagaactgagggagtggttgtatttgctgcgttttcgattattttttttaaagaaaaaattgctgctgctgttgctgctctctctatctcttatctctctctcaaataagagcagtgtgcagcgtacgtcttgcaaaaaatgagagcagtgtgcagtgtacgtcttgcgaaaagatgcctttagcccctacataaataaatacgcatacagggccagccatcagatgctttggagggctccatgccatttctgctctttcttaaga

SEQ ID NO: 23685 - DNA, 219 bp, Oryza sativa
gtatcagttttactaaaggggtagtactcagacatctcacgaactgttaactttgtttttacctctgcatatcaatcaatggttatctacgaagccagcatgtaatgatcgtatttgtaatagtcttgtctttatttcaccaatcaattagtaattttatagttcagtatattggctagaaagactcatgtctgttaatctggaaatgcccaattggca

SEQ ID NO: 23686 - DNA, 1501 bp, Oryza sativa
aacatcctcaaaatgtcctttaaatggtaccaagaaaaaaaggtagccacatacatttacttctagcatattgtacattaatctttatagatcatttaacttgttttacattttttaggaaaaatcgtgccaaacaaggaagaccactaggttcaactagtgatgcagcgggttctagcacacccaaaagacaaaaggttgcaatcaatgattccagcaatatgagtcctgggcttgtcactagaaggtatgatttttctttagttcaatggtatgattgattctcaaaattttactaacactcagttcattgaaggcaattggcattgactaatgttgttggagaaggatcgagtcaaatggcaacccctccgaggccctactagagctgcaaggaagatcactccaaagaaagggaaaaaatgaatgcttttctaaatataatatttagtgttctggatgcttttgtaatgtgaaacatgggacaaagctggttgatttcattttgttctctcaacttgccaaatggttatgtaatctggatgatgttctcaagtttgctattgaacttgtttgttctgaaatgattttatatgcattatgggtacatgctgccattttttttatctgtgaccaaattatgggtactttcttgacttgtgtcaaatgctatacaaattgcaaggtacatgctgccaaaatttagggtacattctgtcaaaattttgcttacaagctgtcaaaattttggcatccggagcaaccgtttatgtatacacatatatactatacatgcagcaatatatgcaacagttatatgccactatcctgctcagagaagaggaacagcagggcagcaggcgtactcctgatgccattttgttctctctggcgagaagaggcaagggcagggcaaccggcgcacagcagcagataaaaccccatctccctctctcttttacctgacaggtggagccaggggtaaaacagtccaaagaaaagggaaaaacagaaaacgaaaaaaaaaagaaaaaatgacgggaatgagagaaagtggtatgaaatcaaaaaattagcactcctagtgatgtattagagaagacatgcggattgcaatggcgcgcgtatttagtggtttattatcaaaaatctctccctgggacggagcgaccgggggcacgagaggaaaagatatctaagaattgtttagtattgcaagttgcatctcatcccagctcgcgaagaacaaaatagaagaaaacaactcagaaagaagatttttcctacttgattgagaaggcagaaccatactatagcacgtgtttgaccaattaaataattaattatatagttgtgtttgaccaattaattataacaagttcaatataaagataaccaagtagggtgtggaagctactatatttagagaaataagagacgaagatgtccattgcatatacatttcatcagcactgaaactgtagcatatcgaacccaacta

SEQ ID NO: 23687 - DNA, 461 bp, Oryza sativa
aattttcaaccaaacttccaacttcacagtgaactaaacacagccataatcgcattccaccattcctattcgcgaccagaccacctggaccatgcgtagcgtagctccctgccatcctgccactgttgagtaccttgcagcaggcaagcagccaatctggcaatgcctctgtctgagcacatccatccgattcaacctcgactacttgtttcgcatggatccagatttttacttgtttggcatggatggatccagaatttttacttttagccgacgacgacgagacgggtcgagatcgatctcgtggtactacagtaattttgaggccgggaggcgctgtgctgccgatcaaaccaaaaaaaagaaaaaaaaacggagtcaaaccaggcaaccaacccggcaagcgcggcgtctctcgcccgtgtgtgcgtgtctcgggcgtgatgcgagccgcgttgtga

SEQ ID NO: 23688 - DNA, 260 bp, Oryza sativa
cctggtcaaggtaaaagttatcatgatgataatatttgcatgtttttcatatgttgctgatccaagcttacttatcttaataccatgcagctgagactaaagttgcacctgttacaccccaagttgaggatcttcttgatggtttgtcctcaagcacatctctttctggtcagatcctactgccttactattatctaacattatggagcactacaaatgattatgatatttactgttgctatgcttgcttgctcaccaga

SEQ ID NO: 23689 - DNA, 1083 bp, Oryza sativa
ttgtgtatgagcgtcttctctcttaccgacttcgatcagtcagtttgtagagtcatacactctccctagcccccagccttctcgttggagaatcgttctcggaggataaggctcttggacccttgacctgccttggttgaacaagcactgatcctagccccgagccgtgaagttggaaaactcaatttccgattacacggcttggttaatacgcacggcgagaactcttacacgaccagatcttacatggtcttttgtctctacaggatctgacaaggccttatcggctctgggcgttcccagccgaagatcccttaggttcctcggaggccttgtcaagacggcgtaaagggacaatagcataggtttcaacgctaggtgtcgtcgtggtaagggatctctgggtaaaacacttggcattattgtgtacctgatatcaactttgttgaggtagaggtagtgggagaatcgctacacctctggtcgaggaccaggtagtagtcgtaactcgaccacttgaagtggaaatagtgggagaatcgctacaccgttggtcgagaaccaggtagtagtcataactcgaccactagaagtaaatgtacgagagatcgctacgattaactggttgagaaccagtaagtagatgtctctcgatcatttggagtcgtggtacgaggaccgctacgctgccggtcgaagaccagtcatagttgttcctcaaccatctgaagtcatggtgtgagggccgctacgctgccggtcgaagaccagtcgtagttgttcctcaaccatccgaagtcatggtgcgaggaccgctacgctattgctgtagtcgtacctcgaccatctgaagttaaggtgcgagagattgctactttttactagttcgagaaccagcgagcgagtagaattatctctcgaacaccaatggaaggtgcgattgcgagagattgctacatactggtttgggaaccagcgagcgagtagaattatctctcgaacaccaatggaagctgcggtgcgagagattgctacgtactggttcgggaaccagcgagcgagtagaattatctctcgaacacc

SEQ ID NO: 23690 - DNA, 171 bp, Oryza sativa
gtaaatatttatgacgttacctaactttttttatactaggttttatcaactgtgatcaatatttatttttagaagtatgccctttttttccacgcaatgtaaacatttctggctgatggaattttgcattctcattggaatttcgctgctggaaatttgctttctgattgg

SEQ ID NO: 23691 - DNA, 1501 bp, Oryza sativa
attattaaattatttttaaatgttgcacgatattccaccaggtatatcggaattgtttcactaagtagatcgaaaatgtttcactcgtttaaatcaggtgttgtttcaccttatataaaaacaatgttttaacaaatagtgaaagaatgtttcagttcactgcaacattagatctatacatagtgaaacattgtgagtagactatgtgaaacattttttggtggaacaacaaataaaccaaattcccttaatagggggtttccaaaatttgtggtttttttgttgcaatgaaatgcttcgttcactgcaacattagatctatacatagtgaaacattgtgagtacactaggtaaaacatttttggtcgaacaaaaaataaaccaaattccctttgtagagagtttccaaaatatgtgggtttttttttgcaaaagaatattttaattcactgcaatattagatctacaaatagggaaacattgtaagtacactaggtgaaacatcttttgtggaaaaaatgggagggagaagtaggtgggtccagcagatacgcacatggggagaggggcgcgcgtagggagcgcccgatccggctcccccgcgccggtcacccggagtagagcattatcgaaaagattcgtccatgcatatgtccaatcggacatcacatgtatataacatgatttatctattatatactaaaagtccattaaatttcctgtcagggttatggataccacatacctactagtagtcgactacatctcggcaagacccaccacataccatgtcttatacggaactgacttcggatatggagggagttccagataaggaaagacaaccaaagttctacatggaaacgacaagtactcagattgtatccatattggtttccctagttctatttggacaaggggacacctatgggtataaatataaggccccctaggaggagaggggacacgaccacctcaatcaacacccaccacaatctacggaacaacagaagccacaacatacaagcctacatacggcaagacaagacgccggatatcgacttcagggataagcacggctagtctcctatggtgtctccggatactatcaggagagacgaaagcattatctctgatctcgctgggtacatattcgaggaggaagactaccctattgtcgactacgagtcagaccttcagaccgccatgtcgacaatagttagataggttacctcacatattgtactggtgtgattatggtgaataagagcaatatcggctccggccaacaggatgtagggttattacctgacaattcaggggcccgaacctgtataaaaatcctcgtctccgtctcttttacctcagtctcgcgtatatcctagtaccaatgatccccataccatgcaaataccggaatcgcgacatcaaacgtcgacagtggcgcgccaggtagggggactttggtgcttcaggatttcaacgagatgggttcaataga

SEQ ID NO: 23692 - DNA, 349 bp, Oryza sativa
gggttcatttggtgtgcagctaatcccatcggtctcatgggctgaatcggagtgtttgaaaacattgaaccgtttacaaaattggctacaccaggagcaccaccatattgctcccaatttgtgttactgctaggattcaacatttgagaattgcttgccaaccctgggtcactactaccatgtagttgatgtgaccatgcataagctgtagattcattgtttggcatttcattcgtcattgccgagagttgatcagttgaaaaaggttttttgggggggtttttttttttttggacaaggggaagcctttggaaacttgacaccaaaagagggttgcatcctggctcca

SEQ ID NO: 23693 - DNA, 577 bp, Oryza sativa
ggttggatcaagaatgtgctaattctgctcgtttcttttgatcaccatacttgtcaactcctgacgagctgcttagctgcaattcgaggcaaatttcagaatcttaaacgaactcgaaccaaaacacaaacaccaaaaaaagctctgattcttttattcttcagaaaaggagtaactgttttgtcaaaggaaaatgcgcccgttgcaaacaaacccaaagctgactgctaatatctcgggccagcccacttcacgattatctgtcctgaaaagtttcggcccagtcacctatagccgcctataagcccactagtccctgcaacgtctaacatatctcccttctccgctaatcaaaatcaaacccatccaacgtgctgtaaaacgttagtagtaaaacgattttgctatatatttattaaaaatctgttaaatgtaaatacaatataattgtgtagtataattatatgtaactataatgctcataatttttatatatgtaactttcatataattttaaacggtaagatttatttcaagatttgtgtaagttgggatgaaaaaaataatagtgtgcgca

SEQ ID NO: 23694 - DNA, 608 bp, Oryza sativa
attcctgcagccctgagcaagaaagagcctgcatagaatctactacagagttcatcagtgtatgcaaagaaattaacttctcagaaaactactgattgtggtgaaaggataacaataggattgtatccacttgaactgatagctagatcgaatagtgcaaatcaagccatagtgaaagaaaatgatgtacattcagattcagataatccacatagaggactattgggctgaagaagggaatcggaagactcactttcagctgaagcactctacactctgcactctcacctgcaaaagagaggatggcacacgtccgtgagaaccgagtgcgtggtgtgggcagactatgaaccttacaacggcggcaccactggaggcgcggcagagtgccgttggaaggcaggaccacagggccgtgacgggatggtgatacgagccgaaaggcatattcacgggggagtcgactgtgtgcggcagcggagacaggcttcatgacatacagatccacggcgccggcgagggcagggcgcggtggtgtgtggcggcggtagggaggagcggagcgaggagcgcgcggcggagtcagctccgttgggggcaggccacga

SEQ ID NO: 23695 - DNA, 1127 bp, Oryza sativa
tatctccccgcaatattttaaaagaagaaatagataaataagtaaatattcatatgatatacattttgaaagaaaatcatgctaaaattagaagtcacaaagttgcagaggggcgataaagtactaaacacatatcggataaatatttatgcatacctagaatttgttggcaacaaactgctccaataaagttttaatatataatacttcatttagcaaagcgaagaacagggagactaaccaggatactacaccttagtttaacttagtagacagagcatcaaagaatgccttcatcggccattgcactgtccttttgggaactccaagagtataatattatccttcttcaattcatatccatgcaaacaacaaagatctcaattcttcagttcatatccatgcaaacaacaaagacctcaattttaatgaaatggttagctgcttgctcatcttgtccctgcaaatagtttacgaagttcatccctttatgtccagggagaggcattagacaatatacaaaatgtacttcaaggtattgctttagatcgattgcagcactgaaacacaataaaactggttttgcttcaatgataacattggtgcaatattagacagtactgatgctccctgcgtataccaaagaagctccctgtgtggtccattgaattaggatgcagagaagagatggttgacctgaattgcaagaaaggggtagtaaagggtgcttgggattactaacctgatttagggatgaaccttgtttgataattgctgttgtctacacgctcgtgaaatcatctgaaaatcagcggtagcaggattgtgaaacgccagatgtggccgatggcaagctcctactgggattgcaacgccatgaggggatacgatgccttcgcaccacggctgcaaatccattgataggggctgcacaggatcaactgaaaggatgcaaatccattgatatgttaaaatcttcaaactctacggccaatttctgattggcaattgtgaatgatcaagaaaacaaatggtgatccacaaattgacacatcacaaaaacatgtaaaataggagaaattggtattaccttagggttcagggggaacagtgttggttcctttagt

SEQ ID NO: 23696 - DNA, 275 bp, Oryza sativa
ctattttatggttgccggctgagtactggaatttcgttagaagaacttctaagtttaaaatatggtgcaaaacaaagctggcaagtggcaacaaccgtagactccaagtcttggagtgcaatgcgtagccaaccagacaatcaccgacgcatgggtagatcagcatctggacggacttgctagtgcttctcagcttagcaacgacgcgtgtaaattgcggccatatagcctatagcaacatgcgaactaccgcttgcgtttgcgtggacaaaaaa

SEQ ID NO: 23697 - DNA, 490 bp, Oryza sativa
agattttgggtgaatcttctaggaagcttactaaagacctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgttcaaccttaatcagtctccatcgaaccgctggtatataaatagtacattggaaaaggcaaatctcagtgggattttgagatttggtgggggattgttggaattaatagatgggctaaggcccattcgaagattaattctatggaaaatcacaaaagcccacctcatgggatggcatgcatgtggagtttagtaccgccttgcttattccaggagagggggacctccttaaaagggaggatgccctcctagccacttgaagcatgtgtggtggagagaagaggggaaacaca

SEQ ID NO: 23698 - DNA, 241 bp, Oryza sativa
ggacttcttaactgagaaagaatcatgggaactttgcaaattcaaagcaggagttcctgacatatctggaacagaaaccgtggaaggaaaaatagcgaaaagatgtggccgtttacctcttgcactagatgtaatcgggacagtcctgtgtggaaaggacaagaggtactgggagtgtgcattgtcagagcttggagttcctaccctcttgagaaggccgaagtgttgcaaaagatataca

SEQ ID NO: 23699 - DNA, 194 bp, Oryza sativa
aaaatttgctatattttgggatggagggagtattcgtttcagttaccggcaattgaaaaccaattcaacaatttatctctgaaaaataaatgcgagtgcttttggagtttaatctctttttgtcaactacagaatgcagctgtgtgcatgaagcttatctgcatttatgtgttttctctctttttctttgcaga

SEQ ID NO: 23700 - DNA, 913 bp, Oryza sativa
ttttggtcttgcaatcccttgccaaaaaatttcaacccacagaaaagatggtaggaactcttccctaagggagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtaacctgccttcggccggcgtcgtagttgcgtttcacggccgt

SEQ ID NO: 23701 - DNA, 683 bp, Oryza sativa
tcatagaaaccggccccttttcccaccctcacatgataaaaaaagtagaaccaacacatatagtatcagtataggtgtcggttgtacttaaaaaaccgacacctataatatagatgccggttttttaatagaatcggcacctttgaaaaaaaccgagccggtctctttttaccacccatagcacatccttatccaccccaccaatactatcgacatccttatccatccaccacactgcgccagccatccctctctctccctctctgatttctcttgcccctcctctcacattgcgcccgacgatgacagagttgcggcggcggccaacggagaagctaggatggcgcggaggtcctcgccaacccgggggcccttcccccttctctcctcctccagggcggctcagcggtggagaaggccggccgatgcggacgaggaggcggctcggtggagaaggctagccggggcagcggctgacggctggaggaggctcgcccctctcgccctcctctgctcgtgctcgcggcggcgcaggtgaggtagaggctggcgcggagcgcctcgccccccttcccttctcgtcctgcacggcgtggggttgcggccgacgcggcgaggtagtggcgtggtcgctggatctcgccgaccccccctctcccgggggacctcccccctcctccagc

SEQ ID NO: 23702 - DNA, 973 bp, Oryza sativa
tctagaaaatctacgattcaaaatgtgatgtgaaattttcttttcatagtggtccttcaatgtttaccagattggcacgttttttctttttccaagactgatttatctgctactgacgttttatttcattccaggtattttctctgaccttgtctgaagctcacagggtggtaatagaatgtgaatttttcacagggcttgttacaagctggagttttcaccaatggagtttaactgacgagagtcttctgcttctgaattggattattgcttgtattttttgatactacatgagtttttcaacccgtaaattgaattagcaaggcacagtcttctgcttctaaagtggatgactgcttgtactatcttgttactaaccctttgtgttcaagctgttgatgcccacaagaagacttcgtaaaggactgcatttttaccattccttgaatttgaaatttggtagtttcttaataggtttaggtacaatttggtcaagttttttccttccttttcagttggagaaataggttcaaccattaaagttttgcacgttaaagagttctcactcagtgacattcacaagtagtcctagaaaagcagaaacttcttagcctaatgaaacaatagtattaatgcagtaccttttgctttatttctttgtagacactttttatgaagtttccgttatgctctttagttatatgaactttagaaagatgtaagttaatctctataactctgcatggttaactgatatccatgtatgatgcttaccagtcataatgctttcaatttatggatttgtgctgtttatgcacaaattttgttgatttcatcctttatttgtatttcattgtgtactatttactctaatgcaaaggaatttgatggagaagtctttttgtttcatttttccagaactcacaacagaggtccaaatttgttaagacaggtttagacggtttaggtaaca

SEQ ID NO: 23703 - DNA, 317 bp, Oryza sativa
attataggtgtcggttttttaagtacaaccgacacctatactgatactatatgtgttggttctactttttttatcatgtgagggtgggaaaaggggccggtttctatgatggttttttagtagtgagtcaacgatagcacggaatggtgatggttgaatgcaataaaatctccgaaggaatggaagtatggaactgagactccaatagaattctgccgaaaacttcgaatgaaattctaaattaaaatatgtaatttcagccatattctattttgccagtagcagtattatacgtcggtctacatgtacgaggaaaa

SEQ ID NO: 23704 - DNA, 271 bp, Oryza sativa
tctagaaaatctacgattcaaaatgtgatgtgaaattttcttttcatagtggtccttcaatgtttaccagattggcacgttttttctttttccaagactgatttatctgctactgacgttttatttcattccaggtattttctctgaccttgtctgaagctcacagggtggtaatagaatgtgaatttttcacagggcttgttacaagctggagttttcaccaatggagtttaactgacgagagtcttctgcttctgaattggattattgc

SEQ ID NO: 23705 - DNA, 1501 bp, Oryza sativa
gacttgtagggacatgctattgagttcccttccttgacgtgtgtatccgggctcctgtgaatgcacggtctagcggtcccgcattgtagccagccatcagggtattgcttgtgggcgggtaatcgctttcccgatctcctcctagcgatcacccgtccctcccccctatacgctcttcctctcccccttcctcctccccttcttctcttcctactacaatacaccataatttttttttaaaaaaaaacaaagttggaaaatttatgtatagaaatactatatataaaaaatttaaattcaaattcaaatttgaaactggtatgtaaacttttaacttataaactttgggtctataaactaatatttgaattcaaattcaaatttgaatcgggtatgtaaacttttaacttataaactttgggtcaataaactttaggtatataaactttagatgtataaaaatactatatataaaaaatatttgaattcaaattcaaatttgaatcggatgtaattcaaattcaaattgaatcgggtatgtaaacttttgacttataaactttgggtctataaactttaggtgtataaactttagatgtatagaaatactatatataaaaaatatttgaattcaacttcaaatttgaatcggatatataaacttttgacttataaactttgggtctataaactttaggtgtataaactttagatgtatagtaatactatatataaaaaatatttgaattcaaatttaaatttaaattgtatatataaacttttgatttataaactttgggtctctaaactttagatgtgtaaacttgaggtgtacaaactttaggtgcataaatttactaaaataggaaagtaatgcggtgtcaaaaaagaaaaccatgtggaggagaggggggcgtgctaggggcgatcgatcgcccgttagcaatctcgcagccgtcatgcctatgtcctgattctatttgtattaattggtttgtataaattgattatagagataagacaagtgctaggctatatattgtaacattgatctctcaatcaatatcaatgcgatgaatatctcgctaacaatacccatagtgtcgaacctagtagatataatgactgctcccctattaatggttgtttctgcctttattgacttgacctcgctgatgtctttgccctctagatatatgtagggaataaaagcagagcagatttagataagtagtggttataccaaatcctataccatattttaaagcggatttagattaggtgtagatgatgtgaatatgcggatgcagagcgaataattccggatgttggaaatggtgccaagtcgattagaacttagctcggaaatagattaaaattgtcggatgttgcgtatatatgcaatcaaatacaacatcaaattgcttatcgtcatcaccacattggatctcacatcatcactaggttggaacctacactatagatgggccgggccgggcaa

SEQ ID NO: 23706 - DNA, 246 bp, Oryza sativa
  unsure (1)..(246): unsure at all n locations
gatttagnaccctgagtaacgccttgcagncgactctagaggatccnctggtgttctgctattctttcacagtgatatcatccatcattattgctgttgtaatttcaacaaaaaactacatggtccatgccatttatgttgcagcatgtttcagtgattgcttttagtatagtacaatacctgtagtacaaaagatcctttttatagcaagataatggtatgctaatattttcccccaactttagc

SEQ ID NO: 23707 - DNA, 476 bp, Oryza sativa
ttcttacccgacccactgggatgtgggccaggatcgtgggtggggcccagtttcatcgactagggcaaatgtggtcgatgtggtgttgcagtgtagcagctgtcaggtgggagagacgcttgcgtggcgattaatccctttcacaagattccaattctcttgagatgatttattttacacataatcctcctcaatctcttcaaatccttttctcctcggggattaaccaaacaaagtctggagagtgtcctaacggtgcaataaacatgcgacaactgaaggtgttctcagtgcagattgttataattttgggtccaatttgatgaaattactcctacctagcaagatttgattgtgttttgtaattatgcaactaaagttgctatccatctcaaaagcaaatgcttgtcagttttgcagctcgtgcaactttagcaataataataataataataatactaataaaattacatagg

SEQ ID NO: 23708 - DNA, 1501 bp, Oryza sativa
agcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgaatggtcaacaacgcaagcaactaactaacaaactaacaatagagtcataacatgcaatgcaaataatgtatggatcaacctgattaattgggtcgtcgttccattcccagccgatcgatcgcttcaaccattcgatatatatagctgccctaagcaggatcggttattt

SEQ ID NO: 23709 - DNA, 1501 bp, Oryza sativa
gcgcctccttggtgacgtcctccttcagcgacgccgctgcttgatgatccacgagcggcccgatgatatcagtcagagggagagcctacacttcatgaagtcacaatgcgatccccgaagaaaaatgcgaaagggccgccgagtacacttacattgatggcagcttcgtgttcggctgcccccttctcgcaaagggggacggggactttgctcgccgttgtcgggccgctgatcatcaattggccgacgcggcgctccacggtttcgctgttcaaacatgtagatcgagaaccagaattcgataagtcaggaggaacacgcacataaggaagtcaatttaaatacaagaaaaataccccgaggagaaacccgggttgcgtcctccggcccagaatagtcaaaggctgggtgggctcgagcctggagcggcttgatccgcctaccaatgaagtcgacagcgacttcataccctgacaaacctcgtactcggaggtcatcgatggcattgatgaaggactgaagagaaggggttaaggcgggttttgcggtccgagacgaaatcttgtctggttgttcctcaggaacaacgaagactgaatccgaattttctatctgaagatagaaccacctcgcccgccatttgctacgagaagaagggcactggaaaaggatatagcgcgacttcaggccatcccggagtcggaaaccgacgcatccagataccttgttggattccatccaacgcaactcgtagtagaaacgaaagaggtcaagaaacggctctaccccaatgtaggcctcacaaagatgcgaaaaaatactgaggaaggcgatggaattggggttcaaatggagcaaagaaaggccgtagaagttcaagaccaagagaagaaaaccacagagaatatagtcctcgatcgcaaccatgcgacccaggacaggctggggttcaatacctcctgcttctctctccatggtcccgcgaccgggaagggtgccatcctcctgtagtttcttcagcgacgcgctggtggaggtagacttgtcgaggtctattgccgccggggatcgccggagaaaggaccgagatgagctagctagggtttttgcgggagcggagaagacgaggtacgcttggaggctggagagttttttcacaacaggcggacttcaaaatggatccccaaaactcccttaaatagtcgcacttccgatggtgcggattccaaggaaaggagagagatggccgccggaaatttctgggtccgttacgcgcggcagtttttcggactttaatttaaattcactcatgactgttgagtttcacttggcgttgtcaattactccttgtctctcggtcctcacaccgagaacgacaacaacctcaacatcagaagtcacgatcggttacacgagttcagttatgcagaagtcgggggctactgtcagggttacgggtaaggtataccctctaccctacgatatacgtcacatatcgata

SEQ ID NO: 23710 - DNA, 1501 bp, Oryza sativa
ggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaatagacctcgacaagtctacctccaccagcgcgtcgctgaagaaactacaggaggatggcacccttcccggtcgcgggaccatggagagagaagcaggaggtattgaaccccagcctgtcctgggtcgcatggttgcgatcgaggactatattctctgtggttttcttctcttggtcttgaacttctacggcctttctttgctccatttgaaccccaattccatcgccttcctcagtattttttcgcatctttgtgaggcctacattggggtagagccgtttcttgacctctttcgtttctactacgagttgcgttggatggaatccaacaaggtatctggatgcgtcggtttccgactccgggatggcctgaagtcgcgctatatccttttccagtgcccttcttctcgtagcaaatggcgggcgaggtggttctatcttcagatagaaaattcggattcagtcttcgttgttcctgaggaacaaccagacaagatttcgtctcggaccgcaaaacccgccttaaccccttctcttcagtccttcatcaatgccatcgatgacctccgagtacgaggtttgtcagggtatgaagtcgctgtcgacttcattggtaggcggatcaagccgctccaggctcgagcccacccagcctttgactattctgggccggaggacgcaacccgggtttctcctcggggtatttttcttgtatttaaattgacttccttatgtgcgtgttcctcctgacttatcgaattctggttctcgatctacatgtttgaacagcgaaaccgtggagcgccgcgtcggccaattgatgatcagcggcccgacaacggcgagcaaagtccccgtccccctttgcgagaagggggcagccgaacacgaagctgccatcaatgtaa

SEQ ID NO: 23711 - DNA, 1501 bp, Oryza sativa
gtcacctcggaagtcatcctcgccggctcgtgattcttgtcggaaagacaaggtttggccgcactaggatccttctcgggctcggatgtcgtcgacgttccgttctccgcttcggcgggaggatccttcgacatggagtcgtcttgggttctagccactgcgttcttgcttccggtcattgatggaccagacgagatcggcaccgtggtgtaaaccgggaagacgatttcgccgacttgagtccacaccagcattgttgaagcaggaactcctttgttgaggttggtgttgacgctgttgtcgacgaagctggatgacatagtagtagaaccttgagcaccaagtccccctacctggcgtgccactatcgacgggggatacccgtagaccggatatagagggtactggggtacgctggtacgaggatctacgtaatacgacatcaagcagacaaaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccgaggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataattgatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgc

SEQ ID NO: 23712 - DNA, 208 bp, Oryza sativa
aattcccgaggccactaaaagtgttactactccactactacacaaaactaatcaatccaatctatactagcctaatccaattgtgcaggattacgtacaagtaggaccggccgacaggcattgcttccagggttacattgcatgcctctcaactgcacacaaggttatgtactgtcacgaaatgtttggatctcgtcgtccccatagc

SEQ ID NO: 23713 - DNA, 1501 bp, Oryza sativa
ggacggagcgcatgcagtgtggttgtggtgcaaggttggagcgcatgagctagggagaggggagagggttgtgtgtacgttgttggggcccatttggcagctagctaagccaatgactggatgtgagccagcagtcacatccctcgtgtactctttcgtgtgtgtgtgggaggtctgttttcagtcccctactttttcctgattgtttacatgtctctactctgtagtaggatctcatgcattacttttttttacaagaaaaaagggtgttatattaattaatcatccttgaggattataagatcatggatataagtattttttaagacaactttatcacctcaatgtaatgtactgaattcaataaaacttccattatataaaaatggatataagtagggaacatcgtgcactatgcttaatccatggcaaactgtgctaactcatgcgctatgcttttacactctcttctaatatatatatgcctaaccttcaccttcggaaacaaccacattatattatacgtttggcttcattgatgaccaatcaactatatttgatgtaaggaaacatgtcattgccacacaatatgactcaaggtaatgggtttgcgaacccactctgcggcgagagctagcctttctcggcatgccatagcttcaactttctctcctgccacaccatcccagattactcacgaagaagatataagaacttgccatgctgagtctctcatggcaatggcaatgtccgcctcaacagagaatgcgcaataagagccatcaacatttactttaagccaatccgcttccgatcactctcaattatgagatattttctcccacgtaggcgttcaaatttcgctcccctaatctcgccttgccctagcttgccattatcatctttttgtcgtactgacaatagcggttaccaatagttcgatcaatcgatcagctaatttctttaattcttcacatgaattaagaatattaattgctatagatggaccatccattgggtattttagttattgaataaattaaaggaattctaggaatatgcttttaattatgtttgcaagccattaatttgtacattcccaggcactacatattttaaacaatcaatatcttcttggaatttactaatttagatttccaaattattaaattacaattatattataattgaagtttcacactaaggacaactcaatatttattaatttagaatcattaaaatatagggaaaaaacttattgaggttgtaggccaaccaagacctaatattcattaattaactattatgatttgttaattcttaaatttggatttattaaataaagaactgagtatgatttggtcttttattaatacaaattttagaagaattaaaccaatcataaaaaaattgtaattgaaactacaggtcaagtataactttcttttgattgattcagaatttcagaatattattagatcattcaaaactataactgaga

SEQ ID NO: 23714 - DNA, 1501 bp, Oryza sativa
ggactaaagatcctagggccctgacacggcctgacatggaatcaaccgagactaaaaatgaactttagtcccggttgaagttaccaaccgggactaaagataatttttagtcccggttggtaacatcttcctcctatcaaccgggactaaaaatgatttttagtcccggtttttaatgcaaccgggactattgtggatttgggtcgaccgaccaaagatggtttctctaccagtctgtgacatacctgaaatttcaggacttaaagtttcttgtcaaaatagttagagattaacttctccaattttgagagccaaaaatttccgttttaacttaggtgatgaccaacttaaaccattgcatgattaaaatttgagaacaaaataaaactttttcatcccaacattagactagaaatgtcatcaagcattggagcatacattgtgcatttggattttggtctctcttttcataataggtctcatgagcataaactaaaagggttaaaaattactaagcaaaactatagttaatcttgggtgataacatgtggacttaatattaaattctaatatctttttctcagcccaaaagaagtttaatgtaatccctataataatattaggtgcaattatgaagtagggacacatatacaaagaaatgttattctaattctttaaaataatctatgcaagatgaaatcatggaaaaatttatggaaaaaattatgtaaactatgtttagcataagcaattcactataatattggtacaagttaataactaagtttaataccacaaattaatcagtcaaagtagaaaactaaaagaaatcaaataaaattttaattggctaaagccatacttcatccaaaagtacatttaactgtacataagtgaacatggaaaataatttattcaaatactagattatttatcatgcctaaatataatttttctagaattttcctcctctgtttaggcttcctaaaaattcaatctacctttctaatagcccatctttgtttaatttctgtgagcagtctacccattatttttgagtacaaccaaagaaaatggaatctaggtgtaatcatttacctccagtaaaatcaacactaattaatttggtccacacattaagttatgaagctacaaagttagggttgagaaaataatctaaaaattcgtctaaaaccgtgttcacccagaatcttccccacacctctcacttccacctagagcacttcgtcctggcccacttggcagcctctccagctcgccctttctctgtgcctcaccctcagccgaccaagaacacagagagggagagatcgagcgagccgacgcgtggccacaacgtgtcgacgacctcgggctttccttttcttgctctcttctcctccagtctgagtcgccattcctcactcatcactcagagccgaagaagccgaggggagcaggtcctctgcctctccgtcaccagcgacctcaccaccggcca

SEQ ID NO: 23715 - DNA, 1501 bp, Oryza sativa
tgcaacacaaagggttaaactcagtttggtgggaaacacacatcatccttggcactactgtcattttacatccagcctaagtgacaaaatactgaacatttttaaacaatagttagagggtttttccattaaatcagttagagggttttgccattcaattccctgaagacattaaagaagcagtgaagggatttgctatttaattcacagaacattaaaagcaaccgtgagatattttgccatttattgattccttgaaacaaatctttagcagaaataaatgaagatacaatcataaatacgtgatgacagagagaagatttatgcttacctcattgcagctagtccaccatcaattccacttcatcctttcgccctttaatagcacatataggcacacaaccctaaggattaaccccaaaattcccccaccaccgcactgtgcccgctgccaaatcccatccgtgtcaatcaccatgttctccctcctttcccttgcccacaaactctgccctcgattcatctcccccaacaccgcgagcggcacacctctactaatgatggtcaagaccaaatcactgccctccccaacaatctcctctctgaaatcgtctcccgcctccccatcattgatgccatccgtaccaccacactttcccaaggctggtcaaggatttggcactcggtgccgctcagcctcgatcactcccagatccgacgtgccggggagaacatcctcgatgatctctccaacagcgccatggtcgctagggtctccagcatcctgtcctcccaccctggccccttcaacagtatccatctgacctgcagcagtatggggtctcacaatgacgccctcaagagctggttcaaggcatttgctgacaagcacctcaaggagcttgccttcctcaacctgaactacccaaatgacatcatggtacctactgatctcttctgttgcaagtccctgaagcggctctaccttggtggtgtccagctgcctgcaaacactggcatcatcccttgttcccacacattccatgaactctgggagatctgtttgtatcgatgcatcctgcacgagtgggacattgagaacctgctgacctgcagcccaaaggtggagaagctctcgctggtcaacagtgcttgtggttggccactgcggctgcacatccgcagccacagcctccgatgcatgctgcattgggcctcctcgttggaggagctcgctatggtatccactccatgcctcgagcgcctcatcctttggagggatgatgctttgcactggagtgactgtaagaagatcaagatctgctctatgcctaagctccaggtcatcggatatctcaaccctgcggaccatgttcttcagattcgtgatactgtgatcaaggaatggagctctagatctcctgtttgtgtttctttaattaatttggattattagtatctaaaattaaacttatgtatgagtgtgtgatttatttagtgg

SEQ ID NO: 23716 - DNA, 594 bp, Oryza sativa
cctgcacgacaactacaccaagccgtgctcctaccgctcgcagtacgtcactcaaaccaccactgcccaagaaatcatgtccgatctcttcactgctttggttggtttgattaaaatttgaaaatatacctctctttcattggttttgtacaaatacactcatttagaaaactaggaagaaaatccgcgcagatgcgcgggcatctgatttattcttttacgaaaataatgcttacagaagtcatatatcaccatttatactccgtgaaatagattgtacattttaatatatttaaatgataaggaggcctcctagattaaataaaatcatttgccccgactacatataaatgttcttaggacccgttctatactccaactgcaaacttcaactttcttatttttcattagcacgcttcccaaattgtgaaacgctatatttttgcaaaaatattttatatagaagtttaaagaaaaaatcaaaatttcaagtttacaataattaatatctaattaatcacgtggtaatgaactttctatacctaatcacttcaacttactacatatgtacctattcatggatgatactacata

SEQ ID NO: 23717 - DNA, 1501 bp, Oryza sativa
gtcaggagaggctccaacggtcacattatcctcgctgactccgccgcgcgccgggtgctcgcctttctcccccttgcgccaccaccggcgccggcgagtcctcgtcaccggagagcgagggggtctccgccgtggtcgcctgcgcgctacgcggcgacgctgccggcttccttccgccggagtcaaccttgggggtaagggtaaggtttcccccgagagagagagagagagagagagagagagagagagagagagagagagagagagagagatttaggggttttcttctgtagtttttgctgtgatttcgtcttgcggttcttctttacatccgtggatgacacgggcagtatctacgaaagcatatgcgagttatctatcagatctggctcccccgatccccttgtgtgctagggttgatgcgcgcgtgcgatggctttggttggtgcggatttaggtatccttagtttgataccaacaacttgataggttagagccccaatgacccatgttttttttattcaaatgcttcagcaactcatgtctaattacatagcagagaaaatgcaatagaagggtatatgttatcaagaacgcacttttttggatgttttggtaggagatagcacatctgtaccttcaaaagttgttattgccctttcccacagattggcattggacgatctggcgcattgcacatgatggtcaatcgaccagaattggacttttggtactcttttttttagataatggatagaaatccggcctctataaggtcttttggtactggaatgttgttgttgccctagttgtttttcacagaaatttactataactgtatcattgtgcttgtcatagtttgctgttcgtactttataaaatttcggaactgcgggtttcagaccaggtagtttgctgttcaagaagtcatggccttaggcttcttttactagttccttttcttatttacattacaaatgattgcttgtgttagggcaaattcttggcaatctcgtcttgcttacacctcgtatgctgttggataagctcatgtggaagaatgacagcatgtgtgcaagatgctaacgtgttgtcttttccaattaactgtggtttttcataaaatttatctcattcaattcactgttcttttccatagtaaatacatgttcttctggatggtgggttagcaatttagccttcattcattatttctattaaacacatttttctagtgtataatttcttttcacgaatgctaggcaataggcatcaccacctcacaaaggtgacatttcctgatgattcccttttcttctgtttccacaccagattgctgcaaacaactccagtttctgaataaagacagtgccgatattaatggataagaaacagacctcgttaggcactcctgtctacaggacaaatcccttcgattctgactctgattctgaagtgccctcaagaccgtcaagggcacaatctgtcccagtgcgacgca

SEQ ID NO: 23718 - DNA, 1501 bp, Oryza sativa
cgctaccactacctcggcgaccacgcccttcgtcgagagctgcaccgcgctcgcggacggcgacggcggcggcggcggcgggtactgcgcgttgtgcagcgagaggtgcggtggtgagatgctgcacccgggtgatggttcgttgattcgttcgcgtgggcgggaaaacggggaggaggagctgtccaaatatagcaagtgattaaaaaaattcagttatcttctgtgattgtgatctgatcaccaattgtaaatcctcccgttataaacatttgacgacccagttgaatttcaattgtgatcaccaatcttactcaaagcaacaaaaaaaaattaatgtaaatatgcaagtaacaatcaagagtaccagagccagtaacgcatagcgtcaaatatacagccgccacatcttccaagcctgtaccttctcgcagcaagtttgggtgcaggttcaggctcgtttgagcctctcctgctcgccgccgtcctcggactttgccagttggtggctcgctacccggcaaactgttgcgaagatcgatcgcaagacgttcgacgccggggtcatcctcattatatggttgatttggaaagagcgcaacgcacgggttttcgagggaacggcctcatcggtcatgcagctgtgtgcgaccatgtgtgatgaatgggttacttggaaatcagcagggctagttacctcgttgaatgttgctgcagtgccagctttagagagattacagactttgtaatttgctttttgttgtaaaggcggtgctctaacgcactgcatttgtacaattttccccttttccttaatatacatcggtcagcattcttcgccatcccggcgaaagaaaaaaaatatacaaccgccacttcaagaggatattcagtgtcaaacatacaggacaattctactcaacaagatgtactcccaccctccctatatatttgtcgttgacttttttaaacatgtttaatcgtttgtcttatttaaaaaacttttatgaaatatgtaaaactatatgtatacgtaaaagtatatttaacaatgaatcaaatgataggaaaataattaataattacttaatttttttaaataagacgaacggttaaacatgtttaaaaaaatcaacggcgctaaatatttagggacggagggaatacgaaattaagcaaatttcttaaaaacaaagttgcagaataattttaagtttctaactgtttcctctgcacgaaagagaaccagctaaccaccgacaaccacaagctgcaacaaaatttctgtagtatccactgtgctgatctggtccggcccactgacccggcccataccagcccagcccacgttttgctcacgcaaggtagtacggcccaataaggcccatttaaagagggaggaaagccaaatcagatagctcgcctcgtctcggtcgtctctctctctctttcctctcgtctttctcggcggcggcggaggcggaggcggcggcggcggaga

SEQ ID NO: 23719 - DNA, 1501 bp, Oryza sativa
tcatgtccaagaaaatgggttttagactttcagagaaccttacatgcattgtgtatattcactgtaaaaaaaggttctgttgtacagttgtatcatacatttatacaatagacaacactgttgctgacttaccgttaaatcatgacaccagtttatgctcattgtcctggtttctagatgagtcaccccttttattttgctgttcattctcttctttctcaaaacggtgaccccagattttttttcaactgatctctgaatattgaatggcttgtgagttgtagtatctgtaattaacttgtcttttttttttgttcctttgcgaaattcagctgctctctggttgaggtaccccaatgttcatgccgcctagaggaaggcagaactacaggagcagaacctctgacaatcacttcttcattaatctcttcagagttattcgctgattcagatcgaatgacagagaactggatgtcttcattttttttggttgattcaggttcagaaagggaaactatcaaaaacattttggtttccgggttgttaattagctatggctaggggtgaaaacagtacggaaacattccgaacctattttcgaaaacggaatctgtcggtcggaattttttcgaaatttttcggaaacggaaacggattcagaaatatttcctcggaaacggaatcgaaaatgataagggcagttttcgtcggaactcggaatcggtcggaaactttccggaaattttctaggaatttttagaatttttctcagaatttccagaaatcacaaaataccctggattacttttttaagcactgaatagtgaataccatggtgtttagcggttatttttttaaaaaaaattgttatgcaaatctaaaattatataagaatatttttttctacattgggatttatcaacagcattactaatttattccatagattgtgttttgtgatgtagtattgatacttaacaattggacttatatgattgtgtttatgatgaattgttgaccgttgagacttgagaatcggatttatcagtttgagggtttttttattccgataaattttcgttactgtattcacgccggttcgttttcgctccgttttcggttttgataatattcgattccgttttcgtatccggagtttccgattccaaaacgaaaacgataaagatgatttccgtaccgttttcacccctagctatggcctatgggccattatgcccaagtgatctgatgccgaagtgccaatgctggcttgggcctctctcagcgaagccttcatttgggcgcaatttatactcgacacgcaagattaacggacgtacggctccgactccgagagccaggcgagaatccgatttgattgcagaactgatgcagattccgaatcaaaaaacaaaaagtaaaaacgattcggacaatgcaagcatcctcttcctataaaagtctttcttgttttagttacagggaattcgcttgctatcga

SEQ ID NO: 23720 - DNA, 601 bp, Oryza sativa
ctggggagggccgggtcggggtgcccgccctccatcgtctcgcctgagaagaaagagagagcgtttctcttctgtagcatagacgacatgggtaactcgcatacacgttggcgggccggcgaattggcccacccacccttaaattacagggggcccgttgctagattgacgtttcgatatgctccaatccggaggctggagcacttaaccagaaacaattcttattggagtactagttttacatgacgtgttttttcatacgtttgatctcccgtcttgtttaattttattaaacatataaacatataggttatacttaaagaacctttatttttgaaatcacaacaaaatacttacttcatctgtctcaaaataaaatataaaaaccttaaatcgaatggaacatgtcctagcaatataaatttaaatttggtcagactccagtcattcctgataagttcatcaggttgtaggttcttacatctggggacatatttggggatgtaaggaataaatgataatatttatatgattttttttagtaaggcgaatagtcaccagtctcaaaaagttaacgataacacatgctaaaaaatgagaa

SEQ ID NO: 23721 - DNA, 1501 bp, Oryza sativa
tctttgggtcgatcatttggctccgcctcatctcgacgcggtgcggcagccccggcagggacacggcggcgtcggggtcgtcgtcggggcaggcctccaccgggttgtggcgcaccatgctctcctggcatgaccgcgcgaacacgccggtgccgaggaacaccagccgcgggacgccgtgctcggcggcggcgtccacggaccaagtgaagaagccgtcggccacgacggcgtcggggtggtgctccgccatgaaccggtcgaacggctcgcgcagccgctggatggcatggacgaacttgccacggtcctcctcggaagcaagcgccgtgccgctctcgacgcccggcgggagcccgacgtccgggaatggcacgacggcgatgtcgatcgccggtgcgccgccggcatcgccacggagagcgtcgtcgttggcgcggtccacggcagggcggacgacggcggcattgacgggggtggtgaggatggtgcacctgacgccgcgtgccgcgaagagcgcggccatgtcggcgatcgggatgaggtggccgggcacgaggaacgggaggaagaggatgtgcagtggctgctgctcatccatggtagccattccgttgtcactccgagctaagctgcgtgcgttggagcagagtggctagctgagcaagttcagaagcctgaaaaactgtgtgatcttcagaagaggagatccacctaatttgtagtgtccgagtcaaaatgccttcagctcgaattatccaggaagaatggtaccaagtcgccatttctgacttggtgatcatccggtcatccctccaatgtcttacctgcttcgcctgcaagatttctacatttatatttcttccgtcttttaatagattacgtcgttgacttttgaacacacgtttcaccaattttaattatataaatgtgtaaggtataaattatggttaaagtaatttaagctataaaataactcataacaaaataatataatttacgtaaattgtttgaataaaataaatggtcaaacttgtggtaaagaaaatcaacgatgctatctattaaagagagagagagtatttgcgctgaagttacatcttgttttgcaagaaaccgctgggagcctaggatgggtaaccagccactttgctgatttttcgtttgtctgaaggtactggagaatatactccaatatggaactgctgtctgatcctttataagaaagagacatgtgatcgccggcacatgtgcacttgcttcgtcaccgcttacgtaaagcttcatcatgattgaacagtctttatctacaattcccatttggaaaaggcctggtttagttcattattttttttcaaacttctagctttttcataacattatatacacaaattttcaacttttccattacatcgttctaatttcaatcaaacttttaattttagcgtgaactaaacgcacccaaagttcatcgtataaagatcaaacttttaattttagc

SEQ ID NO: 23722 - DNA, 1501 bp, Oryza sativa
gtgcacacaccatgagcagccagacgacgagttgtgattgggcattgggcatgtggcgcgcacacacaacgtcaggctcgcagccaatccagtggcccagtgtgagattgcagtgagacagtatattgggctaacatgtgtgcgtcagtcagtcagtcagtcagcgcggctgctttgtttgtcccgtgctgttgtgttctgtgtctgaatggagtatttgcaattaaccgaggcaacagaacctgccatatcctgcctgcatatgcatgccagtgtcttgtagtagtagtagcagcagggacagagtacaataaaaaactgttggtactgctttggcatggcctgcacacctgcactgcagagaatgttccaagtgtactcctgctgatgctgatgctgcagttgcagtcatgtgtcccaagtcccaaagtcatgtgtgtgtgtgtgagagagagaaaagatttgatgacgagatggaaagcgttttgtactttagtacttctaggagaagtacagcaatgcatgcagtgcagtgcagtgcacagagatatagtgagtgagtgttgtatgatgatgagataataactcccattggcagcttctttgacgcagagaagtacgatgtgggggctcctcatgctggctgattgctgctgctgctgtcgtctctccctttggttttcttttgggagtactgtttgctttagataacagaggccggccgtcaacgtggggactatgccactatatatggtccaggaactcttccaagctgagtacttgacttttgttatactcatatactataagccatgtagagtaagtttggtatttatttatgaacatatgcaccaaagcttccactaatccactcctactgctgatcgagcaagaaaatattctagtggttcttaaataactctattatcataagttattttgtggtatgatgaattctcggattgagccttatgatatgttgttgtgcgagtgatatcatattagatctggaaggtgttcaaatctgtctagtattcaagtaataggatttttaccgggtactatgcatttcaagattcagagaactttattaattttgacaaacaagaagttcaacaatatgcatgtttacactgtagtcagatttgagagtacttttacagcatggtttgtagatttaaacaaactaacggtcaaaattttatttttagcaaccatatcaagttgaacgccgcgacataaaacaatatcaatttgggagcatggaggatctaacacgggggtgctgatggatccctatggagagaaggaaagaagagaaggactagaagggtagggggctagaggaggaggaagatgagcccctccaaacttgtcctagatccgccccagtttgggagtagtggtggccaggaatagacccaggattggctcaagggtcgggctagggctagcccatgctgagttgcgtcttacatgttgaaaaaatgtacatcataat

SEQ ID NO: 23723 - DNA, 253 bp, Oryza sativa
  unsure (1)..(253): unsure at all n locations
cgccaggtagacacctcttgnacccncccaaatgatcatacaggtcaatttcattgtctcagatttctctctctccccccccccccccccctatctgaatttgttgttagtcctgtatcaaaatcccaaatagatatattgttttgaactagacttcattaactttgccagggtctctggtttgagagagattcatctctttggatgctaccatccatgaatgataatcttctagatcatctgaagggcagag

SEQ ID NO: 23724 - DNA, 1501 bp, Oryza sativa
tgataaatttgattagtaataaatgtttggatgtggagacaatctcatccacatctaattgcttagtattggacccctacacaatgcctggtcttctgcttgacaatttgttctcgttttcttggctaggttatcctccacaaataaaattctataatcatactactgcaatttgcgaaacaaacaccatttcggtacatgaaaccaacaaaatccaccctagagcagcaatcttttcggcctaactcgtcgctaaatcagaacaactacaacaacacacgtaccgcaatacatcccacagaaaccgacgcctaacttttgacccccgatctaccccaataacaacagcaatcgcaaaccaggcaggctgaaatcaccgcgcccgcagccaccacatgaaccaccaagagcgcgaatcaatcagatgcggttagggtttgtgggggggcaagagacacggtaccatgcggacgtaggggttgtcgccgaggcaggactcgcagatgatggggaagtcggaccgctcccacccgtccgcctgcgcgtctcgcagcagccggtgagccatctccgccgccgccgcctccgcctccgccgccgccgagaaagacgagaggaaagagagagagagacgaccgagacgaggcgagctatctgatttggctttcctccctctttaaatgggccttattgggccgtactaccttgcgtgagcaaaacgtgggctgggctggtatgggccgggtcagtgggccggaccagatcagcacagtggatactacagaaattttgttgcagcttgtggttgtcggtggttagctggttctctttcgtgcagaggaaacagttagaaacttaaaattattctgcaactttgtttttaagaaatttgcttaatttcgtattccctccgtccctaaatatttagcgccgttgatttttttaaacatgtttaaccgttcgtcttatttaaaaaaattaagtaattattaattattttcctatcatttgattcattgttaaatatacttttacgtatacatatagttttacatatttcataaaagttttttaaataagacaaacgattaaacatgtttaaaaaagtcaacgacaaatatatagggagggtgggagtacatcttgttgagtagaattgtcctgtatgtttgacactgaatatcctcttgaagtggcggttgtatattttttttctttcgccgggatggcgaagaatgctgaccgatgtatattaaggaaaaggggaaaattgtacaaatgcagtgcgttagagcaccgcctttacaacaaaaagcaaattacaaagtctgtaatctctctaaagctggcactgcagcaacattcaacgaggtaactagccctgctgatttccaagtaacccattcatcacacatggtcgcacacagctgcatgaccgatgaggccgttccctcgaaaacccgtgcgttgcgctctttccaaatcaaccatataatgagga

SEQ ID NO: 23725 - DNA, 253 bp, Oryza sativa
aacatttttaacatttcaggctacggaaaaataagaagccggtttcaggttgctttcagcttgaattctgctttattggttgagggttacccttccgtgttagctgtaatatcagtgggatcatcctcatcatcctgaacctgacagatctaagagctgcatgtagtgtcgtttgatatgaaactttggggtttgcatattgccgacgccttacgttttcacgtgcattagacccacagtaatacgttgggaa

SEQ ID NO: 23726 - DNA, 1501 bp, Oryza sativa
caacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaatcgtacacccggtacgttccccggtccgcggttttggaaattcatttagttcgcaagcaccgacccaggtgtcgggttttccaagtcttttgtaaaacccaagttttacccaagttgttactcaaaattttaagtttgaaggcgtccgtcgatactcgcgcagggtgcacgaatatcgagacgcaactagatggttacaaggggacatggtatcacaattaacaaaggaaggatcaaatgcaacaaattaggtaggtccgccaatctgccttgcagacgggacaagcagagtaagtgagagagagggccggtggaccgggctcacctcgcgcggtcccgggtgggacccgcttgtcggtgacacggttcaccgtgcggagcgagcacgcggcgcacgcgcacgggcgggggagggacgcggtgtacgcgcgcggttcgcggtggacgcggatgcggcgggaccacgcgcagcctcacggctcgcggtggaacacgcgcacggggagggactgaccggggtcggctcgacccggtcttggccgagctggcgccgacgtggcgcctacgtagctgccacgcgggccggcgggaggtagacgacgacgccggccggaacggacggcggacgacagcggcgagcggcggagcgaaccacggcgatacaggcgaaggcgagcacaccgggtggttgcacgagacgaggggagacgagccaacggctcggattcgccggagggagcttgacggcggcgaattgcggcggcggcaaccggcggcgggagaagggggaaacggcgacgaggtcacgcgagccttgcagacgggacaagcagagtaagtgcagtcctatcaatgcataatatttttcaagcaacataattaagttcaaatataggctcaagatgttcaaaggtggcttgccttgctcgagatcttgagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttgcggttgggaagatattgaatttctaagattattggatttttggtctaaaggaaaaggattgaattaaatcctttttgaaaaataaaagaaaagaaagaaaagagggaggggaaatagacttttcctcgggcggctagggcgcggcccgagagaaa

SEQ ID NO: 23727 - DNA, 778 bp, Oryza sativa
acccctgaaatcctgaattagaaaaaaaaactaaataaccccctaaggtgcttacgtggaacaccacggaactgaaacaattctctcttttttttttctttcatttgccttctctttcctacttttctattcaccccttttctctctgatatagcagctttagaatttgattacaacttactagctaaatcctagctttttagggataaaacaaaatgttacataatattatttcctgaaataaacaacattaatttgttttttactatatgtagtgctcgccttgattatttatgtggcaacccaataacattgctgcaatatgaagaggtgtggtggcagattcattgccacaaccaccatcgcatctttcaaatggagtatagatttgttgaagcattgacacattagctgctatggtggcaaaaggcatgtgtaaaaccttatcgggtttatttagatggtattagatagttcatggggttatctagacactttcgcagtcagagggctaagtagatcaaccctgacagctaagtggtagcttggactggaaactttttttgcatgtaataagtcctgtaaacaatgttaaccaatcgaaaagatatcagtttatctcttggtgtacttaatatatttacatttcatatcgtgagatattagcaattcataaagtgtgagtgaaactaaacagagaatgtgaagaacaaagaaattcatctagtctaactgtagagcatgctactgttgtttaattcgggcctttcacccatca

SEQ ID NO: 23728 - DNA, 1501 bp, Oryza sativa
gccgctcccgccgaccccgactcggtcaagccgcgcccgcccgcagcgagcagcgcgccgcacggcccaacccaacccaacggctgctcgtcccctcgcgcgagccgcgcgcgtcacgtgtccgcgcgcccgttgcaatgcggcaccagcagcgagcggtcgcgcgtttctgcccttctgcccgttggttgccgcgcgccgctgcacgggacgggttcccggcgttcccgccacactcgcacgcatcgcgcccggtagccacacacactactcctactactcctccatgattcggcggcacggtgctgggaccagcggaaagcgatagttgcacgttggagcaggcgtgaggcggggcccgggaccttccttccctcaccgggtggctccgtttccgctggggcaaggctggctggctgagtggccatcagccacactgtttacaacacggggaaaagcaaccttcattatcacgaacattacatgattgcccggtgtcattatgagttgagtgagataccaaagatgctgatggaaaatcatggcccatggaaccgatagaataacgcattacattatggaactgagaaggaatacagagcacctataggatgtgggttgagtacggcatcgggtcaggtagagcggttacaagcactgaagacagtggagaagctttttgacagcgttctctccgcctccaaagcgtgctagtctcgataaagctagtactagcacacaattggggcttaaaccaacgaggtttacaaactgattttgaaacttcgtgttttacctactacctctcgccttggcgacttggcggcatatgcatgtacctatttggagcccgaaatcacgcagtccggcaatcaatcaaccatgggaattccaacgaggcaaaaatcaacaactgacgctacaaaaccccacatgtttccccccacacatcaaatgatcaaatcctggtcgaaaacgtgctgtgttctctacggatcatcctcgtcccatgaacctgaccaaaaattcagacccaaacatctacagtaacatgaagcaagtgaacatgctttgattattattttgtcaaaagtacccgtattttgatttatttttctctctttccgacataccacctcgccgctttccctttctcccctgcgctctcacgtcaaacggtttcctccccctctcatctcctctttatcttttgttcttttgtgcggctgcttttccatttccgcccacatcgccttctacctctcgcactccgctagctaagctcgcttgcttccactccagctagccagcgagcgagcgagcgagctcaccttctactccactcctcgcgccgtactctccatgccctcgtcttgaagcaaggtcggcagtggcagtctttgtccggggaggcggaagctttcttgggtttttctttgaggcggctgcattgtttgtgattcttgggcgatggagaaggagaggaagcaggggttcttcg

SEQ ID NO: 23729 - DNA, 168 bp, Oryza sativa
gatgtttgtaagacgtggatctgaatgtcaatattgtcatttgtgtaccccggccggtcctggacggggattttaatgcacattctgcttggaattctattcgggaatttctgggcgtgacacctgatttctcctgacttaatgagggtaattgaggattttcaaaga

SEQ ID NO: 23730 - DNA, 363 bp, Oryza sativa
agaaccataatctctagcctgcttcttgattgccaataagggtttcatcggggtttcagccagggagtgatctggacgttgcatcggctcataaagatcgcatatacatataagttggatttagccgatgacaacaaaggtttcactgtttaatctaatcttgtggatttcctgacatcggatccccagccgatatatgctttaacctttggatcaatacttgttctactatatcatattattagccgattggttttctactggattatattgctatattatattatcatcagccgactgcctttatatcattatctacattggacatatagccgatcgcttaaatcctatcgctatcggctg

SEQ ID NO: 23731 - DNA, 1501 bp, Oryza sativa
cctcctaaccctacctttcttttcttccatatatggatctaatccctctctcgctagttttttaaccttcttccatatatatccatctaatccctctcttgctaagcgctcggaattacccacacgtgttggtgcatgcgcatgcgcgctcggccataacccccggccggcgagagctctcgaccacagctcgtcgtgccgtcgttgtcgtgtgcgtctccacggtatatctatcctgggcgtgcggcggcggtgtaggcagtgcgcgcgtcgcggctgccatcgattacaaattggtcggagaggcgagaaattagctattttcctatagtttcctctctttttttcatgttcttgttattagactggtttccctgtatgttctactatatccttctagacttgtttttttttaatttcctttctcctccaatttggatggggttattattttgtttgctctctcaatctagcagcatgctacccgcgcgttaaagggattaatatgccatcatatttttcatgaacaaatagtcaacatatatttaaattgtaagtttctttctaaattacagatgtaattttagtctatttatttacaatgtaagtctctaaattacataagtaattttaaaatttttacaatgtaatatatttaactttgcaaccggttatggacataataaagaaccgtggacacaaaataggagaaaaaaatgaatttattattaattgtacaagtccgcgaaaaatgagcacagaagagttggagcttgatcaagtgtcctagttagttacgctttcggatagctttgatctgacgcaaaaaaatctgactctaatcagcccacaaatatatatgccagcacatgtttagtaaaactgtattatgtttgttcacatatatgaacgaataggtaatgagtactgtaatagtgggttaattaattagcttgccagcttcaggggtgccaatattagttctctcatggtttccacaaattcccgatgttgttcttgtgcctttttctttggctaaaattaaaagttctagaaaacatcgtgtcatgctagttttgagcagaagtttaaaaaaaaaaagaggttatctttgaccagaatactagatggatatcccaataacttccaatggctctacggtttgagatagttcaatatgcaacttctttccaagggccgctctattatttggaaataattcaacatgaacttcccaagggcactacggttttagataattcatcgaattaataactgcattctgtagtttgatttgcatacatgtaatcctcaagatatctccacgtataactaatcttgcatatcctgcctattcagaattgagatatatctcatctaaactctcaattaataattgacaggtgcacacacaaacacgggattatggcggcggataagagccctatcgacgaggctctcctacatggcaaacacgaagaggctctcctacatggcaaac

SEQ ID NO: 23732 - DNA, 1501 bp, Oryza sativa
aaatatgcctccttggtaatcgtaggtaaactggaagaaggtgtcaaaggagtgcggtagcacgacggtgcattgcagcgaccaccgtggcctgctgccccctccgtcggcggcggaagctgtccagagctcaactctatcgtcggcgggagcatgcacatagcacagcttgccacccagctccgtcaggtccccacaagcgacgtcagacatcttctgccgctccatgaacggtgggcacgggaaactggcgaactcctcgctgcacacgtcgaagcgtacaatccctggggtggtgcagctgccggtggacggcgacggtagggcggcgatccagtagatgccgccgaggatgcacggcgacgttttggtcttgatgaggtagggtgggtcggcgaccggcctccacgccggcgagccgagggacaaaacctcgcatccgacgctgtagtccgtgtaggtcttgtcgcagtggcggatgaagcagtggaccaccttcgtcttgcccgtagattggtcggcgtagaagcttaccgcttgcaccccgaagtagtccagcgcacagtccggtagctcggcaagctccttggtcgccgggttgcaaactaacatctgagtggagtacttcatcgtcgagcgcagcaacacgagcccgttgcagtgcagatgcatgccccagccgatggcgccaacgtcgtcgtcccagtcgtcgtcgtcgtcccagtccgcggcggcgtccccgtcgtcgacggcgtcgtccaagttgtcggcggcggccccgtcatccgcggcatcggccccgtcgtcgacggcgtcccagtcggcggcagcgtacccgtctgcggcggcggcgacggtcgacttcgagttcgaggaccatgttatcctatgcgcgaagtccgcggcgacgccatggcccggatagctaaagaagtcgatcgttcccctccattgctctggcacacaccagtctgccaggacgagcatggacggtgggtgatggcgcgccgccgtggtggagtggtgcagctggaggcgaacgaagtgcggctcggcgaccatggagcgccacgacttgcacacggacctgaaccgcaggatggacttgacggggagacggaggaggatttgctcgatgacgtcttccgggatgccagccgccgcggcgccggtgggttcgacgcaccgccgccgcttggccacgggcagatcaccaccatgtcccggctgattcatcatatcacgttttcccgcgctcgcacaagccatcgatagcaagcgaattccctgtaactaaaacaagaaagacttttataggaagaggatgcttgcattgtccgaatcgtttttactttttgttttttgattcggaatctgcatcagttctgcaatcaaatcggattctcgcctggctctcggagtcggagccgtacgtccgttaatcttgcgtgtcgagtataaattgcgcccaaatgaaggcttcgctgagagaggcccaagc

SEQ ID NO: 23733 - DNA, 1501 bp, Oryza sativa
tgtttccgtactgttttcacccctagccatagctaattaacaacccggaaaccaaaatgtttttgatagtttccctttctgaacctgaatcaaccaaaaaaaatgaagacatccagttctctgtcattcgatctgaatcagcgaataactctgaagagattaatgaagaagtgattgtcagaggttctgctcctgtagttctgccttcctctaggcggcatgaacattggggtacctcaaccagagagcagctgaatttcgcaaaggaacaaaaaaaaaagacaagttaattacagatactacaactcacaagccattcaatattcagagatcagttgaaaaaaaatctggggtcaccgttttgagaaagaagagaatgaacagcaaaataaaaggggtgactcatctagaaaccaggacaatgagcataaactggtgtcatgatttaacggtaagtcagcaacagtgttgtctattgtataaatgtatgatacaactgtacaacagaacctttttttacagtgaatatacacaatgcatgtaaggttctctgaaagtctaaaacccattttcttggacatgaaagagctgactgagatgatcatggttttaatccatcaacactactaacaagacaaaataacaaaaggagcatgaatatgtatgcaactagcaagtcattgttctgaatcactgaactagcttcaggattgtctaatctatctattatcttattaaagtaataaaaaaagaagccatcacgtttggtctctcacggtctagaaattctcacattaatcggagaaaaataaaaagtagaatccatataataatacaatttaaaaatagctgaaattcggaattagaaataaggaatattgaaagagtagactagagattggcatgtagagtcctattatatttttttgttgtttcgctgattcctgattgtaactgcaccaagtgttatgttagtcgaactgttatcaatactaccgagacggtcgatttacattggttttaaaagtttgcccgattttattattaagggatgcaaatcaaaacacgttctatagttgaggggtgcaaaatagacattcttactcatttacattggttttaaaagttaggggcgcttggctattggtgcttcagtcggcgagcggcggaggtggcgcagggggctcttgatcgtggagttagatatgggcaagtatggcccgcgtgggggtgtgtgtggctatataagcttgtgttctggcccatctcgtagcagcccaaacgtgttcaaccgacgcagcaagtttcaggatactcgacacgcaagattaacggacgtacggctccgactccgagagccaggcgagaatccgatttgattgcagaactgatgtcagattccgaatcaaaaaacaaagaagtaaaaaaagattcggacaagcatctttccccataaaagtctttcttgttttagttacaggggattcgcttgctatcgata

SEQ ID NO: 23734 - DNA, 1501 bp, Oryza sativa
atcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctatcatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcacgctaaaattaaaagtttgatctttatacgatgaactttgggtgcgtttagttcacgctaaaattaaaagtttgattgaaattagaacgatgtaatggaaaagttgaaaatttgtgtatataatgttatgaaaaagctagaagtttgaaaaaaaataatgaactaaaccaggccttttccaaatgggaattgtagataaagactgttcaatcatgatgaagctttacgtaagcggtgacgaagcaagtgcacatgtgccggcgatcacatgtctctttcttataaaggatcagacagcagttccatattggagtatattctccagtaccttcagacaaacgaaaaatcagcaaagtggctggttacccatcctaggctcccagcggtttcttgcaaaacaagatgtaacttcagcgcaaatactctctctctctttaatagatagcatcgttgattttctttaccacaagtttgaccatttattttattcaaacaatttacgtaaattatattattttgttatgagttattttatagcttaaattactttaaccataatttataccttacacatttatataattaaaattggtgaaacgtgtgttcaaaagtcaacgacgtaatctattaaaagacggaagaaatataaatgtagaaatcttgcaggcgaagcaggtaagacattggagggatgaccggatgatcaccaagtcagaaatggcgacttggtaccattcttcctggataattcgagctgaaggcattttgactcg

SEQ ID NO: 23735 - DNA, 1501 bp, Oryza sativa
aaaaaataacgaacggaaaaagaattgatgaggtttattgaaaatttgaaacatgatgatccagaaatttggtgagattcattaaaacatcatgacgccggcttattgatttgttagaggaacaagaagatagaggcaattgctgtaaatttgtgttacactagccttcaaatccgtattagtccattatatatatgctgagcagacccacgtttttatagtattttacttatataatattgttaacgtttcatttgaaagggttaagttgaaggtgttgatattgttagagtgaatcgagtatataaactagatcaaacccatctaaactcttcacctagaactactcctaccaaatgaacacttgggcttagttgaaaacttgaaatatactaagcctgtgttcctccctcagtttttccaactcacctctcttgtttttcacgcgcacgttttttcaaactgttttaaaaaattctatatgaaaattattttaaaaaattatattaatctattttttaaaaataaataattaatacttaattaatatgcaataatatgcaataatacgcatttcgaacgcagcctaaacgggctaagggtattacggttgctcctttgtttactttttatgtttaaagctcatatatagccagatgacccatttcagtatcggataatttggtttcggtctcagccatgaccaaaattatcggagacccaaagattcagagaatttaccaataaattcagtagatagatataaaaatacaaacatcacaaaaatccaatagctgatgaactcatcgacaaaaatactcttctagtcttgcacatcggttttttagatatggcaatggatctccatctctagcatggctggcccaaccaggcaaggcggaaggccttagggagatgctggtttttgctaatatggctctttgacctggtctaatgggactaggtccatatgtggagcccacatgtcagggacccgtgtggccgagtatttctcctatgctcccctttcccacaccaccacacgagctcaagaatggcagttggcagcggcacgacgacatctagcgaggaggagcgttcttcgtccacaccgccacacgagctcgagccaaatcaatgaaaattgctcttaaaacagacaagaaagttaaattacatcggttttaatagttttggggtcaacaagttttggggtcaacatatcccatatcgcagtttaggaatatgaataagactaaacctatatatgagagttaaaatggacttattcattttctcttatgctcatctgtacttgggccgggcctactccaacaagaacgagattcccccagggccgacgtgatgtgggccggaattggattcccagtgtacgtgatgggcttcatagatgcagcggggcggcgaggcgagcaaacccataaaccctcggcctttttttcttcccgaagctccaaggaatcctctccactcccggcga

SEQ ID NO: 23736 - DNA, 1501 bp, Oryza sativa
gtaggataggtttcaaagctaggtgtcatcgtggtaagggatctctgggtaaaacacttggcgatcttgtgtacctgatatcaattttgttcgagaaccaggtagtagttgtaactcaaccactagaagtaaatgtacgagagattgctacgattgactggttgagaaccagtgagtaggtgtctctcgatcattcgaagtcgtggtgtgaggaccgctgcgttatagcagtagtcgtacctcgatcatctgaggttgcggtgcgagagattgctacgtattggttcgaggaccagcgaacgtgtagaattatctctcgaacaccaatggaggttgcggtgcgagagattgctacgtgctggttcgagaaccagcgagcgagtagagttatctctcgaacaccaatggaggttgcggtgcgagagattgctacgtgctggttggagaaccagcgaacgtgtagaattatctctcgaacaccaatggagacgctagagttggtttatgtgcatctcatgtggccagcatgactcacacacccaacttgtagtatatccggatgtccgttcgcaatcatgtcgggtgatcaagccgacggtgttcgcgaggaattatccgttaacaaccttttctcgagtagtccagccatggccggtgctatgagataggtcgtcggtcttcgttgataggttgggcgcgacgactctgcatttgccgagatcgttctcgataatgtggtgtacttgaccacaacctactcgagtgctcaattgttcttgaaaaatattttctagaagacaagacatatagcagataatatcgagtatgtactcaaaaactgcatggatcttctagtattatcaggatataacgagcagatgtaaatatcagggcattatgtaaaccataaacaagcatgattcatacagaagagagcagagcgagcccccagcgtcggtttaacgtcggaaacactcgcgcgatagatattgtatagaaacatgctctaggtaaacataataaattatagatctgacaatgctgtatgatctgaataggtacgataaattccagataaaatattgcgtatctttgtagatacaagccggatgtatctacgaaattagtagatcaatttaaaaaaccaatctaccaattaccttgttgcgtactcgttcgatgtcatgcgatctgacatcttttggtacgccgcgaagcttgaggcttggatgatctcgatagaccaagttgtcgatgacgataattgttccgatcttagtcggaagatttacttggacaggttggatctctccacggccgaagtcatcgagtagcttgttgttggagaatccatctcttaaacccatcttgtctaaatcctgaagcaccaaaatccccctacctggcacgccactgtcgatatctgatgtcgcggttccggtatttgcatggtatgaggatcgtcagtgctagggtatacgcgagactgaggtaaaagaga

SEQ ID NO: 23737 - DNA, 407 bp, Oryza sativa
  unsure (1)..(407): unsure at all n locations
cgagactgtgtttatggattattctaatactaatgttntntttactcntcacacgtcttcccatcttccttcgaannngncatcttttatttgtatntnnatctttncttnccnccccccncagtgattgattgnacattctgctatgcaccctatnnnaannataattaaaagaataatttacatgttacattacaagccatgaatccaaatggatattactatttatcaagtgttagaatgcatgctcttaagttcttccttattgaagattgtttgtagcaagtgattctggactcatgtttttgtagtaccaaatatgctgtgtttatataatttattcatttgagtattctggtttctaattcttttcacatgctatgcagatcgacctagctgcaaatgca

SEQ ID NO: 23738 - DNA, 1501 bp, Oryza sativa
ttgaaaaaacataggaataggaaaaatataggaataggataggaatgcaagtgtaaaacagaggatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagcgaaaaaagaggtcagcatggacgtttttcttcctgtgatcttccagtgatatggctagtgcaggaaatttccctatgtatttcctatgaacgttttcctgtgatctgaatgacgccacagtaaagcaatccataggaacccaaatccttcatttcctgtgtttctcctccattccgaataagccctaactgtgttcatgattgattcattaaatttgcgagcaactcaatcctgtgaaaccatacttgaactagtactaagatgtctaggattctctttttgaaactgcctgaggagcattgtacttctttgaagtggcattgaaaggtgtttctgcggaacaatagtttttcaactaagatgtaaatatagttgtgtttttttttcttgacatgattgataggatgatgctttatacttattctggttgtactttgagatactaccaccaaggtgcagttttgtccatggttgtgactgatgtttcatgtaccatgcatgcttgttctgctacactgcttatgatttggtcaccaaaataaaattacaatctccaaaataaaattgcagtgatgcaccaaactgcaactttattttggagattgtaattttggcatacaaatatcctgcttgtgtgcaactattatttgattaatttggtgaaacttgatctgttgaacataggaatcatgccgtcctaatgtagccagttaacagccaagaagtagaaatttgactgtatgatcgattgctattaaggtttttgatcagcacattttatactttttccctttttaaaatttgtgcatttgtagttaacccaccttctatgttatggtttcctccatgtaaccttgctttgttcctcgggggcaaatgatgagagcagtctcgttctccactcgctttgtcttttggcgtgctgggagaagttttcggtttcatttgttcaggaatttcgttagcctgaaaatgcaggtgtatggaaagagctttggagcctttggttagaagctgtgaagtcggttgtattccatggcgttttctgttatgttgatttgtggcatgtctaagggtctgattggggtttttaattcatttttttggattctacaactacatcttcttaaaatctggaaaaaaaaactgactgttttggacgaaaaactgcatctgtcagaagcttcctcaaacatgccctaaactcaaaatcaaatcctgagttactaccttagggcaacc

SEQ ID NO: 23739 - DNA, 1501 bp, Oryza sativa
tcggaaacactcgcgcgatagatattgtatagaaacatgctctaggtaaacataataaattatagatctgacaatgctgtatgatctgaataggtacgataaattccagataaaatattgcgtatctttgtagatacaagccggatgtatctacgaaattagtagatcaatttaaaaaaccaatctaccaattaccttgttgcgtactcgttcgatgtcatgcgatctgacatcttttggtacgccgcgaagcttgaggcttggatgatctcgatagaccaagttgtcgatgacgataattgttccgatcttagtcggaagatttacttggacaggttggatctctccacggccgaagtcatcgagtagcttgttgttggagaatccatctcttaaacccatcttgtctaaatcctgaagcaccaaaatccccctacctggcacgccactgtcgatatctgatgtcgcggttccggtatttgcatggtatgaggatcgtcagtgctagggtatacgcgagactgaggtaaaagagatggagacatgaatttttatacaggtttgggcccctgaattgttaggtaataaccctacatcctgttggccggagccggtcgttgctcttattcaccataatcacacaagtacaatatttggggtagcctatctagctgttgtcgacatggcggtcggaaggtctgactcgtagtcgacaacagggtagccttcctcctcgaattcgtgcccggcgagatcatagatagcgctttcgtctctccagacagtatccggagacaccgtagggtactagccgtgcttatccctgaagtcgatatccggcggggtgtcttggcgtatgtaggcttctatgtcgattgtgttgggtgttgatcctccatggtgggtgttgattctctcgtgtcctctctcctcctaggggggcttgtatttatacccataggtgtccccttgtccaaatagaactagggaaaccaatatggatacaatccgagtagtcattgttgtttccatgtagaactctggttgtctttacttatccggaactccctcgaggtcagtttccgtataagaaatggtatgtggtggatcctaccgagatttagtcaactactattaggtatgtggtatctataaccctgacagttatgtatttccaaaaacgaaagaaattaaaaatcgactcaaatacgaatgacatatcaaaatattagtaaaaatatctttaatttttatattagtagagatttggtacgttgatttgtatctcacttaagctttgtacagcgcctacaaatttgacggcatggcccagcccctactaaacccgaagacattttggagtttggactcgtgtataaacatttctggaaacgccgtcctctcccgaagagcacaaacttttcaggcttctgaacttgctgagctaagtcactctgctatctactctgttccaaaacacacagaagaaaagctcggagtg

SEQ ID NO: 23740 - DNA, 1501 bp, Oryza sativa
cccccgcaatctcccatcggccaagccccgacgacgagccggcggacaacccgccgcctcctgaaaggaaatccagctcgaggtggtcgaacgaaccaagcttggcgccgccgtcgcggagacgcacccacccaacctgctccacacccgcggggggctctccgcgacaccgcccgtttcgccactagtattttttactagtacttttcactggcgcgcgcgcgggcgcgggcgcgaggcgagggagtggcggtggcgcgcccgcggggcgagcaccaccaccaccagcagccaccaggaggcacacaagtcgacataaaaaaaggagacgtcaagacccaaacaaagagaatcttcgcgacggggatgcgaggcgaggcgcctcgtggtcgtggcgcggcgcgtcgcggtctttccctttcccccctcctccgagtcctcctcttccgtcgcgctcgctgggggtggactggggtgtttggctgcgtgagtgcggagcggcggctataaagggggaagaaagaaacagcgccaccccgatctcctacctctaccgctgctactcaccacaccagccgccgccgcctcctgagccacgcaggtgtggatctctctctctctcattctctgtgcgctccgcttgctcctcctcggggttcttgatttgctactcgcgtttgcttgctcaccacgtgttcgatggaatacctgtgaggaggtgcatgtgctcaggttggttctttttttgtggggcggatccgagggtgtggctgtggtttggttgatgctaatccagctgttatttgtgctggattgattgctcacttgtgcttgttattactagtcgttgttagaagcttctggctagaaattcctccctttttgtgaaagctttctttagcctacaagggcatagggatttcgatagctaaaaagtgtgcttatcttgttaatgaaagagaagtgcaggtgctttatttgttgtcttgtgttccaaactctggaaaagtatgctatttttgcctttatcccatgagtattacatcatcataacttcagttgatgggaaatcttcccgatatacacacgtggattggagccccaacatctgcatagctagccatcatctttgtctcactttgttaggaaatttaagtgaagtcaatcaaaatatagtatggtaaatccaaaggctatacctttcagtttaactatcaaatactccctgctaaaactttgctaaatataaagagtttgatgtattttccagagaacttatattaaatatcaatcatttttggtatccattcttctgaaattagtattccctacaggaaaacatgcttaaaatagatagtaatctatagccttttaatgtatcctgttcttatggcaaacacgtgccccttctttttcttgacccgagcaagcaaatctgaaaattttatttcttttccagtttgcaggtctgatactgcttgttggttcctccccatcaaaa

SEQ ID NO: 23741 - DNA, 550 bp, Oryza sativa
tggaacttgtcccaagcaatataaattttaatttggtcaagactccaggcaattcctgataagttcatcagggtggtaggttcttacatctggggaaatatttgggaatgtaaggaataaattataatattaatatgattttttttagtaaggggaatagtcaccagtctcaaaagtttaccgataacccatgctaaaaaatgagaatgtcttttgaaagttaacattttatccatgtggccaaacacttgcaataaaagaagcagcagggagacataacaccagattagtttccagtgatcagaaacattagtcacgaaggtttcagcaaaaaagagatcaggaatcaaatatcctatccagtttaaaagataataaaaattgatcgcaacacatccagttactacgatggccattgctgtactgggggcaggagcaggacaaataactccatacgctggcatgaacaaaacgcatactgctacaagattctcattgtaagtaagtcggcaacctaagctgattctgaggtctcccattacatgacagc

SEQ ID NO: 23742 - DNA, 207 bp, Oryza sativa
atgtagtttggaaaggatatggtgtcgaggtgggtaaaaaagtgtcaaaatcctcaatgatagagcagaattgggcagtgaagcatgacctgttcatcaacatcggtttcttacgccagcaagatcttgatatcctcccttctcaagcgttagctagatcctatatacatataactcctgtcaattccacatgctggaaagcaaata

SEQ ID NO: 23743 - DNA, 161 bp, Oryza sativa
ttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaaga

SEQ ID NO: 23744 - DNA, 1501 bp, Oryza sativa
tatatactcgattcactctaacaatatcaacaccttcaacttaaccctttcaaatgaaacgttaacaatattatataagtaaaatactataaaaacgtgggtctgctcagcatatatataatggactaatacggatttgaaggctagtgtaacacaaatttacagcaattgcctctatcttcttgttcctctaacaaatcaataagccggcgtcatgatgttttaatgaatctcaccaaatttctggatcatcatgtttcaaattttcaataaacctcatcaattctttttccgttcgttattttttttttcgatgagagaaggccatgttcaattctcacgcaaaaactttttacactgtcacattgaatttttggcacatgtataaagtactaaatgtagaaaaaaaaccatttacacatattacgtgtaaattgcgaatcgaatctttttaagcttaattgtaccatgatttgacaatgtggtgctacagtaaatatttgttaataatggattaattagacttaataaatttgtctcgtggttttcaagtggaatctgtaatttgttttgttattagacaatgtttaatacttcaaatatgtgtccacatattcaatgtgacacgcaaggccaaaaatttttgccaactaaacaggcctaaactgctcctaatatatgtttggtataaggttttatcaatttttgatgtgttttttttttctaagggtgtgtttaattcacgccaaaaatgaaagtttggttgaaattggaacgatgtgataaaaaaagttagaagtttgtatgtgtaggaaaattttgatgtggtggaaaagttgaaagtttgaagaaaaagtttggaactaaactcggcctaaatataggccctgtttggagaactggccaagagttattttgagagctattttttagcacaacgaaataacccttcaaaaaatagccccaagttgtttggatccaagggttattttgagagctatttgaccttcatgtatcttcctatggagggagatagagagaaaagacactttttcagtggacaccacccgaaatagccccaattagcacaccttgggtgggttatttctaaatagctcttaaatagctcacccttttaatctttttggactgtttaatctatttgagggaggacttaaaaaaaatatcccttagatcaaagagaggcatagaatggacaggttcgtgcgaagtccacatcagtgggtcgggttcgtgaggaagtcgacgtcaggtgatctcttttcccgagtccactgtccaacagtaaaatggacagaaggccacatcgctgaccgatcctgatcttctgtgaggttcgagcgacacgcgcgaaatgccggtgattcccctggtcccatttaacctgctccgtataaatacaagggagagggagcagctcaacgcacaccgaacaacgaacactgtcaagctgcaacacacaagctgcctgcggctgcaa

SEQ ID NO: 23745 - DNA, 1501 bp, Oryza sativa
taggtcaaaagttaaacaaaccgttgacaaaccatactttacaataatgtcaaaatgttcaatacaaactcatgattatctgtagtacgctgtacacattagtcgttgttaccttgcgagatcaaccgtcttccaagagttgcctgtgcaaatttgacgtgctcgctagtcgctagttgcccgtccatgtgctaataaaaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaaaaatttacacataaaacatttctagcttttaacaatataacaaggacaataaagtaatttctacaataactaacggtcaaactaatggtcaactaacggaatgggtatgtaagggatccaaataaaaactcaggggtatataagatatcaaacaaatttcaggggcgtagaagggattgggtgaaattatatgggcatatagggaattggccctaataaaaaagaaattggtgcggtctttggcacgttagctagttagcccgtcccatactgtatacatatgaatatgtacatggattcgtgtatgaatctatcgacaatctaaaacgtcgtataatgtgaaacagatgaagtatttaacagagcttattaataatacttttgttatcgttttccttttagataattttattttcattttatttttttaggaaacacaattttattttctagtgtaacttacagcacatagtatttacctcaagatttacaatatccacatattgtggtgagatttattgtatttgaaaaaaaatgataatagtttccactctaaatttttatttaaaagtataaatgaagcacacaagtaaattggtgtatgattagattaacatgttaaatgtatatgagactgtttagtagaattc

SEQ ID NO: 23746 - DNA, 1501 bp, Oryza sativa
tgaactatgtagccataggaattctaggtctttcgaaacaacagaatcaccttacagtttgaattgattcactaaacacattcgatgacaatataatcacatgcatagatctcaaacgattttaccctttaccctacacccttgtttttcatagtacctatctcccttaccacaataacaatcaagcaaggcatacagaaatcgcaaaattgaacaaacttaagggaattcactgtcatagataaagcatcgaccgcccaagcatgtccaacataaaattaaaacacatgattatcagatagtttggtttagataacaagaagcataataatgataaaaccatctaagagcagcaggcatcacaaggcacagcaaaccagcacatcaagcctcaggcgccggctgcgagaggccggccttggcgagcagcttccccatcgcctcaggggagcacacctggtactgcacttccccggtgccgggctgcaggaacacctcggcgagctccagcttctcggcggtcaagctggtcgaatccatggtcttgctcaggaccttgagggcgagggctacggcctcctcccgggtcaggccgtcgcggtagtcctgcttgagcatggactgcgccgcctggctgttggccccgacggccgcggccttccagccgctgtagttgccggagggatcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgcgccgtgttgaggaggatgttggcgtcggacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgccgagggccgacccggcgttcccgatcgcctccatcgcgtactccacctggtagagacgcccctccggcgagaagatcgtcgtgcggctgtcgtaccggcgagacatcacggcggcggcggcgagagattggggttttctccggttagatttggggatttgaggggggagaagtgaggggagaggtgtgaatcgggtgaggttaaggagagagacctacttgtaagacaagaaaagaaaagagaaaaggccttatgggctggatttgatttgaatttgtcatggaaacgaatttgtacatccgagccccctatagattctaactttttcttcaaacttccaacttatccatcatatcaaaacttttctacacacataaatttttaaattttttctttaaacttccaattttagtcaaacttccaattttagcgtggaactaaacacacccgaattgaagtggggtggggga

SEQ ID NO: 23747 - DNA, 1501 bp, Oryza sativa
tcagaaagttaatggtatcaagtatttaaaaaactaaggtagtaactgaaatatagagagtgtgatctgtagcaaaagtgatcagtactacaactgtttggaaatgtaatcaaacagcgttgatgaaatactgaagctggctttgatcattgcaaacgctaacagaatgctatagcagaacgcaacccttctcatgttgttggtaagagccaagaaatgcgttaggcatgtcctgctgcttaacaacttaaattaattgattacataaaaacgttaactcatccaggtatagcaaagtattattgaaagggattaccaatgtaaatattaaaattgtaatataattatagtgtaacttacacataactataatataatttgtttaacacattatttccactaaaggagtacacgtgaccaaattgcatcacccgtggttgcgctatgattttttcctttcccgcttgcagagtcttaaagtaaatataccagattaaaaatacataaaaagttacatacatattatattataattacatacaagttataatattttttgaacgactcgcataagacggtgcgaagttctattgatagagcagaagaaaaattataagattacaaccctggaagttgtaactaggaaaaagggaaaaatataccaccacccacacaccgacaacgccaaaacactgaacaaggagaaggctagcaccggaccggccaccactaaccgtggccgacctccgctaggccaacaaagaaaacacggtcgggatcgcccaaaacccaactcttacaatcaacacaaagccccgctctatccaagtattcaggagttaaggagagagggtgagagagaagaatggaactcctctccccttaggccctccgacatggccagcttgtagagactagttaggatgccgccacaagaggatgtaatctagagtgagtttgtactaattggttgggtggttttagctaggggatgcctaaacgatggatcatagcaaaaccgttacttgaatactgaagctacctttgaatctttgatcatggcaaaagcttaacagaaggctagagcaggatacaaccctttcgtgctgttacctgtcggtacgagccaacttagccaagaaatgccataagcatgtcatgttgtttaacgaattcactagcttagtagtagcttaattaactgcctaaaagataaaaaggctaataaaacggttaactcattcggagacaaactcgtactgcaaagcctacgtgaaaatcgcgtttcccgcgctctcgtggcgcaccttctttgtctgtacaagaagtctattatataccccccatcctggccaagaccacaccttgccgtcgccaccaccttcctcgccgccggcagccgagcgggtcggtgccgccatgcaatcgccagagaatgcggcaccgcgcgtgtactttatcccgttcccgacgccggggcacgcgctgccgatgtgcgacc

SEQ ID NO: 23748 - DNA, 942 bp, Oryza sativa
gggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaagcccaaccatccacctatactatccaatttcattagactaaactagggtgagactaatcacggtgaatctggttgactgcccataaccgcgggcacggctattcgaatagttttactctgatcagaggtgtacaactgtacccacaagacacagccccacgacacgtttccgtgcgccgacatgccaccacgacatactggaaagaggccgtgacaggacccttcgcataaccccctctaaccaagcacaccacacctcaggtttcacccccactcttcgcaaggcagcgggcagtcccctctagtgcctaggtgaattcggaagccgcataggccgtcgcaaggcccatccaaactccatcacgcccacccttgcctggatgcgtcggctagagaaaagctacactacaagcccagccgttgcccatgttggcttgtggtaagtacgataagttctttcagggcatcccgcgaaccggtccttaactgccatgggtgcgaccaacaaaaccatgcacccacagcccaccatgtgatttattttaattaagcaacaccgaagcggtgtcactaatccaacattaccattagaacctacagtctaaacattaataggatttttccccaatgtgtgctagttgaactaagcatggctaagcaattcctattccaaagtctattcatgttataacccaagctaacaaaggagcatggtatcaaaatagca

SEQ ID NO: 23749 - DNA, 374 bp, Oryza sativa
tttgatttcactgaaacctttttatctcaatcacataaaggaaagagaagagctgatagaggaaaccttgctattgtcaaggtcactcctatgacaactaaacagaaacctgggagaaaaccaaaaaagaaaaaatgaaaggtattatttggaatattagaggaatgaaggatctagaaaaactgaaacatctgagagatattatgaaagaacacaaggttggttttattggattacaagaaacaatgaaacaagatttctctgtctattttctaaaaactttagggcaagggagggagtttatttgggattggatcccagcttctgggaggtctggagggattcttttgggtctagatggagaaaaatttaaa

SEQ ID NO: 23750 - DNA, 942 bp, Oryza sativa
caggtaagaaatcaatttctactgatcatcttgctcttgatatgcaaatcattcttctgctatagttgaaataagcagaagaacatggtacctgaagtaccatcctctgatatcctctcagcaatacacgataatatgatggcggctctgccgccgttatcgttcaattgctagagttgatacatcctctcagcaacgcccggtaacatgatggcggctctgccgccattaccgtccaaaggcttgagatggtacatcccattagcactattcgataacgcaatagcggctctgccgccgttatcgcccaaatgctagaggtgatgtaggtgcctgaagcaccagcatagcaacttaatgaacggctctgccgccgttgccgccaaatatcggaggcaaacgaaccttctgcacgaccctgaagtgtcgttatggatgtcctttgttttatggacatcacccatatgggcccttgatgccactaagtctgccgccatgaagcgtgggctcatagtggggaagtactacatggtttatcttactttttacagactgcacaatacacatgaagttgtgcccatgtatgctcttcgttttgttttacatgcttactttgctgtttgcatgactttcataacatttattttattgttatgaaattgatttcctagcatgattgataatatttaatcaagcaatctgtaatcctgaagattacttaagttaatttgctaggaaagattatatgggaaactgtgtgataatcctgaagattacacacactagtaatcctgaagattacgcatgaccaattcatgtcgaccctgcacatcgtatttacctgttgtaaataccaaatgatgttgcagaacatgtcagacatagcaaagaaggaattcgccgagcttgccttggatgatagtaactacctcacttgggcat

SEQ ID NO: 23751 - DNA, 1501 bp, Oryza sativa
accacgaggcgagctcggcaaccaggcaaggcgacgaccgtggaggcgagctcggcagcggcggctagggcgagccggcgacgagagaggaggcgaggtcggcggcggctagggcgagccggcgacgagagaggaggcgagctcggcggcaagagaggaggcgagctcggcggcgagagatgaggcgagccggcgacaaccggatctggggggcgccggcgagagagggcgagcggcggcgtccaaggagagagggcgagtggcggcggccgaggagagagggtacgaggcggcggcgaccggcgatttcgagaaggcgaacggcggccggcgatttcgagaaggcgagcggcggccgacgatttcgagatggcattttttttcttttttttgtttttctccttccccttttatttctttctgcttttttatttctatttagattttttttagtagattgataatttttgggtgagaatttggaggggtagactcaccacctctaatgaaagggtgattgcaaccactcatccatcccactcccccaaccaaacaaaaaaatggatcaccatatcaactttcatccctacaaccaaacaaaaaactggatcgccatattcactccaccaaacaaaaaactggaccgccatatcccatccaaccttgaccgggaaccaaacacacccttagttttatattaggtgtcatttagttttaaattgcctattcacccctcccccccccctcccctctagtcgacatctcgatcctacaagtgcccaactctagtggtagtcgacatctcgatccacacttcttattaatgtgtcgctattagtactgctagaatcatataaatagacactctaaataaagaatagaatgttacaataagcacctgctctaggcttttagcaacatatgtgaacctataatttgggcataatgtatctcctattaaccagggctagctaaaccctaatgtaaagcatatgagctaaccagtgcatcaacactttttcttcagctttataacaaacctattattagtgtcataattagaacttaaatacttgcagatgtacaaatatcaagcacctgcaactgcaagaaattttaatgttggtttctggatacctggatgatattgatcacttgttttaatgcccaaccaactagagttgaaataaaaacgaagaaagtgagaggacttccctttagaaagcatctgcacacctgttgcatatagaaataccagatgttaactactgcaacaagacttgattgtattaagcaacagtagagatgatcgtcttcttacattaagcaagcttgtcgatttctcatcagcaaacagaaaaagaattatgtacagaacctgtaattttataaacttcctatgttagaaggtgaaacatttaagtgcagtttagtcaagagtgtataagggtgctagacatacagagatggtgactcctcaactatatcaaatgactatttg

SEQ ID NO: 23752 - DNA, 1501 bp, Oryza sativa
gttggatcaaagggttcaaatgttggaaagcacccatgcctttgtgtatcaccgtcgccgcgatgctcctcgcccttcctcttcggctcgtcctcctcctcaagagtgaagcttttttttcccttgatgccaaaagggggagaagaatctagcttgcattttctttagtgggatgggagtagtggtagtgaggttagtcacctcatatttagtaggttaaggtgaatggtgtactgttttgtgggatgagagtagtggtagtgaggttagttacatatttagtaggttaaggtggatgggctatattatgtatgtgtattgggctatatcttgtgtttttttcgttttgaactctatgttatttggacccttcgtggtcatgtaatagcctaggttattatttgtgagccctctttggacaatttgtgacttggatgatatatggatgaacttctataatttggaaggttatggatgtgaatttgtgctatgatggacggtggatgtgattttgatatattcgtgaccatcctatgcaattgaatgatctatatgtgaagttcacattatatggtgtttttgtgttgagctatgctgaaatgtgcatttgttcctaatttgtttattgtgattgatatgcacatgtttaggggaagcatttgcttttcaatgcaatatatccatgtgctttaaatttgattatatatgttttaggtgtttgccatcaattaccaaaaaggggggattgaagcatctaggcccccgttgttagttttggtaattaatgacaaacgctaattatggactaaccgttatatcgagttatatgttttgagttaggtttacatcatatgtgcgcatggatgattatcgatggtggactaaaaattgatgggggcaaagcaaaggatagatgacagtaaactagtagttgaattttaattcgatcgaggagtttgggtgatcaaaattgtgctagtttatttatagctttgccgtactattaagggggttaatgacctagcaaagagatgatttaaattgccacattaggtcactatgcatttagacttgtgttcgcatttagactcaaatttcacatcaccttaatgcttgttgtctctgtgtggactgaccaggaccggtcagaccaaggcttgtatgccggtctgaccggcggttagaggctggtctgaccgccggctataggccgatctgaccggccccctggtagtcgagaggcgtgctctggagtggccgatctagagccaccggagctgtattcggtcagaccgagctgggggcggtctgaccgagccgaggccggtctgatcggccaccctatgtcggtctgaccggccaggcagttggagcccaatgtcaggccggctagaaaactagccgttgtagagtagaacggtctgaccggccacacacctccggtcagaccggcagtacacaaaattgggggatttcgcccccaacagctagttttggtggg

SEQ ID NO: 23753 - DNA, 666 bp, Oryza sativa
attaaggaggtgacaatccttcgttaagttctcaaagaaaaaacaatccttcattaagctagcatttgtgggctaatagcaaccataataaaattagtacataatctttcataggctgctagcaaccatcaagaaagggtgcatccaggagcagtgccagagtctgctttcattgctactaataggagagaaggggttcaaccaccactaaccacatcaacaaaagagggcagggccacattgaggaagagaagtgcagcacccaagaagaaaaactctcccaagaaaaagaaacagtagtttatactatgcactcagttatgcatttagttttcgttcaagttattcactgaattttattcaggatctcagtttctgttcaaaatatgcactcagaagtttcattgtgttcagattttgtcacaatgtgtacaattaagcattacattccttgctgcttcagtggatttaatgttcatgcggttaatctgacggcacaatggcttaattccttgctgcttcaatgtctgcactgaagcattggagctaggcttcaaagttgctatatgaattgtcagtctgagataaccgatgttggcctaaagcaaggcactcatatgcctaccgcagcatcaaaataaactaaaacttgattactgttgcagc

SEQ ID NO: 23754 - DNA, 665 bp, Oryza sativa
cagcgtctaacctggataccacgagttaatgttggcactgacagctcgtgcagcgtcggcctattagagacatacgtaagcatgttagtaccaatcggacaaaagaaaaagaaagaattgagcaggagttcgacttaccccgaggaagtagtttcggtcacagtgcgtggggtactcatctgtgacagcggcaacatgcggctatggcacggtaggagtaaaggtctattaatagtgaaatttggtaagccacaaaatcatcatcgaactggagtcagtatcggcttcagaatcctgaatcggctggtgggaattatcaagtcaccaatagattatgctcaaaggaaaaagggtgttcctgttcaaattcggaccgttctttctaaaagagattgcatattttcccagggagaatttaacagattgcagagattgttaatcattaatcatcatggttatgtgcgggatataaaccatttccattatctaaaagaatcattgtggttaggtacagtcagtgagtcgtttcaaacaatattacagtcagtgagccaataggagtgtttgtttgttgaaatttgctccggtccaataaaaagtacctcgaggaactagtacctcacggtactaaatcattttcgatcactggacctaattggacaaga

SEQ ID NO: 23755 - DNA, 1501 bp, Oryza sativa
tatatagaagttgttttaaaaattcaaataaatccattttttaagtttataattatcaatacttaattaatcatgtgttaatgagctttctcgtttcgcgtgcgctaaaaatgtctctcaaacttgaggcaaagaacacagccttagccagattcaaactgataatttgaaataaacatgttagctctcaagatagttagataaaaccttcggtaaaaagaaaaggtaattagataaaactttaaaatgtataaggtttccaaattttgcgcacgaattagagcttagaagctgactctacaacatactgggaattcatattctgaaaagtatagcatggtcaattacaaattcctgaagtgctggtggaagactgaaaatattcgtaagtatagcatgatttcagctctcaattagaaacaatagcttccccagaacacaatcctacagttgaacaaaagtatggcactgcaagaatttcagaagtgacgtgttcagatgacggattaatcacagcattgtgaaacacatcatattctttgaggcaggttcatccctggtggcagtattgtcatcttctcgtgcccctgaaggcctcttactattgtttggacattaaaattacatagttagtgatgataaatcagatattgaagtagatattccaagccagacgagtagacaggcaaaccctggcacaaatgcaaccaagcaaggtctctagaaaacgaagactttcctttttggcaaggatagcaatgaggaaactcggacagcaaagatacattaatttcgccatccatccttaatagtttaaagacaacatgatagtttaaagatgtcgcttgtctatgtcattactgactgaaaggtcatatcccaagatacatgtaaagaaaagctgttgagcgacctggtcaacatgtacaatgggttttaacttgaacttgcaagcactaccaagttccctaacgcaagcatctcatccgaaattaattttcttatttaacaaatcatatttcacgaagaatccaacttacaggtactttaggctactatcgtactgctgaaggtcaattgatcctgacaagttgtttgatctcaaatctctgcaaacataaggcaaattgagagagtaagagagagaaacaggcagagaaggagagaatcatcgcaaataaaaacagtagttatttcaatgttcacattcattgtaatattgaagattaatatcagaatacatggtttattgtattgtaacgtttttttgaacaacaacaaaatcaaataggcataggcttctgcagccaaatttaaagttgttgcctgcaaggtgcattgacagcccacccccctcttttcccaaattgaagtgtttgagattccaattatgtttcggtttgattaacataagatttagtcgttctttgaaactctattagaagatggggtcacgatggttctgagatcaagcaccctcatgctactaagcaacatcacc

SEQ ID NO: 23756 - DNA, 1501 bp, Oryza sativa
ccattattcgcaacactgtcagcatcctccctctgcagtatatccctcctttctgcacagaccttattgaccgcattgacaatctcagaagtggagttgtatggcatgcaaacagagaagaccagtcccgtgttttcagcagtggtagccatcagtttctcagctgctaccctcactgatttgctcaacatgtccaagttcccccagaagttgatcttacagttaaccttgttgatgacatttctgttttctagcagttcattgatcttttcctccattaactccatcaaggatttcacctcagtcggatctcgcttaaaattatcgatgctaaatgcatacaccgtgatatacttcacgcccatttcatagcagtagagcaggctggcaatgagagcagagaagcccaccctgtgaccagagccttcctggatactcctgaatttagcatatctacggttaccatccataataaatgcaatatgcttaggcattgggccatacgagaggacagctacaatgcatttgcggatgaaattctgcagactagcaagaacaccagtcgcaattaactcatcagtgttctccgtctttgaatcctaaaccaaaaaagtaaaactcaagtataagaatatcagcgaatgacacagctaagcacaaaggaaaagtcgcagctctttgattatctttacatgactaataatacctccacctggatacttgttctacataagagatttaactatatatcactgcatatgaatctaaaacataccactgaaggtgagtaagacataagtgagccaagcattttgatggggaggaaccaacaagcagtatcagacctgcaaactggaaaagaaataaaattttcagatttgcttgctcgggtcaagaaaaagaaggggcacgtgtttgccataagaacaggatacattaaaaggctatagattactatctattttaagcatgttttcctgtagggaatactaatttcagaagaatggataccaaaaatgattgatatttaatataagttctctggaaaatacatcaaactctttatatttagcaaagttttagcagggagtatttgatagttaaactgaaaggtatagcctttggatttaccatactatattttgattgacttcacttaaatttcctaacaaagtgagacaaagatgatggctagctatgcagatgttggggctccaatccacgtgtgtatatcgggaagatttcccatcaactgaagttatgatgatgtaatactcatgggataaaggcaaaaatagcatacttttccagagtttggaacacaagacaacaaataaagcacctgcacttctctttcattaacaagataagcacactttttagctatcgaaatccctatgcccttgtaggctaaagaaagctttcacaaaaagggaggaatttctagccagaagcttctaacaacgactagtaataacaagcacaagtgagcaatcaatcc

SEQ ID NO: 23757 - DNA, 350 bp, Oryza sativa
catccaccccaccccaccccacccaccgttttcccctctcctcccatccccccgcacccatctcgccgtcctcctcctcctcacctcacctcgccccggatcccccatccacctcgcgacctctcctctcccctccccggcgcttcacccacggtagcaatcactcccccccaaaaccctagcccctccgatccgcccgccgctcgctggcccttccgagtcccggatcggcgcggcggccagatctgctttccccgttcgatctgactcggtttctctcttttccatccgcgtgtgtggtgtggtgttgggtttggttggtgggtgtgggtgtgtgtgtctccaggcga

SEQ ID NO: 23758 - DNA, 1240 bp, Oryza sativa
ttcctgcagcccagagaaacagagaagaaactgtcaatcgattcaacgtacgattcagcagttgacttaggggcataaacgtccgagaaaaactaaaattgatgaaaaatatttttgaaatagaaaaaggcccgaaggtggcatttcagcgaatgcccccagattgatagtggcatttggttgaatcccattttgagagtgccattctagcgaagctagttttttcgagtagcatatatgcaaatttctcttaagttttatgattccctatataagatggtttattgcaaataacccctcttaattcaccagtttgatacctctccccaattgcctttgcttgtgtgtttcttttttgtctttccgcatgtgttatacaatttagtgcatatattgatgtacatgtccctaaacatatctcaccgaaccccaagaggcaagcgcaacagttcattagtgactaagatgtccaagagtgaagactcatgacaaccactgtccaatgaagtgttgggcgccatcactgggaatgccacaatcatatcatatagggcatgacttatgagtgacaaccatagctcctcatctaatagtattcatatgagcgtatatgggtgtatatggggtttgcgattacaagaatgggcaagcaacaacattttgggggtggggggatttcaaaagcaaaggtgagttaggagagagaagtggtatttgcagcaaaccctttttaggggaaaatcttaaactcagaacgatatctatcatcatttttgcaattttgtacgcatgttaagtccaagatgacttccttaaatataggttggatctaattcatatccctcaaccgtaaaatcatgtataatgtcccaagtattaaaaccattcaaaacgacttcctaggctgtttcgagagtggttttggtgacgtggtgtctacatgacaatccaatcatcaataaatttaaaaaaatagtaggcctgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctattttgtaatcctgccccccatcctatataaggtgggcaggaggcctctagggggca

SEQ ID NO: 23759 - DNA, 1501 bp, Oryza sativa
atttggagtctagccaagtgcaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggtgacaccgatgtagggcacgcctctcggccctacctcaacggctgtcccattgtagcgcacctgcctcactcaggggtgaaccatctatgcagggatactgcctccgctcggctatctaatccgctaggtctatacccattcgagaagtacggttgtacgggggtcgtttcacgcttaactccatggctcggtccttaattgaccgggaacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcagttgtcataattgactagggactcatacgtaaacatggttacgaaggaataaggggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaagctgcatacgttgcctcacgactaaccgatatacaaattctataatacgcgagaaaaaccaatattcaaataacaatcaaatatgtacaaacaaaatatatttgttgaggtcgaacctaaggttgctcatattattcgcgtttgctaatggattccaacatgctaagggctacttaatctttctgttgtcttggtggtctattcaggagctaatcaatgtagtataaatgagatacgtatctggctaatatgtggtgtagtctagctaatggctatggaaggattatggctacacatgcatctacctaaataaaatggtcgtatactagaggttctgttgtcggatggatttaggatcaatcaaataatgaatcatttgtattattatttaattgatggaggctttactttaattatgaacatatttcacttgtcgcaataaattacaaaaggttaataatcatcca

SEQ ID NO: 23760 - DNA, 785 bp, Oryza sativa
ccctactcctgtttggggatttgaatccgctgggtgtgtattgatctgacgatcaggttgtctcatgccccctagaggcctcctgcccaccttatataggatggggggcaggattacaaaatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaggcctactatttttttaaatttattgatgattggattgtcatgtagacaccacgtcaccaaaaccactctcgaaacagcctaggaagtcgttttgaatggttttaatacttgggacattatacatgattttacggttgagggatatgaattagatccaacctatatttaaggaagtcatcttggacttaacatgcgtacaaaattgcaaaaatgatgatagatatcgttctgagtttaagattttcccctaaaaagggtttgctgcaaataccacttctctctcctaactcacctttgcttttgaaatccccccacccccaaaatgttgttgcttgcccattcttgtaatcgcaaaccccatatacacccatatacgctcatatgaatactattagatgaggagctatggttgtcactcataagtcatgccctatatgatatgattgtggcattcccagtga

SEQ ID NO: 23761 - DNA, 1501 bp, Oryza sativa
ccgctgcaggaggagggcgtcggcggcgcgggagtaggcgctgcatgtgacgcgaggccacaaagcgcgggtggtggttgttcttcatcccgacgatggttctccatcccaatgacaattctcctccatcttcaactctcgcaccgctgccaacgctgctcctggccctctcctcgccgttgccgccttaccgcgaaggggatggcgagcttgagctcgctggctccctcgccttcctcctccccgccactcctgctcacctcctctgccatcacggaccaccacggccctcctcgctggctgcccaccaccactgctaccttaactaagttggggaatgcgatgtatctagttttgcggtccagtgatgaatttcaggctcgacgacaaattgagagacctaaattaaatttattccaatatgcctcggctaactgcaaagtcgcaggcccataaaataggctcaacaagacagcatgtaaccttagattcctttgggctccagcggtctagctgagtagctgccctcagtcccccgaaccacgacgccgcccggacgcccgacgcggcgaccccgaacggccgaagtgtcgacctcgccgcactctgtcaccttgcgggctctcggcgaaaaggcgggagacggaggccagagccctaagttgcgaggtggttagcccctgagccctctttcctccacggaccaagccaccacctggcaagtttcttcttaaatctcccaaccaatcttccatttgttttgttttaaactgagtagtcattgaattagttgtagagctagaaatttgaaaaatgaaaaagaagacaataggtttgaagtcgctaaatcaacccaatgtgtcactgaatcatttgctgtttaggacaagggaaatttggttaaacttgtttagttgtatcctaaaaatttctctaatttagagttgatgtatctcccatttcaactccaccactgatatatgtaaagataaaaggttttcaaaaatgtaaaatctggttgaactttatatcttgtttgttgaaacgaagaaacaccttagttatgaacttatcttccggtgaaaaaacatctcaaattcgtgctaattcttccagtggcaattgcagtgtttaaagagtgttatcttcgctgaatcacgtgaagaataagctatgaaaaagaataggagtgcaatatatgaaattttgaagattgcatacctacctttcttagcgtggctttttgtgcaaattaaggacggtcacatcacttctcgctttcgaaaccatggcacaaagttaaattgtacttttcttcaagtgttatgtaattcattgaaactacgtgagacatctccagaatgaactattagtgctactatgtgtactctaaaacatctcagttttgtttcttttcatatgaaacagttcttttaactcattatattcagctgcaaaatcctttgtccgtcacaattgcccatggactctgctgtcgatg

SEQ ID NO: 23762 - DNA, 1501 bp, Oryza sativa
tatttatcatgtaatccctccgtttcacaatgtaaatcattctagtattttccatattcatgttgatgttaatgaatctagatagatatatatgtctagattcattaacatcaatatgaatgtgggaaatgctagaatgacttacattgtgaaacgaaggaagtagtatattgtatggttcgatatagctgtagtagataaaaaatgtttgcgtataatggtgcatttgatatgaaggagacatgtttaggtagtacgcagccataactatattgggttccatataagtagtagctgtttgaacagcatttcacagcatagaaggtggcaaggtaaatataacattacttatttacaatgataatcatgacctaggggtcatgaacaaaaaggcttgcttcttagcctcctctgggcttgcagctaacttgttgcttctacacttctagcttgggtggttcgttctgtacatatacacaaaaggcttgctgatggactgcatatatccatatcattcactgcaggaatgaatgatgagtttagaaatttagtgaagtttactaaagaattgatgtgtatgtgtggagaggtgagctgagttattcagaattaacctgtcagtgggtttcttctgggtactatccttgaacaattttttttggcaattgtggtggtttctgcaggtctagctctgttcattataaggatatgtcaaatacaatgtgtgcaagaaatgtttattattgtaactttgaactgaaagttttacagacctttttttgggtgtgctctttggcgccagtgaaggatctgcctgtggagactcatctggagattcagtggtgacctttgccttgtagaagaagtattttttttcagaaattgatggattaggttatgaaaagaaagagcaggaataccttatccgaagtatcatggggaacaattgcaattaaagatgcactttgtgagatcttctcttcatgatgtgtgccaatttttgccttgcacagttagtcaataggtcagagtgtatctccagatatttaggaaaattaggttatagcagaggaagtgcaagagtaggcattgagaaggataccttactatcggtagaggtctttgcagtgtgagatggcatagagttagcttgagacaataatgcttttttttttggtaaatactaaggagcttgatttgctagttggtgtctcatctgttgcagcaggaggagtgtattttgttggtgttgaagtaccctgtgctggtatgatggctaattgtgattgggtgcttgttagtaaacaagttaatgttcatacctaaacatttaaaaaaaattcatactcatttaaattaggtatatactcaatttgaatcttggagcccgggctccatggtgccccagttaattttactatatatatatatatatatatatatatatatatatatatatatatatatatatatatacatacacacatatatatatatatac

SEQ ID NO: 23763 - DNA, 1501 bp, Oryza sativa
ttaacattctatctaacttctcataagttggcagtgctagattattggctcaagtaaaatttcttccagatattaaaagttctctaagattaagatcatctataatagcattaaatggaaagggctatctattatcaaaattgtcattattctttttcataggactacataaaatattaaaatcactaccaatgataattggtaaggttttatgactgcacatataaactaactcagaaaagaaagaaagtgttccttaaattcattttgtgctggcccgtacaccaaaactaaagcccatttaaacttatcaatcttattacaaagatgaaacttaatataataatcaccctcatcaattaagccaatatcaaaagtctgtaatttttatagccaaataatttgatgtgctcaaacgctaaacctttacttgaagcaccgctggtcagatcagcagctgcctgaggcgcaacaaatctgaataaagaagatacatttaattagatagaaggtccttattcagaacaagaggaaactggcgagaactttcactaaatcagatatgaaatccaatttctgacgtccatgaaccataatacactaaaatttcgccagcatatacaaggaatttcagtgaaaaaaatccatttcaccaaaaattctgcaaaccatattcaaggaattaacaaagcaatacacaatctacatcaaacagataagcaagtactgaattgcaacaaacacatgatggatatcttgtgattcttgcgaggaagaagaagaaagaatcgctgcagacctggaatctcgcgtgagttgccgaacaatttctgcccggcgttggtgggatcctctcgcctcaaaacctaccgattcaatggacctgaagagattcgaatgtgcaagaattagaactcagaatcaacagtttcaatggatctatcagaaggcacctcggcaggtgcagcattgccgagcggcggatcgcatggcacgacctgtcttctgaatcatcaagaaaaccatcaacgtagatcaccaactgatccttctcgcagttgagatataagaaagaagaaagaatcgctgcatcattgcagacctggaatcttgcacgagttgccaaacaatttccgcccggcgttggtggtctcctctcgcctcaaaaccaatcgattcaatggacttaaagagattcgaatgtacaagaattagaactcagaatcacagtttcaacggatctaccagaagagcacgcagctcggcaggtgcagcatcgccgagcggcggatcgcatggcacgccctgtcttctgaatcatagaaaaccatcaatgtagataactaactgatccttcttgcagttgagatataaagagtgcacgagctctggatcaagccgcttgggcatcgtcgatcttgaggagaaagcccctctatttgcgatcgtgccaagaaagaaaataaagaaaatgaacaacagaacgtgaatggggaggaga

SEQ ID NO: 23764 - DNA, 1501 bp, Oryza sativa
aatttctcatcatcactataagtaacaggtaaaaacttatgatggccatacctttgacactttagcagttgctctccctcctgcatgtaaatactttggaaacttcagcatatagaaagcaaatctcccattttggaccagcatctctattcctttactcatatgccaccgaaggacagtatgaagaaccatcgcatcattcagaactagtgtccgagatccaagttaaacaagcattaataccaatatttgtttcaaagtgaatcgattagaagattgagttgagtcaaagtaatgcctctctgtgttttaatgtgattttgttgctaaaactacttaattaatgctgaactaaagcaggggaaagaacacagcgttatgcaatccaatactccaaataatttttttgcaagcgataccaaattaccaagtgattatctttctgaacaaagtatacaacaatcccaaagtatcatcatcagaattttttcctaaaaatctgcaaaaaaaaaagttaccttcaacaatactcatctgtatttttgtgccttcttgaagctaaaattccaaatgtagtcatcagatggaatggaatcagtagcaaaaaagaatttataatgagcccttaatgatcgacatattggtattgattgatccacagaggttcacaaatcatcaaattgattatcagatctgcatcatgcaagtattggtattagcattttgtcaaacaactagtacgatggttcattcctgaagcagaaagaacgaaaggtacagatcaatatttactcttttatacttctgcaggattacgaaataatccgatggggtagaactcaacataaagtctggacaaattgaatcacacaaacaaatcaaagcacctttgtagttccttaagccttacagattaggggatgagagagcatacctaccaagctaccaccgtggagttgttgctgggctggtgaaggcaactgagggagggacgcgttggcgatggggagtcgctgattaggcggcaaactgccagcggtggctcccatggcgaggatcagagcaggcagtggtgggcggcggcctgaggaggaggaggcagatgtggcattgactcgccgaggatgaggcgccgctggcccccggtcgaggacgagccggcggcaggcatcgagatggcgactggtggaagataggcggcggcaccaagcaggcagttcgatctagatgggagtttgttgcagcacgcagagaggatgaggacgtgggtggtttccaggagaaaaaaaaattcaatccaaatcttaatttttgagaaatcaatgtaaaactagggcgttatttaaaacgtctcataaaccgtctttattggtggggtagcctagaaaatagagacgatttaagtctcgtctccagccaaaggtcttcatttgtttgttttgttgtagtgagtgagaagctttctggctcttagtgagtaataactactgatctccaatgg

SEQ ID NO: 23765 - DNA, 1501 bp, Oryza sativa
ttcaacaatcaaaattgtatgtatagatagattcttgttgataacctttataattttaggtgctgaaaagttgtaattttagtcgagaagcatttttatggtgctaagtaaatgggaaaaataaacaagatcagtttaagtgttgatatttttctatttctaagaacatatatatgaattgttatcaatggtcatttctctctatgattagatttgaaaacacactttgaaaatgaaggggttgtttagattgtagctaaaataaatcttactaaattttggcaatgccaaaattttgacaatttagcaatattgtcaagttttggtaggatttggtaaaaaaactaaataaatgtatatttttgacaactttaccaaaaattgatatggtttaaaatgatatcaatctgaacaacccaaaaaattgtgaatatacatataacaagtctcactgtaggggagagagggttaagggtcatcttgtcaagtttgcgctagggccctcaaaacttaaagccggccctgcacccatgcaggagaactaatccgaaggatggggattcacattttgaaagattaaagcatttctctgcttccaaatatgccaacattcaatagaaaaaaattccaagaagctttttcctctaaagcgcaaccttgccaaaaccaccatctgaaaaaaaaaattccatgttaagattccaagtaaaaccaatcttcctccaacaagtatcactgaatgggcaagaaaagaatagatgttctatagtttccctcacactcagagaacagagagcacaagttagatctgcatcctcatgagcacaatttctcctgtccaacatgtccctagtgttaagacggtcacaaaagagaagccacataaagactttgatcttgttcacacagttcgttttccaattccaaacaaatggtctaggtggagagcgaccaatgaaattcaggccataaaacctttgcgaagaatatgtactgttatcccaaatgaaagacatgcatctcctgaagcattagacagaagcagcctttgcaataattcctgtaaaaccgaaaactcttcatatgactgcgatgagaggggcagttggaaacaatcttcaaactccctttgagcaaagcttttcacagagtcagttttataaaggcactgattgtaaaggctctcaaaatactgacatctgactattccattccacatgtcctcccaaagagtgactgaattaccattaacaactgtacattgtgcccctgctctgtaaatatcaatcaagcttatgatatctttccaccagaaagaacccctattaagtgccacattgcctgcaccatccaagtaaattctatgttgtcactatgaatgagaccttcatgaagcaagacagagtggttagctcttttatctacttctcatccttttataccttaaattaacaactaacactcaatttccattacagtacttttcaaaagagttctctgt

SEQ ID NO: 23766 - DNA, 1501 bp, Oryza sativa
acatacagaagggccagcgaaaccattgggggatctcgatcttcctgatctataaattggatggtcaaatatatgtgagatagaaagctagcaataatactcagcaggtagctagtagtaaagctagcttaagcgaaattgcatggcacagtcacatctgtatccatgaacttgggcatggaagacatcgagactattcttgtgcctgtgcactggcatcctctcccgggttgatcctttagttctgtggtgaaaattgcagggttccaacacctgtcaaatatatagttggcagagtgctgtctattaacatgcatcgcttacccctgcgatggtgatttttgagaatgttaacgatggttcgtttatttgttgtccttttcgagctttgtggtcgatcgtctggaagcaggtgcagatggtgcgaagaaaggatgggatggcgtcttcttgtcccagtttgcaactggaagaggatgcatgttagtagttctttgagcatgcgtactcctgaattctctctgttttagctcttatctttctggaaaccttgtagaaactcagtgctcatttctttaatggaaatgggggaggactcgttctctttttcttaaaaagacaaacagaaaatgttaaccaattcagttaattagcatgacaatgagggagaaggagaatagatatggttgagttaattatagaaatcattctggtgattggatttaatcagtgtcttcttgggaagtgcaactaataaaagttacacttttttttctaataattgtggttttagactcaataactgttgtttctcctctcaccctattcattcgaggtaatattctaatagcaaaagaaaaattatgcttttaacagaccccacctgctatatcattgcaaatttgaagtataatctacatacaagcatatatatttcttttaaaaaagataagtttaaatccgagtaatgtaattttattcaaatgataatagcaaattatagggccgcagaaaatattataattattgtactaacattaccaatagactgattgttggtcaaaactaagtttataaaaaaaataataatattttcgacccaagataaatttattataaaaatatatttaattattaatttaataaaactaatttggtaatataaatattattatatttgtctataaacttagtcaaatttaaaacagtttgattttgactaaagttaaaacatgttataacctgaaactgaggcattatgcaactaggaactgctgaaactatatgacgtgaagttttaactcgtataatgcaatcttccacctacaaatatagctagctgggcagccaaaggaaaactaaaaagaaagaaagacagtggtcgaatagaccaacatgttagatttaattgggtaattaatccatttaaatcaaataaattccaaggctcattatgctaggaattcatgtgaattcattcttctatgggatatcaatggga

SEQ ID NO: 23767 - DNA, 1282 bp, Oryza sativa
atctatgccgttgattgccgattcaacgatcccacggctgagaaagggccgccatagtggacatgtggacggttagatcggctctaccgcgagatcgaacggacgatgttggtggaaaccagtatgtaattaccaaaaatacagggttttttttgtaaatttgctgacgtggcgcccctaatcttcaaccgatcccacgggttttaagtaaacctatatatgtactccatggttaagtccgtcaaacttaattatagcacactggcgcatgcacatttggatccatgcatcgatctacttagaaatggaaggtatcaggactattttctccggcgtctcagctgactacggtgaaactataacgtgggagttctctgttgctatctaacacttttgctcgatcgtcccacattgttcacgcccgtctcccaaatcccaatcccagcgcatggctcccgccttctcccagcgtgtagctaccgcgccgcactttattggatcgcgatttcaaggaataagcagccgcattgttcctggaaatcgctaatcaccctgcttgttttattataacaagtcccgtatggatattcctgctgaaagaaaatctctatctgatttttttctaatactaattttaatttagcagaacgttcttttttcatttatttttgaataccagtttcatttgggaggatggtgatttcagtttatttctagtaacaattttaatcatacagaaaaatgttcttagttttgcataacagtaatgatattcccattgtttgctttgtttgccagaagttggaatgcactttcaatttttttaatactagaaaaaatacatgtgcgttgcaacgggcgaaggctatttttaatcttattattgttcaatgtgaaattcagtgtgagaattcacttggatatatatttttctagaaaatcatgtcaagttagcatgcgagtttttttaaaaaagatttcttatacgactcttttttatttccaaaagcgaacaaacttaaaattccactcaaatacggatatgtattttcaaaacagtacaaatttaaaaaccgacttatacatagatgacgtactaaagaaccggtaaaaatatcttcaactttttataatagtagagactagttttagtataatttatctaattttgttcattgtgtactgattttaatttgacgggacgctgtccattttgtcctccttaattttaattttgtagaactggtaattttgtccacattgtttacttttttaccataga

SEQ ID NO: 23768 - DNA, 1342 bp, Oryza sativa
gcctactttcccaacgcgtgtgcacacctcgtcggatgggattaccgtaccagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaattccttaatcaaatggattaattctcaaaactcttcatcccattgatatcccatagaagaatgaattcacatgaattcctagcataatgagccttggaatttatttgatttaaatggattaattacccaattaaatctaacatgttggtctattcgaccactgtctttctttctttttagttttcctttggctgcccagctagctatatttgtaggtggaagattgcattatacgagttaaaacttcacgtcatatagtttcagcagttcctagttgcataatgcctcagtttcaggttataacatgttttaactttagtcaaaatcaaactgttttaaatttgactaagtttatagacaaatataataatatttatattaccaaattagttttattaaattaataattaaatatatttttataataaatttatcttgggtcgaaaatattattattttttttataaacttagttttgaccaacaatcagtctattggtaatgttagtacaataattataatattttctgcggccctataatttgctattatcatttgaataaaattacattactcggatttaaacttatcttttttaaaagaaatatatatgcttgtatgtagattatacttcaaatttgcaatgatatagcaggtggggtctgttaaaagcataatttttcttttgctattagaatattacctcgaatgaatagggtgagaggagaaacaacagttattgagtctaaaaccacaattattagaaaaaaaagtgtaacttttattagttgcacttcccaagaagacactgattaaatccaatcaccagaatgatttctataattaactcaaccatatctattctccttctccctcattgtcatgctaattaactgaattggttaacattttctgtttgtctttttaagaaaaagagaacgagtcctcccccatttccattaaagaaatgagcactgagtttctacaaggtttccagaaagataagagctaaaacagagagaattcaggagtacgcatgctcaaagaactactaacatgcatcctcttccagt

SEQ ID NO: 23769 - DNA, 1501 bp, Oryza sativa
ctctcctctcatctccaggccacccaccgcctccctcttcctctccctatcctcggtgagctacagatccggttcgggggtcatcggaatcgatggtctcggccattggtctcctcgccggtgaatcgttttgatacccttctgcatacatttagcacaaaatccacatggtaaggcaatggttttgacttgccattaagcatttgcattgcgtttgctggtgtttttacatgatcccccatcttgccttaggttctgtggagaaattgatgggctaggatgaggtgtaagtcgcagattacagagaggacgactttcattctgcgcatctaccgtcatactgaacaagttatcgagctttctcctctcttaatcagggcgtgcgatatttagattatggtgagtttttcttgagttcagattatttcatatgaatttagctgtcagaagttcgatggttattggttttgttgctgcattgtatggcactccttgatagaataacatcaggaagaaaaaagaataccatgataggtgttacaaggctataagtataaggtaatatgagagcattctgcaaacaggatatgcaatggaaggatattctttttattaactttggtaaaatacctgccaatagcccattattgacatcaaaaccccctagctctaatactgggagcataacacgctgatagacagtgtgcaaagcttttactggtgtctaatttgttgcacaaaattattactacttcaccggatttatgtggtttgttgtgttggtccagttcagcaaagaaagttggtaggatcatggagaaaatgaatcgtatggttattttttcattgcttggtggtgtttcacacaactcaatctgctgccatatatccataaaacaaaacattcagaaatgtagttatttagtactatcctaaaacttacattctgccaaaaaaaataacttttagcgtgcctgttatttttataatttaatgtgtaaatgatgaagagtgcaagcatctaattttctcctctgccttgacacaagagtttaggccactagaatgtcctagcagcactgaaaatactctatgcatataagcatataaattttccatgtggcacgtgtccacttatgccacattgcttctggttatgtgcacacacatattcaaagggccaaataaatatatatggtaccctgcctcaaggtccacttcaatccatttttatattggtagggggccttagcctaataaaagtatcccatattcctactatcttctgttaggctttcacatttaactattttattttgtcgacatcgtttaacttggtgttttttccccttttcctaagtggttggttgatactattacaatagtatagatacacataatggagccatgtttcaggttagaacttccaatctgcatcttttattgttatgttcaccttcaaattttcatgatgttcaaatgtgcttagaaaatcaagaac

SEQ ID NO: 23770 - DNA, 341 bp, Oryza sativa
tgttataccgtaccagatcaaatatcctcaggtctttcttagggtcaagatgatccgcggtataaaagggacccccagggaggagtgaggggtatccaattcaactaccaacacacccaccatagtttgcaaagccggagtacacgaagccaatttgccgggagatctcgtcgaaaccctcgactacgatctcgtcggtattatttgtctcgactactctctttgtaatctgttatcaccatcataaattccataaaaactggactagggctattacctgatcaggggcctgaaccagtataatccttatcttttgtctgcttgatgtcatacttcgtaga

SEQ ID NO: 23771 - DNA, 1501 bp, Oryza sativa
aaaacccagagctaagaaggaacgaacagaggaggaaaagaagttcaggcgaaaagcaaagtatttccttgcgacacagctcgttgcggttcttctattcctatcgctcatgggtggagccgatagctcagagctagacgatgaggacggtgtagattatgaagattaaatcctccctttgttgtactgcacgattctttctgaagtgttaatttgccaaagcaccggttgtggtgcttgaaaatgttcttcccatggttagtcagagagatcgcatacttcatcatattgtagttagcaatacactgagttggtcagcagccggcagttccatagttttggtacttcaaaagtaaaacataatctgtggaattttgtattggtttcgttggacgcaactgtaagcatatgcaaagtagttgtgccgaatgccctttgccctggagatttgctaaataaacgaagtaccttttgaaagtctatgccagtttttgttttgaaagttcatatcagccctttgccctggagtttacatacaaataaactcagtctcaatcctcaagcccaattatcagaaaggatgccagcaacttcgtactaatacaaattcacactaaattaaaatgcacagaatcctcttcggcgttcatctcttcgagccgggccagctggccggagaccggctcgccggcgtctatggccgccaggagatcgttggtgagctcttcaaccggacgttgtttctcgctgatgccggcgactacatcagtgagctgagtacgggaccatgagtccatgacgtacacaagcccagctcttgctcttacctcatgttttattcttcctgtgttgaattcctacaatttttcatgtatgactatcaaacagtagtttcgaagctttcccgtgtttccaaaatcaaatccaatatgaatccaatgaacgtgatattttattcctacgtttttcctattcctgtactttaacaatcctgtgtttcaaagggtacctaatcgatcgtgattgaaaaacataaactaattcaaactacccctaaaacaaacagaagcctcgttctcatcttgtcatgataaacggtaaatctaattggagaggccactccaattagtcttaaccagagacacccacgtgctagtactttaggagttttggttgctattaattcattgggcaagtaggagaaatattcctatcatctatacttcaaataaaattttctcttaaattactaatccgattacaccgttgtgttcgtaataattaaatctttacaataagatctcacatgattatattttgatgaaaaatcacaaattacttttatgatatgtctaacttacttttagatttcactaagttacttcttagacatataaaagtaaattcagtaaagcttaaaagtaatttacatatattatagaaataacttataacaaaaagaaagtaactttaattaatgccttttttcattgaacaaatt

SEQ ID NO: 23772 - DNA, 609 bp, Oryza sativa
tcttatcctaattgtcttggtcgcttcatcccaatcgtggaaatcgcttaatagtaaatggtggcacatatgaatatagaggccgggtttctatctattattaagaaacaatgtttgaaaaataattgtgttctcatattcactgttaactatttttagaatttttcataaagtcaactgtttattgataaaggaataattttcaaacaaaaaaatcattcctataaatattttaatatataaaataaaaaataaaaaaaatcaagggataaagcaaacaaaaacatactccctccgtcccacaatataaaagattttgagtttttacttgcaacgtttgaccactcgtcttattgaaatgttttttgcaaatataaaaaacaaaaaattgtgctttaagtactagggataataaagtaagtcacaaataaaataaataataatttaaaaaaattgaataagacgagtggtcaaacgttacagggaaaagctcaaaatcccttatactacgagatagagagagtatctggtttcaaacaggatttataacaggatagtgtgaccgttgtgtggacgactctggtcgtcgcgaatcatgtacagaacaca

SEQ ID NO: 23773 - DNA, 452 bp, Oryza sativa
tttgcaacactaatgcggcatcagataattgaatgccacaaccagttctgtgttgcaaggacagcttctaaaactggctagctgaaatttcaagagatcttgtttaaatgacagtaagcagctcatagtgagtaactggctgtatcgttcgagcgtcagagtaacttgcaagcctggttgttttctttcttcggtttgatgttaaagggatttggaagggtggtggaactgagggacgaaacatctggggtttgggtgctgaagggtggagttctatgaaagttaaaggggggatgaagtatgtcccacctgtccgtaaacttttttgtagtgtagagggggataaacaaaagaaagagcatatttgatctttacaatggtagatacttgaaatcttggttttttcctactatttgtaaagtatattcactgctcgctgttcttatacctta

SEQ ID NO: 23774 - DNA, 202 bp, Oryza sativa
ttcttttgattataacacacgctattgttacatgaaagctggttcagacctggatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagg

SEQ ID NO: 23775 - DNA, 1501 bp, Oryza sativa
agagaaaaaagaaagagagaggaaggggagaaaagaaagaaaagaaaagaaaagaggaaaagaaaagaaaggagaggaaaaaggaaagaaaagaaaagagaagaaaagaaaagagagagagagggaaaagaaaagggaaaaatttagggggaaatttaaaatatttacaaatattagaatttaattataggattaatgaaaatataattagatgaaatcttactaattaaatacctaaaatactagcatttaaatataggattaatgaaaatataattggatgaattcctatagattatagatataatgctcgggtagattaaattaaaaacttatactaacaaaatatttatacccgcaaaatagtttaggatgtataaatcgaaaatggatattgtacagtggcataattatctttaacatgtcttgtcactgtagcaactaaataaattagttataatcaatccttccaatttatgggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaaatttgtcgatacaatgtcatgtgaagtagaacatatgtatataatcgattgatatccattagttaaccaaacagagccatcttaaaatcaacatgtattgtatagcttacagtaaaaatcaactactcaaatatatgatccaataataagatattgttgcttacgcatatactatacatcccattatagtagtacggtatagtattaatttgcgtgttgcatatattaaattaagagggagtgtatgacaaaaatgtatattggataaatactagttataaatcttgaccccatataattataattatagttcaactgtaaattaggattattcattgtaaaattatgtgatgggataatctgtaaccataatatgattaacctaaacaactctaacatagaaagcatggatgattattaaccttttgtaatttattgcgacaagtgaaatatgttcataattaaagtaaagcctccatcaattaaataataatacaaatgattcattatttgattgatcctaaatccatccgacaacagaacctctagtatacgaccattttatttaggtagatgcatgtgtagccataatccttccatagccattagctagactacaccacatattagccagatacgtatctcatttatactacattgattagctcctgaatagaccaccaagacaacagaaagattaagtagcccttagcatgttggaatccattagcaaacgcgaataatatgagcaaccttaggttcgacctcaacaaatatattttgtttgtacatatttgattgttatttgaatattggtttttctcgcgtattatag

SEQ ID NO: 23776 - DNA, 388 bp, Oryza sativa
gagggagtgaataagtgatattctctcaaaaaagaagctcatattttgcttagcgagtggaaagaggaataaaatggtcttataaaacagaaaatgctccttaaaaataagcattccaattaaaatattcatataatgcttgtactataaaaaactagaaggcagcataattgtgcccctgtacactacccataatctttctactcaatatcgaaacctttgatggattatataatattatattataccctcctgtatcaaaacgtaaaaaatgttgttttaaattaccataatgagccaatgcatatgcccaaagatatatcagtggttcctctcacttaaacctttttgcctcatagtaggcccacacctgacaggttgtactagt

SEQ ID NO: 23777 - DNA, 1501 bp, Oryza sativa
atgtgaagtagaacatatgtatataatcgattgatatccattagttaaccaaacagagccatcttaaaatcaacatgtattgtatagcttacagtaaaaatcaactactcaaatatatgatccaataataagatattgttgcttacgcatatactatacatcccattatagtagtacggtatagtattaatttgcgtgttgcatatattaaattaagagggagtgtatgacaaaaatgtatattggataaatactagttataaatcttgaccccatataattataattatagttcaactgtaaattaggattattcattgtaaaattatgtgatgggataatctgtaaccataatatgattaacctaaacaactctaacatagaaagcatggatgattattaaccttttgtaatttattgcgacaagtgaaatatgttcataattaaagtaaagcctccatcaattaaataataatacaaatgattcattatttgattgatcctaaatccatccgacaacagaacctctagtatacgaccattttatttaggtagatgcatgtgtagccataatccttccatagccattagctagactacaccacatattagccagatacgtatctcatttatactacattgattagctcctgaatagaccaccaagacaacagaaagattaagtagcccttagcatgttggaatccattagcaaacgcgaataatatgagcaaccttaggttcgacctcaacaaatatattttgtttgtacatatttgattgttatttgaatattggtttttctcgcgtattatagaatttgtatatcggttagtcgtgaggcaacgtatgcagcttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcctacttgtgattatgccatgccttgattattgtttaccccttattccttcgtaaccatgtttacgtatgagtccctagtcaattatgacaactgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgttcccggtcaattaaggaccgagccatggagttaagcgtgaaacgacccccgtacaaccgtacttctcgaatgggtatagacctagcggattagatagccgagcggaggcagtatccctgcatagatggttcacccctgagtgaggcaggtgcgctacaatgggacagccgttgaggtag

SEQ ID NO: 23778 - DNA, 1501 bp, Oryza sativa
ctttgcgccaatttcagtctggtttatatgcgctgcctgggatgaccatcttgtctgccttcctagatgcggtaagtgttgaaacttttatctgaactacctgctcattgccatatgacaaagtaattaataatcatataataaaatgccaaaatacttatttgtaacctaatcgtttgtgatcaggttggtggaccaagctacatgagagcagatgatcatggcggaaaccatgcaagccaagcatcatgggaacgcatgcctggtacctcacaagcagcagagcatggcaccaaagataggagatacggatcactttgaactgaacgatgctttagtttttgagggttgcttttttgtaagtttgaagtattctgtaatcagacaaactctgcacttcatctgcagttgagcttccgaagcattgcttatcatcttttcagcttagatggtgttatgaattgtggtggtggatcattcagcatgccaccatcgtcatcgccatccgatcgacgtgcatgctcattagcagatactagacctctgttcttagatagtgctccctccagtttttaatgctcaacattattgactttggacatatgtttaatgatttatcttattaaaaaacttatgtaattataatttattttgttatttgttttattattaaagaaaagcatgactttatattttttttgcatacttacattattttttttaatataagatgatgaatagtccgacgtacatccaaaaccaaaagtcacggatgtcaacatctatcatatctagggttttcaatttcgaaatcagttttttttttgtcgggggagaccgaaatttcggtaatttcagaaattttttttggccaaaattatttgaaactgactgattttgattaaattcgaataaaatttgaccaaattcaaaaaaaatgcaaaaaaaaaaaaaactgaaaatttcaggtgagatttgagcttgccggtagggggcgaaattaccgaaatttcaaaccgtgatcatatatttaccctgtagttcaataaatagttttactcaccactcattctttttattcatcgctcaacggtccagatcatctcgctcacatccaacgcatgcatcagaatcaactagccggaaaatcgcgcacgcgggatccaccaaatcgcgcgcccttctccctccgcgcgcgcctacgccaaatcgccaaccgccgccgccctctctcccgcacccgtcgcgaatccccctccgcctccgcaatccgccgcggcacccacacctccctcccctcccagatcgccgccgccgatcccccgcgtcctccaccgtcgccgaatccccttcagcgttggatcgagcgccgtcgtcatcatcatatcctaactgaccaagcaagcagcggtgattttttgttgaaggcggtttaattaccttcgttattcggttcgtgcaaccacactctctcaccttcacttgacacacggacgatcga

SEQ ID NO: 23779 - DNA, 1501 bp, Oryza sativa
attcctttgggagaaaaatatgaagattacaattaatgtgagtgccacattgcatgggaacgggttttcaatcaatatgctacaaacgtggtcatctctgaagccatataacggcaaaattggttacgtagcatggaaagttcccatttttattttttagcaccgtcctatttttatattttagcaccgaacattcacggtttactttaatagcatcaaaagatagctcatatttaacgctccgttcacatttccgttagaatcgctctccacttatacatacatacatacatacatacatacatacatacatacatatatatacatatatatacatatatatacatatatatatacacacacacacatatatacacatatatatacacatatatacacatatatagatatgtatacatatatatatatgtatacatatatatatatataggacactcatatggggcaccatggtgcccgggcaccatggtatgaaatacacaaattcgcctaaatttttcaaaattttcaaattgtgagtatatacctagttataagtattcgattcatacctatacctagcaacaaaacaactcaaatttaactttatttcacaatccattattacgtacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgcccgggcaccatggagcaccaaacaaatttactatatatatatgtatacatatatatgtatacatacatatatgtgtacatatatatatatatatatatatatatatatatatatatatatatatatatatatatatatatatgtatatatatatatatatatatatatatatatatatatatatatatatatatatgtatatatatatatatatgtatatatatatatatgtgtgtatgtatatatatatatatatatatatatatatatatatatatatatatatatatatatatagtaaaattaactggggcaccatggagcccgggctccaagattcaaattgagtatatacctaatttaaatgagtatgaattttttttaaatgtttaggtatgaacattaacttgtttactaacaagcacccaatcacaattagccatcataccagcacagggtacttcaacaccaacaaaatacactcctcctgctgcaacagatgagacaccaactagcaaatcaagctccttagtatttaccaaaaaaaaaagcattattgtctcaagctaactctatgccatctcacactgcaaagacctctaccgatagtaaggtatccttctcaatgcctactcttgcacttcctctgctataacctaattttcctaaatatctggagatacactctg

SEQ ID NO: 23780 - DNA, 1501 bp, Oryza sativa
ttatcagctacaggatggtgatcaggtagttaatggtgatgcgaatttaaaggcgcatatcaccacttattataaaggtctttttggccatcccgaagcttcttccttaacgttagatgaaagccaaataagtgatattccccaggtttctcaattagaaaataatgctttagtacaagattttttatgaggaaattaaacatgcgatttttcaaatggaacataataaagctccgggtccggatggattcctagctgagttttatcaggttttctggaatgttattaagcctgatttggttaatttatttaatgattttcatggtggtaatttacctctttactctcttaactttggtactactattttttttccaagtgcaaagaggctttgaaaattcaacaatataggcctatttgtttacttaatatcagtttcaaaatttttactaaagttgctacaaatagaatttctggagtggctcagaaggttattagtcccacacagacggcttttatacctgagaggaatattatggagggtgttgttattcttcatgaaacgatactacatgaattgcaccgaaaaaaagagtggtgtactttttaagattgattttgataaagcctatgataaagtaaaatggtcttttgttcaacaaacttttagaatgaaaggtttctcacaaaaatggtgggattagattgcgtcttttatccaaggtggacatgttggcattaaagtgaatgaccaagtgggatcaaattttcaaacatataagggtttaaggcaaggggacccgttatctccaattgtttttaatatagttgttgatacgttaactatattaataaagagagcaaaagatgatggtcaaatttctggagtggtccctcatctggttgatgatggtttatctatcttacaatatgctaatgatactatcatttttctagagtatgatttacagaaagctaaaaatatgaaattaattttaactacttttgaaaaatatctggccagtataaatcacttatgtttaaaagtactttaagatgaagattatatatacgttcgtagcatagccgatcaaatagatctaacatgtatcagctagtactccgataccactctatgtcaagatattaaaacagacaaaatatatcaaacagcaagtctaatatactttaatgcaataaaatcttaatataaagggcagatttagcatatcaagtgaacatgtagggatgaaaggtagctaaatgaggtaagatcggctgaaaccccgataccatctcctttgacgatcataagacaaactagatatcgcagttatgaatatcacttaatagatcgaactcaatcgatgcaacattaagcataagaataaatacaatatctagacatgttgatgaaaacctctaggagatggtagatatgctatataatctagattaacaatgatatctaactctatcggcttcgggaggccgacgacga

SEQ ID NO: 23781 - DNA, 1501 bp, Oryza sativa
atcttcctcacctgaatctccacctgccagcaaaaacaaaagacacttcattagctagtactaactgaaacaaagcacagttttaaatgtgcacaccgtataataagttatgttgcgggattaaatcgagctaattgtgacggtaaattaagatggatacaaaaagtccaacaaaaaccaccatacatgaatattcagcctccaagaggtatcataagaggactatcacaatgtgaattccaatcgattgcagaaccatcatctaacatgaaatattcagcattctagagctatcacaagagggctatccgaatgcatattctaatcaactgcggccaagggttgatgcaaatgcaattgatgatcatattgacccaacataatggtggagagagcagacctgctgcgtggtggccttgaggggctccttggggagggagacgacgccctcgacgtcgacgattgattccttgctgagggaggtggcgaagcgcaccatctgggtgctgacccctgcgtcggcgctggcgacgagcacgcactggacggtgctcatgctctcgcgcagcacaacgaaggccatcttcttgctgacgggccggatcgcctgcgcggcgccgcggatgaggacggagcggccggcggcggcctcgtcgaggccgccgatctcggtccacacgcggccggagatggtcttggactggatctcctcgacggggacgtcgccgtagttggccgcgaaggggtcgtcggcgtcggcctgcggctgctgctgctgctggcgctgcgacgccttctcggccttctccgccttcctcgcatccttcttgagctgcttcttgctgatggtggcggaggagagatcggccgcgagatcccccgcggaggaggcggcggcggcggcggcatcgggtggaggctccgacgacatcgcggcggaggcgaaagaagaagaatagggtttaggtttaggtagttggcttggacttggacgaggcagaggcggaagcggaagtggcggctcttggcgacggcgacggcgcgaggggaggcggaggcggaggcggtggcggcgggagagggagagggatcggtgcggggctagggtttgggtgtggaatttttttttaatcaccgattgctcaactgctgcgtagcacgagtggatgacatgtggggccaggtagagcgaccaagagtgggcccgatcggtcatggagactggaaggcggtgatggtgcagcggtgcaccgcgcgagtgacacctcgcatgcggtggcccatctggcagcccgcgtgtgcggccgcctcacgtgcgagcggctatcccctctctctctctcccgtaggcggtatccgctttaacgctgcgttacggaaaccacgagtttacgccttcaccgaccgttacgctgccgctttgcactttcccctccccgtcccccgccgcgccgcgtgtccgcgtcggtgtcgtggtcatccgccgccgccgccgccgccg

SEQ ID NO: 23782 - DNA, 1501 bp, Oryza sativa
gcgctggaggacaacgggatggcgtgcagatggcggcgtgtgtctagtcggatggcaggagggcgacggtcggagtctttgcaatgacgggcaacggaggtagggaaaatctcaccctttgggggcaaccttgctgaaagtgcaagggatgtcgatggcggctgccgaaggagaaccagtacgcgcgggtagaagatgagagcggcggagtgaaattgttccgcgcaagaaaaaacatcgatggaggctgtgctccgagcccccagaacttagggcttgagggcaggatttgagggcctcttcactttgggggctctaataggatccctgctggatctagttattttatcttaaccctcaaatactgtttaggggctaggtttgagatccctgctggagatgctctacatccgactcgtgggctccgataaaattaaccaacacaagttccagccccaattccctcttgacgtcgtaccttctccccgacaagtagctccatcgcgtggcacatctggtctcgtagtccgatccgttacatcggaatgccgatgcccgcctgcatgtactatacgaaccaaaacgctgtccaacttttgctggttcatctgcatcgatcttaattccgaccacgacatagccgccgccggcgacgaacgagtactactaccgcctctccctcaggatgctggagctatattagctatccacccggagcggatcccgggcagccaaagctacaaaatgaacaccatcgaggtgctgaaaaaaagcatcatcaactgaaaatttccgttaatacactttgtcctctgaggatctgatcaaactcaactataatttgtcaaaggatctgagcaaactctaaattccaatttgagcaggagaaggtgcatgtaatccgtggcgcaagagaagatgcaaaagtggcttgccggcgagagagcaagtgcctggctgcctgctgctgatgaaactgatccataccgtaccgtaccattgccaagaacaagacgataaaatccaacttgctggtgaacggagaccggagcagtatgccacatgaacaaatacctcctgtgctaggattcgtggaaatgatgaaaaaatgagaaaagggaagggggcgctaggggcggtatttaatagtacgtcttatagatggtctttttatgtgatctgaaccaagctggacaaaagtcacatcttccgggttggtcttttatgcccacatgggtgtggaatatgggggaaagttaaagggagagaggacactaaggtgtaacgcgttaagaccacgctctctattgatgctcctccgatcccgtatgtagtttgttgagagactatcatgtttcatgtttgtttacttccgaacagctggtagacctctctaggaataaactccatacctcattcagcacattcccaaacaaaatacgagagatttgccaagaaggtgaaagatcaggcacagagaaatcaagaggttcgagctaga

SEQ ID NO: 23783 - DNA, 1501 bp, Oryza sativa
tgcaataagccaataatcaaaatgcaggtctattagctctacttgatctgatgatctctcgaattcaatgacatatcagacagcagtgaaattggaagaaattgcatccgcaaaggaaagcagcaatatactatggcttattgttcacgaatctattagttttcagattttaatgggagaacaaattattggatgctatgtatgataagcattcattgcagaattgatatgacgaacagcatgaaattttgacccgtgaaacaaatataaggaatcttgacccgtaaatcacaatgacggtcatttgattattgttcattactgcaatgcgtatctgtaagtcatagtcgattgaatcagttaatggagtgtcaaacaggatcgatgactaaaaataacctcaaaagcgaaatgagtagaagtgaggtataaaccacgcgattcactaacaacggcacgcagaaaacctatatatatatatatgctaagcacagcaattcgcacctcagataactagaaccgctacagaaaaactcagggggacaaaattaaacagcagaaacgacggggaggaggaggtggaagcaaagcgcaccagatcgtcggccgcagcgggatcgacgtcgccgtcctcctcggggaccacaacagcagggggcggctggccccgctcccaccacggcccgcgatcccatcccacctgcaccggttggaccgcgtccaacaccgcggcgcggtacagcacggcacagggcagcgccacggccgccgcgagcaggagcgccgccgcggctttccggagagccggcgcggacagcggcagcgacggcttcgagtgcccagggaagtgacggagggaggtggcggacgtccgtgccacggtctggttcggcaacggcctcgccattgcgagagcggcggcggcggcggcggcggatgaccacgacaccgacgcggacacgcggcgcggcgggggacggggaggggaaagtgcaaagcggcagcgtaacggtcggtgaaggcgtaaactcgtggtttccgtaacgcagcgttaaagcggataccgcctacgggagagagagagaggggatagccgctcgcacgtgaggcggccgcacacgcgggctgccagatgggccaccgcatgcgaggtgtcactcgcgcggtgcaccgctgcaccatcaccgccttccagtctccatgaccgatcgggcccactcttggtcgctctacctggccccacatgtcatccactcgtgctacgcagcagttgagcaatcggtgattaaaaaaaaattccacacccaaaccctagccccgcaccgatccctctccctctcccgccgccaccgcctccgcctccgcctcccctcgcgccgtcgccgtcgccaagagccgccacttccgcttccgcctctgcctcgtccaagtccaagccaactacctaaacctaaaccctattcttcttctttcgcctccgccgcgatgtcgtcggagcctc

SEQ ID NO: 23784 - DNA, 1501 bp, Oryza sativa
ttttttaaaaatagacggctattgcggctagagtatatgtccacgctttttccttaatttaactatggcaaccgcaacgagtttaatgccaaggttgtgtctaaccatcctatagaaaactgtggtattttgtttgcctccaatcactcaacttaaacatgggaattaattgattttatacttattttgtttgcctccaatccctcatacaaccccgcaacgtgttgatggaaagtgatgtgaattgatttctattttgtttacctctaatatcttaatgcacgtttaatctaactcaaaatatgagtatttatgaaaaagacacgaacacacacgcattttgcatgacttgaaaagaaaatgaattattgatcattcatgtggccggccagccaaccatacataatcatgcattacgaaggtgcagtctaaaaagtgtaaaaagtggtggtcatatgatatatgcatgcaataagttcatctgagatcccatcacccctcttgctgctcagcgcggcagtcaggggcttggcgagtggcgtgaagaccacgaacgggaccgcacgccgctcggcggcctgcaaactcaccatgcctcttcctctcggaaattctagatccgcacgagcagatggatggatgggaatccgcgcgcagagggatggatggggatggctctccttctcactgcaattgaagcgcccagctggtctcccggcccttgaccagctagtctcccggctcggatggagaactttttggtttgaaatcttgaaagtggaagatgatgagcagctggaggggtgatgggactaaagggctcttgattcgacgggagaaggtggcagatgtgtcaatcgcccatgtggtatcctagcccggatggaaatttttttgtttgaaatcttggaagtggaagatgataagcagccggaggggtgatgggactaaacgtacgccatttgctggacggaataagataggagtttttaaccattgtatggaaaggagtgggaattgatttctatatctattttgtttgcctccaatttcccaacttaaacatacacgtttaatctaactcaaagtaagagtatttatggacaaaagacacgaacatacactcattttacatgacttagaaagagaacaaattatttattggaagtgatcatttatatggccggccaaccatacatatttatatgcccgtaagttggggacaaatcccgtcccggcccttggatgcgaagagggagcccaacaaggcaacaactcaaacctctcacgcaagcatcgggccttgttcctgcagttcggcggccttgaacggccaaccaaaccccacctcaaaaacccaacatctagcgaaagtcaccacctcatcccccatcgcccgcaccgcacgcgacttgtagtatgctcgccgcctggaggctgtcgcagcgagccgtcacgttcattccccgcgtgcgatcccaaaccctaaaccctctcccca

SEQ ID NO: 23785 - DNA, 1271 bp, Oryza sativa
ctaaacaaacagaaggacattagtttgcactatgatatgcacatgaaagatggaatcaacatgaggaaaatatgtgaaagaaactaaaggagcagaagcccaagaaaaaaaatataccactgggattggacgaagggatgatgtttgtctcgaagctgtagggatctcttgtgtaggagacataccacatcgtttcatcgtatccatcatctgaattagccttcacttgctggatatggctgatcttgttccactcaggacctgtatctcccatggctatggaactaagaagctcaaagctgcagtccacgaacaaattcctcatgcttacttgctgcaaataaccagggagtgtttcaatactatagtccttaagtgtgaggattctgagttctggcacattctccaatacttccattttggggcagaacataatgtcaagcttccgcaatttgggaaaattagatatcctctgcagatcagggttgtcatccacactgagctcaacaacacaagcgaagttatcaagagacttgaggttctggacctcacatatccatagtttcttcagagcccttgcatggaaggcaaggccaggaggaaggcacctcagtttgcaacgctcaagtaaaagctcctccaagacagccattgcttgcacttgttcctcccactcccactcctcccattccaccatccccacgaagaatagcacttgcaatcttggaaatgctttcgccgtcagggaatgatggccatgatcatggcagagcaggaattcagacccgacacgcttgatggccggtgcacgaacaatttgtagcatgaacaaatgaaggagctgagacaaaatatcaggtagttgggtgcaacaagccaagtctttaagaaacagatacctcaagctcgtaagaggcgttctggatattggtgacatcatccaatttggcagtgaacacccaaagtatccaaaaatttcaagattgtataaacagcgaggaggacagaactcattaaacacctcctcaacaagccgctgctccatctcagataaaccttcctctttgagtaacccatcatctcccaatctactagtgcagcgtaattttaagaagataagatgctccttggtgcaaagtgaagcctttgcagcataagagctggcagagacattctcaagacaatttaggtctagatccctgagctcagaaagacattctagctcttccaaactacaccaattctcttttggcgaaacaccaccagtgccc

SEQ ID NO: 23786 - DNA, 1501 bp, Oryza sativa
cggtcccgttcgtggtcttcacgccactcgccaagcccctgactgccgcgctgagcagcaagaggggtgatgggatctcagatgaacttattgcatgcatatatcatatgaccaccactttttacactttttagactgcaccttcgtaatgcatgattatgtatggttggctggccggccacatgaatgatcaataattcattttcttttcaagtcatgcaaaatgcgtgtgtgttcgtgtctttttcataaatactcatattttgagttagattaaacgtgcattaagatattagaggtaaacaaaatagaaatcaattcacatcactttccatcaacacgttgcggggttgtatgagggattggaggcaaacaaaataagtataaaatcaattaattcccatgtttaagttgagtgattggaggcaaacaaaataccacagttttctataggatggttagacacaaccttggcattaaactcgttgcggttgccatagttaaattaaggaaaaagcgtggacatatactctagccgcaatagccgtctatttttaaaaaaaaaaaattatggaagaagtgtgaacatatactctggcgagagcaaaacattttctacaactcttgactaattttgtataatctgcaaaaatgttgtagtttttttttctctaattggtatagtttgccagtgtacacatattttcatcttagaattacttatgtaaactttttaacttaaatcatatgaaacatttatcttaaactacaaaatgaaacatttatcttaaactacaaaaatacaactaagagatttagtttgagtgtttgagggaaggaaaaagaactcatatttagaaaatacacaaaacgaaacgagatgagttattagtgtatgattaattaaacattaattatttttaaacttaaaattttggttaatttgtgttttctaacattttttttaaaaaaatacatcgtttaatagtttgggaagcgtgcgtgcgaagaagaagaaaaatcttctctctttatcaatttatcaaacgcagtatatgttgggaaagcaacggcattaaatagcaattccggatgaacgtatggagcacacaattttgcgagcaaagagccaacgtatttcataatcatctataacggtctataaggaataagtccacttcatatcccccatctttccatcgagtttaactcgtatccttaaaccgcaatactggaatcttaaccctcaaacttacaaagtcaggttaaattagatcatatggtagtatgtgtggccggttttgccgacataataacatcttaataagaaaaagaaaactgaaaataccattaggcccatatgtaagtggttaccttacattcttcctgtgattctcctctcatcttttctcttcccctcctctcctccatgtcggggagcttctcctgtcggtggtgagctttgcgacggtcagggtacttatcctggtggttgcggagg

SEQ ID NO: 23787 - DNA, 1501 bp, Oryza sativa
catggaaacgacaaggattactcggattgtatccatattgatctccctagctagttccacttggacaaggggacacctatgggtataaatacaaacccccctgggaggagaggggataagccacaagacacaacatatacacaagccaacactcgttgccacatattgacatcaaagattagcctagacataccctatccggtgcctacggaggccggcaagaggaatctagcgccatctctgatcttgacgagttcatattcgaggaggaagactaccctatcatcaactacgagttggatattcatgccgccaagtcgacgatagctagataagttatcccaaatattgtacttgtgtgatccagaggaataagaggaacaccggctttggctaacaggagtagagctatttcctgtcagataagggggcccgaacctgtataaaaatccttgtctccatctcttttacctcaatctcgcatataccatggtccaacgatccccataccatgcaaataccatagtcgagatctcaaccgtcgacacaatattattataaattcatgtcaaatatatttattatattatcccttagtattttctgcccaacggtgatataattaaggaattaactttaaatattgttttatggttatttctgctcaacagtgttttgtctatgaaaattctatatttaattcgcacgtaatagattaagccaatttaaatcaattatatgcattattaatattttaaatgtttatgtttagcaatgggacattataagactgttgttccctttgatggatctaattacacttaaaggaagaacattatgcttctaaacttagccttgttggatgctagtatttcttacgttcacatataaaatccgcaagcgcacaaatataccgttgtagcactttatccggaagtattccaaggtattgaatttccacattgaacgtgtgtatttaactcttcttcatgttcatccaaggacacaagataaatgttgaccaaaggggaaagaagattatctaatgtggtacatgatcatttagaaagcttaactttaatctaatcgctatgcttcaggcacttgcttgcttgctattattagaacgcactctactccgtagccggatagggaggactacggtgatctcgagggttattaacacctctaacgtattgtgggatacgcagcaaacactgggaattaactacataaacaccatgtctatgcaattaattactactctagcgttaactaaacactaaaataatcactatttcttaatgaacaatactgaacaatgatccaacaagctaaatataactaacaaagaagtataccacacaagataaatcttaattacttaattaaaatattctcaactagagcaaagtaattgctatggtacaaaagaaatagagagataccgacaattccggaactcctccaactctttcttcctcactctctcccttattct

SEQ ID NO: 23788 - DNA, 584 bp, Oryza sativa
atccccttgttcgtgggttaattggtgggattatccgaacaagcccttaaggggaatagaatagttgataaattgcagctccattatacatccactagcagacatacagcaagaaatatttgctaggcacatattagatcctttgttttatcttaggagcatggaaccaactaacaaatatcatagcttagcgactgcctactacaaggttaatgcttcaatgtttcatccgtacttttgcattaccttgatgggcttttcacgatctacttttgaattagcttgataggctgcatgcactgtatgtggcaaaatatgattactatccagtctgcgtttggtgccaattataaagttagcagagaagggtgtagaggcatcagatatacttgaatgcaagtaattttttttgtttaagtttaaccgttatactaaggagtagaaagcttcaatctataaagcatcaattcacatcattttttcttaagacatcttttatacactgttattaatttatgtgtttatgcatctaccccaatatttctgcatgatcccagagaaacaataacttttgtcatgtgaca

SEQ ID NO: 23789 - DNA, 1501 bp, Oryza sativa
gtcttgcctgtagaatgcttggacggttggaccggttattccggagtgcaggcaataacaacatccagctcagcatgatgtatggggcataacgcaccacaaaacaaatgcaaaagctaaagaaagacagagcgcgcctagactatttgctaacaactttgatgcatgtagaacccaagttcatcttttaataataatcttgcagcaagtggcatttgagaaagctctagaacgattatgatagctagcacaaatttcaggcgccgtttccctaattccctccaaatcttggcacgttactgctttatttgtaagctttatagatcactttcaaaatcttctttcaatgtaggatctcgtgaatctatgcactataaaaaaaattcaagactacgggaacatgtcaccggatacaccgagaaatgcaaatttagtttctatcgatttgtcccaaatgcatgttcttttatcatcaagaaaagttcacatttgattcataattatagccaaggttagattttagttacttgatcacgaaaacgttcacaatttgtccctcatctctcagaataattcatgtttcatccttttccgtccaaaccagggtgatgatgtattatgacatctaatctacatggagcctacttagacgattgggatgacaccatcgccacacatattgcatttggctccctcggcgggacgggttacacaagagggcgggcaggaacactgtcagggaagctgatgaaggaggtgtgcactgtggtgaagccgacggaagtgtgcacataagagatgcttcgaatagagacagaggtcttgggtttgaatcaagcttggcacatttcatgaatatgggttgaaaagaattatgtgacttgtgataagtgaaatgtgatgtggtaggtgcctaataaaatgtgaaatattttttttgattttttcacatctgcaaatgtaaaaaatggattcaccctacaagtgtcggttctaaataaaaaccggcaccataccggtaccaatgattacctccattagtgtcgctaaattggtacaagtttgaaaactgacacctatgagaggtttagaacgggcaccaataaaggcaggttttttctactagtgaatgtttctactcaacacccggaacacagtgagagattagttgtattaaatcaacatgttgaattaatattgtgtgcattaggggagttgggtctaatactagtacgtttccacagatatcattgtcttgcctggagaatgcggaccggttgttccgagtgcaaagcaacaacaacatccagctctcagcgtgatttatggggcataccgcaccacaaaacaaatgcaaaaagctaaagaaagagacagcctagactatttgctgacaactttgatgcatgcataacccaagttgatctttaaataatcttgcagcaaatggcatttgagaaagctctagaacgatgatgacagctagcacaaatttcagccg

SEQ ID NO: 23790 - DNA, 1501 bp, Oryza sativa
agaaatcagctcgggaaatcaaaaactcggttttggagataaactcaaaaacgagttcgattcggataaaatactcaacgatttgctccgatttttgggggtaaagatagaggaggatgagaggataaaaacccctcaaaaatccggaagaaaagaggagagattggggcggattcggaggggaaagggggcggctcgggcggcatgggtgggctcggccggccggctgctagaggttagggaagcgtccgacatgtggggaccacatgtcggtctcccgagtggagggggcggctggcgggttggctgggccggctgggccgacttggccgcgggcgagagagagagagagttgggccaaaaacggcccaacaacttaaggaagggattttggaactttttaattaaaataatttgtgaaatgttgttccaattattaaaaatacttcccttgctcaaataattcccagaaaattctagaaaatagagaaacaagcaaagtatttaataaaattttatctagcttgtttttatgttaaaaattttcctagattattagggtttagcttgtaggcttttaatttaatttctaaaaatgacttaaacaatgcgttttaaaattaggcaatttttagggcgtgacaaaaccctaactttttttttctcaaaagtcgatgcccttctagcctcaatcactcatctatttatacccacaacatggctacccctagccataaatccaactagaactagaactcctaatcacataggaaacccaccaaaccaaggaaacaatatcccatacaacttcatacttcaatctttctaaacttggactccaatccaaatttaactcctctttccatacgcacacaacatcatggaaacattcacctccacatgcattgttctctaccaagagcatcccacgtgatatccttgaatgtctgaacctcaacttctcccaagtctaatcccgatccatcaccggctatactcccacgggctcaagttacacctacacatgaacaacaaagaaactttatatttgagtacaagttcacgccaacttgactcacatcagcatacaatagtatcacatacaaatagaaaccatatataagtcatatacatgaagcaagctaaaaattccacgaaaacaactcgaaaccgatgccctcctgaagtttgcaaattcaaaactttcagttcaatttttttaaaactttcaagtcaaatattaaaaaattcaagtcaaaagttaaaaattttcaactcaagtttgaaactatgaacttaaaatttaaaaactttcaagtcgatatttgaaactttcaacccagatttgaaaattttcaactcgaaatttaaatttttgaagttaaattttgaaaactttcaacttttcatctcaaatttgaaaaactttcaactcaaatttaaaactttcaacccagatttgaaaactttcagcttaaatttaaaaactttcaactcaaat

SEQ ID NO: 23791 - DNA, 1501 bp, Oryza sativa
catgtagctcttaaaattttgttgcaatcgcacgtgcagtaggctagtaccagcaaagcaatacggtgcgcatcacagcacagcacagggcaagggaccgcagaggcgcaaaccgtttgcttctaactaccgcggggccaacgaacttttcctctccttcccgcatcctctccacctctcgtcctccccctcccctccgctcatcgtgccctgctccgctgagcacgccgcagctccggatctgtggagccggggatcaggcaggcggaagcgaggtcgtgtcttggcacttctgtggctggttctttcgtagctctagagaattttggtggatagagcgcctcgatcggagaattcgggggggacgagatggatggtctgcctgcggagctgtgcatcaagatcttccacctcctggatcaccaatctctcgcctctgctccccaaggtgccctttttttgtctgctctttttactgccttgtttctcacgattcttagtgcatcattcttgccactgtcgcattcagacgtaagcgctagcaaattgcatcatggtgcctcttcttatcttatgctaatggttcgcagtttaacttaaatcatggccttaacaagtgctgttgcaaaattcagtgtgcaggaagtggaacacgttgacctccgacgacgagctgtggcgcaggctgttcaaggacaggtggggagcggatgctgcagcgttctacgcgccagagggctccaggtcatggaaggacgtcttcattgtgcaggatcgatgcgaccgatatgggctgtaagttgccatcgaattcactcgcctatcatcccgctcgagctgtacttcttatcttggcatgcctactgtcacggtgtcccctgatattcagacgtggcacacattctgtagtacactgcaacaatgtcactctgaagtactcctatatgaactctgaatactgtaagttacgcctcattgatctttccaggggtgtcaggattatcagagaaggaagcgattactacctgatttaccagggtgagatccagaggtacttggggtcgagacagcatgtgagctgcgatagcaaggacgctcctgcgcagagtagcgaggacgagcagcggcagatatccgatcggatcttgttcttccttggagacctggaggctgcatgcgcagatgccaaacgtgtgaaggtgcgacgaccgtgatatccaggaacagcgctgtatgacattgtagttgttatttttgcacatatttcgtgcacatatgttgtatgtaaaatcttcaatccattatccgtagcgtttcacattcatcttatgtatttcctcattttaaaagtaaaaagtttgtaaatctgcgctaatcgccttttacttttaggcttttagcaaagcacgtgtagcatcatctggtaatttttccgccgtaagtaaatgtaatagtcatttagctgcaaatgcatatatgcttaccacgacaaatggatatg

SEQ ID NO: 23792 - DNA, 1501 bp, Oryza sativa
ggaatggaggatccattcttctgatgtgacagaaggaacaaaattattatggttttacttgatataaatccaatagcatagagaatccatatgaagggatatttaggttggttatttagagagcatgagcacattaaggaaatcttagtaatctgaacaatagcacattacagaacgttagttaatagtagtatctattattagctacatgcaactatggacaggggacatatgctacacagatcttcatgattcagtattatctcatcgttttattgttctaaaaatagttctcaaagacttgtttttcatattaggaagtgctgatatatcacaaaatctgcattaaatagtgtttttttacttatccatcataacatttatcgaaaacaatgtaaaactgttaatataaagaataagtttgctttgtagctttgctatcctggtcctctggggacacattctctttgtgctaatttatggttcctactcataccaacactttcaatattgcagtttagacaccatgtgttttacagacgactcaagaaaaccaaagtccaaacggcaaaacagattgagtcgattggaacacaaaatatcatgaagccattgttttacaaaacaaataaagtgatccaatacaaaattgtgcctgagatagtcagcattatgcatacagcagtgaatatcctcgtcgagtcccaactacagtgaatcaactgaaaaatctctacaggagttgctacacctcaccgttgctgcgcataaaaaacgagccaattgctctaaccccgtctagtatcacctgattctacagctccgcacggccaattcacccaattcgaacgaccactaaccatcgaaccctaacttcctaggtccagtgaccagtcgcgagatctatatctactggggcagtgtgggggagaacacgggggtgcacgtaccagctgggcgatggccttggggaagaggtggtggtggcgtccggcggcggcggcggagggcgacgcggaggagcggaagtggaagtgggccagcgccttgcggtcggggagcgggcgcaggagcagctcctccgtgaactcctcctcctcggccgccggcgctgccgccgctgctgctacggatgcgaggaggaggagcgagaagaggaggaggaggaggagacggcggagagccggcggcggcgccgccattagcgccggcgaggtggggggtttgggcggcggcgtggtttggtgcgagagttgttgcggggtcccactccacaggttagggacacggtcacacggtagtaccgtgttactacgacacatggtgcatcagccattggttgagctttgagattcgtgcgtataaaaagaccaatttaatccatagagaattgcaaccacttgtttgttagaactatctccgtcacataatacttgtcattctaggttgtttagcatgtgctaaggttagaagaaaaagactataatacctgatgtgacca

SEQ ID NO: 23793 - DNA, 183 bp, Oryza sativa
aggatgaaaaattctgttccatacctacagacaatgtagcaagttgtcaaaccacattttcttttgaaaagaagcgaataagtaactacaggctgaatttgcatacttctccttaacaagccggcctagttttttctcagcttcagtgttgaggtcacccatgggttcgatttctgttccagc

SEQ ID NO: 23794 - DNA, 537 bp, Oryza sativa
ttgacattttcagtcatagaatcttaccaaatagatagatttgttggacattttgacagatgttcatggactaagcctagtaagctacctacaatggataccaaagaatcttgtctggtaatttggtttgttaacattgaccaattcatgacattaaacggaaattatttttcaaaaaaaaaaaaagaacagtgatgaatcttgatcaatcaaatctaaagaatgggactggggagagattcaaccccacagtatttttttttagtacgagggaggaagtgagcacaccaaccgtgttcgcagctcactcaaatttgatataatgaaatcctgtttttgctaaatatctagtatgttagaaacatgttattggcaactttgaagtagaacaggtgtacaacttacagatatactgggttatctgggtcgtcttttttagtaaaaccagatttaattgttgaactaattttttgcttaggtgttggcctaaaatgctttcacagaattatatccatagcgattaacatcgtggtttgt

SEQ ID NO: 23795 - DNA, 1501 bp, Oryza sativa
tacttccctcctgggaacccacactcccggaagctttgccgagtactctctccggccaagaaaagaaaaaaaagataatatctgagaatgaatctggacaaatattttatctagatttatttctagaaattagttttttatggaacgaagggtgtagagcggtcaacactaccccactgtgccaccggcctggtcggtcccacctagtattagttcacattctccctgggacccacccggtgacaggccggctgcctggtcagggttgttatccgttggcctattattaatatgtactccatctattttatttttaaatcatttgattttctttataatcaataattttaagtttaactatatttataaaaatatagtaatatttttaatagaaaataaacatattatttatttaaggatatatttaatgaaactaatttgaggtcgaagatgttattaaatctttatataaacttggtcaaatctaaataagtttgaatgaaaaaaattcaaaacaacttataatattataatatggtgggagtatatgtgtatttagatattaaaaaattaatgcgagatgtaaattacgacgggagaagttataatcaactttaaatttaaaaatatttaatttttaaattctatcagtggattgtaaattataagacaaatggtgggagcatttactctagttgcacccgggtgttaggactattttggtttggtgtcaaatcttatcctacacgaaatagtacttgtttgattgggttgattttaaaacttgccaaacaatagaaatctccaccaatacattggtagcatcaaaacttgtttagctatcggaagaactatatatttaagatgtttttatcacaaaactatatagttagcgactaatttatcaaatgaagtattgaggcaaagtatcgtaaaattacacattttataaagaagtagaagttatcacaaaatcgaggaacttgccccatccatgttcggtcctaatgacttcatcgttctcctataggcgcttacccggtgtttttaacgatttcttgctttaaaaagggaccgtccacgggttactaaaatgctacatttcttccatgtgtatcatctaaatgatacgtatcgttcaaaatttctcatgtttattacaaaatttatttatacctttattatttttgcactcgagtggagctcccacgctaattagaaaaatctagttgttgattagatagttcgtattatcgtaattgtagatcatattgataactcacgttagatacaatatgcaattgtaaatattatgaactcttcagttttcctatatttaataattgtaaagtataataaatattaatccatatcactctagatttagtgttttattaatttatttctgaaaggaaaaagtaagaattacctccacaaactatcgcggtcgtccgaattacccccctgaacaacaaaaccgaacattctttacccccaacta

SEQ ID NO: 23796 - DNA, 315 bp, Oryza sativa
tgtgtgaattgtgatggagggagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgaga

SEQ ID NO: 23797 - DNA, 1501 bp, Oryza sativa
ttcaaacggccggatttgctcccgcaaatctcgccggcgccattgatggcggccggacctcccggccggtttccttcctctcccggccgccctctcccccttccaatcctatttaaaccctccccgcgcctccctcgcccgtttccgccccttgccgcaccgtctcctcgccggaatcgagctcgcgccgtcgccctctctctcctccgtcgctgacgaccttcggccggctctctccgctcgccgggaccgtttcccgccccggcgtcgcctcctccggcttcgccgcaccgtcgccgtccccgtccaccccctcgtcgagctcgccgaccgccgaagcgccgccgtccccgtcgacccgagccgcgccgccgccttcctcctctccggccgcctttttcgtcgtcgccgtcgacctagggtgagccgtggaccgccacctcgtttccccctttcccttccctctctcggccgccgctccgccgtgcctatggccgccgccgacgaccataggggcgcgggcgcgccgcctcccgccggccgcgccgacgtggccgccttcgggcgcgccgagcggctgccgcgtggggcccggccgtcagccgcccgcgccctcgggtgcggctgacgcttggggcccacggcgccggccggtgtgagcctgggtgcacccggtccaccgtggaccgtgaggctgccgcgtgggccccactcccgtggactcggtccgcgcgccctctcccctcggctgacgcaataaaccatttttaaattaaaatttaaatgaagaaattcgtaaatattcatttaaagagcatataaacttcaaatggccataacttggccatttgaactcggaattggaccgttcaagtctctaattttcccttaagaagtcaagaacccatttttgtgctttgttcctgcttgttatatggagtttattagagtaaaagcctttttcctttctgctagtcgtgtagacgctgcagcttcggaagatccgctctacgtggaggttgaagccgacgtgtgggaaagcgagcaaggcaagtcacatcatccttgaacatattgaatcccagtttataaaattattttgatttaaattattgcattatcgctttatttaaattcccgcgttatcattgttttatttagccatgcctatttgcctttgttatgaccttattattattgctattgttattattaccttgttcaccctagaataaacaaaaccccagctagtgggtactctatttatggtaccactagtatgaatttaagtagatgcttcgctgcttaattaggcaacattaggtggttttacaactctagactttgggaatattcatatcacctggacactatggaatggttggattattgtggaattggactcacacctccccctctattcaaaatcctcaaaatggttttaggctgggctcggggtgcatggttttgatagtagcacctcggccacataaggaccggt

SEQ ID NO: 23798 - DNA, 1501 bp, Oryza sativa
aaatactgtttactgcaaaacttaacccctatattataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcatgcgcctgtggtcatcgccctagtcttctgctgtttttcgtttgtctcttgtgtgctgggccttcgccgcccatgtaataaattatctagttacgcttccgcttgttaaactctgtattgtatcaacttttggtgtaacttgcctcctgggacaaggaataatacacgcacgtaaggaacgcccgttgggttatttccggtcgtgacagctttttatgtacttagaaattaaattgttaattcatgagttatcgtgtatttttgagagttaatattttgtatgtcgtgtttaaatgtggattactaagagcctgtttggttggtgccctcacctccgtgcctgagaaatttgtaagcctgagtggcattcaagtttgtaatgtaggctacctggtcaggcagcttgagcctgtgcttgtttggttgtcacttgtgcctgagaaaaaaaattcaattagatgtttgattattatgccgctaagtcaagtattaatatccgacacaaatttttgcatttaattgcatctgacctacaaccaaattcatctagtgcaacagatccctacacaaatcaatcataaaacaaagaaaggaaaaaataatctaaaaacaagggggaacaaacaagggaaaaaggaaaaaaaagaaagcaaagattgcacccagattgtaaagtcgatctgcttactcaaccacgggcggaagaaatccttgcctgacgacacgatgcctccgcacgacggcggcactgctttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatctgcatgtgaagcatgacgcagcactccggaggggtcttcgtgtggctgcgatggcttcgtgcgacggcaacggcggcggcctcggcagcttcgtgtgaagttatcacggcggggatgaggggattatggtgctaatgtgtagcgcgctgctgcgtctgaagcctaggcgaccgattttggtcgtctggctcaggctaattccgcgcctgagttacatcaggccaggcgaggtggaaggagccttagggtagcaaccaaacactcacaaattagtcttaggcatgtctccagccaggcaacttgttgtcagggcagcaaccaaacaagctctaaactactcaagcaaagcaaaagtggcaacatgatgcaatacaaggattacatgtgcaaattatatatatatatatatatatatat

SEQ ID NO: 23799 - DNA, 165 bp, Oryza sativa
cgtatattcgactaaattacaactgtgatgtagatatggggtattcataatctccacactcattgaatcatccatcaaacagtgtcgtgttactactatcatacctgctccgtgaacgtttttgttcatttgttccgcctcccctgtcatgcatctcccttcagc

SEQ ID NO: 23800 - DNA, 222 bp, Oryza sativa
tgctggggttggtcctctatctgactaataagcaagtcatacctctgccaattgccagttgcaatctgcaatcttgtgctttaatccagttaagaggccaggcatgtgaatatatctatactgtgcctgtttttttttgtatatgtgtgctttaaacaaatctactatttatattcaacttattgtgtgcacaacttgattttctatgacttattttccagg

SEQ ID NO: 23801 - DNA, 1040 bp, Oryza sativa
tcctgcagccctgcaaaacctattccccataacgttaccaagttcgtcactgctatctgtgtcccaatcccaaccgtccatctctatccatgtgctagtggctccatcaatgcaactaacggacgtgtcctctctcgtccacactaggactagccaatgtggtttacaaccgtcaagcgctgacttgttcttcgatcgtcttcatctcggatagcgcctgtcaactgtatgaattgaacatggacatacggttgcgaattactccgtatagtacccttgagtctcgctctgaaccactagtgcctggtggactccgtcacgcagtgagcatcggggaaaaaaaaagcaaaacatgactccacttccgtgctgtactctggtgaggcgagaaaagtcgaaaaccgcatagcaagttgtacaagtgtattattagtaggagtaaacaacacaagcaacagtatggagtagaagcacctacgaattttccgtctgaccagcgagcccgtcatccgtctttgccgcgccggggaccccacgcccactcgccctcgcccaaatcaagtttcggcgtgcgtttcccatgtgcccccacgcccgtagtccgtgcgcacgtaccagggcggcgggggcaccaccccggtcaaactcaaacgaactcaaaacaacccgcgacgttgtcccgttacgcgtcagcttgccacgccacgcggttaaaacgtacggcaagcgcgcctctggttccttccgcacgccgcacgcgcgttatccaccaaaaaccacgtgaaaacgtctcggtatcgatcacctcaccacaccgcccgcgaggccgcgaccgccgaccggcgcccatcaccgctggcgctctatataagcgcgcgcgctcgtaacgactagtcgtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatca

SEQ ID NO: 23802 - DNA, 718 bp, Oryza sativa
tcagccttctaatcctcgttgtgtagcaatctttcacatgcttgacacacatgaaggtatgatcagcatctaatttgttttatttttctgatttagtatcaccatccaatatgtgacttcaattcttggattttctattaatatttttttagagtaatcactttgacgattcatgaaattgtgaggcgcggttataatctagcacacaaatttgtaaaatatttatttttatatacaaactatatagtgcgtgtgaaccatagccaaaacaactcatggttacaagaaaatttgtgacgatatataacatatataacatattggacttttgatcgacatccccttttcaatgaaaccacaacatgtatgcaatgtttatctccagaacttcattccagctagtactgtttagttattgaataatgacaatgacatgacaatcagaagcatgaagatgatctcgtttttttcttgtaacggtatgggtgcaaactaattgtactattgaataaaggaatctgatcgaatttgccataacccaataattaatcaagtaggatgtcatgtgcactcatcaattgattggtacgtacatatgcattcaatattatacagaattttttccttcagtttctgtagattgctgaagctgtagcctttatctcacaagggaaggtggctcaacaggcacgcagggccatctgatcatggccgaaaa

SEQ ID NO: 23803 - DNA, 855 bp, Oryza sativa
agtggttggctgaacagtgactgagtattggtaactttgcacataattttagcataacaaattgataagagtcagttcataacatcagatcagctcagtaaatgccatctcatatcagattaggttatgacacaccatttgagcaaagttactcaatttagatgataacaatccacatagcttagctggcttacagtctgccagaacaagcacacatcacagcatagttggcaagcagtctgccaaattacagaaactaaacaaataggcaaagttggcttagagtctgccaaattatataaagttcacagataggcatagttggcttagagtctgccaaaatacacaaaaagcacagaacattgcctagttagcacaatatggcatcacagcttgtcagtttctgtaacgccccgattttcgttcgggattaaaaaaaatcatttaataatgcattttctagaaattaaataaaagttaaaccaatttaatcaagtggaattatggaggaaattaaaatttcctttaaaaatcattggccgggaatattctgtaatattctttgtgccctaatgtactctctagaattttccgtgaattttcggagctcaagaaataattttaaaagcaccaagttcattttaaccaactaaataaaaagaaaaacaattaaaatcccccttcctctctttgggccattttcggcccaagtcttccttctctcccgcggcccgcgcgccccttttctctccccctcgggccggcctcctccctcggcccgctcggctctctctctccctcaagtctgctttacctccctcgcccgttttcccctctctctctctccctgatagg

SEQ ID NO: 23804 - DNA, 705 bp, Oryza sativa
cactgtctatggatgacattgcttctctccccccacaatacaacttttgtctcccctctattgacaaattccccattgaaatggaacctaactgctagagtgcccaagggttccatgctgccagctctaaaaaaataaaaaaagaagcactttactactctactattaaaactacactacatccatatccctaatacctagttaacacctaacaccaattaaaaaaggaccacccagattcacatgggtatacaaaaacattactacacctaaagcatatgggacaatatactacttgacctctacaccgaatcccagacaaaaaacgaatctaccacattttaaatcttcccccaaaatcaacatagtaccagctacaatagcatgcaatgccgagccaacaaggtactaaccggggtggaatccgccgcgcatttggacgaaaacgatgcttgtcgccggcgccacggccagctcgccgccgccgacaaacccgccgtcgccttcaagtcgcctcctggtcgccgctcagctagggttcgagcaaaggagagagaatggaggtctggctagctgcgctcccctccattaaccccgtctattaactccccaacggtggactgatcagtgggtcccacagcgcgacacgtcagcaaaaccgggcaaaaactgagtcaatactgccgagggaccttgatgtgacca

SEQ ID NO: 23805 - DNA, 158 bp, Oryza sativa
cccaatggaaaggtaaaacatcacttgcagtaatctattgttggtcaatacagaaatattactttgaacttagcatggtattgccttatatatgttcaacaagtgtttatttgcatagctatgacgcagtggaactgaattctgtgcttgatcgcagg

SEQ ID NO: 23806 - DNA, 190 bp, Oryza sativa
tttatctctacgctgtctattgactaagcacattaacaaataacgtagagtagtaaaatccttataaaaatagaacttaaatatatattgcacgtatatttgtggatgcgctgcgtcaccgcgcaatcctccccgtaaccacccaatcctcctcccccatggcaacaacacgccgtgcgcgtcgcgtgca

SEQ ID NO: 23807 - DNA, 233 bp, Oryza sativa
ttggccaattctaaagactgatacattgcacatactccgaccggacgagacgcactgtctcatccgtgtcgtttgagaagcactcactaagttgttttcagaaaagagttcaaataaaatcaattgcaaaaacagcagccctttctttgtagcctgcattaaacacttatttcccatggcttgctgagtactcctgtactcacccttgctctatataaataatcccccccagt

SEQ ID NO: 23808 - DNA, 1026 bp, Oryza sativa
atccccggcaagtgaatagcagagtcctattcagaaaggattgggtttatactatatcgtgtgtggtccatagtatccgagttctacttgaagactaaggtgattcacggtataaaaggcataccccctgaggggtctggaggagggaatcagagagccagcaccaccaccatagtctacaatccggaggacgtgaagcctattcgccaggagatctcgacgaaaccatcttgtcgatctcaccagtaatctccaaaccatgttttttgaaattctttttggccagagggttggtaattggaatccaagcaattttgaaataaattgtgtagcgagatttataattttggatatggattatgtggataaagatgcatgtagaatccaacccatatttttaaaagtttttgcccagagggttggtaattcggatacaaaccaatttgaaatgaattgtgtaatgaaatttataattatgaatagtaaggaaaaaaagtcccatttatatatgttctcctgtttataatatgccgtagcattttttttcataggaatggaaaattgtctctttttttatcttcatttctataccaaatttgacctttatttgtggatatatagcatgtgtaacaacatatcaatgttatctaaaatccacataatctgtttatgcttttgtatcgcactcactttttcatgacgaatagattttcaggaatgtctaaattacttttttgtcgttgtatttgtgcaacactcatttttttatgtcacatgccggtgcgatgcaacggtacaatggttttcacttggttcgcttttttttttctatatttttttctcactatcatcagttttattaggagagcagcttgtttccgtggaaaagaaagtgtgcaatatataagagggtgggaggaggactactcccttttaagtagcagagataaatttccgaaatattaaaatatattagtcatcatttgtgtcacactcacctcttacggcaaaaaaaaaaaacatgga

SEQ ID NO: 23809 - DNA, 892 bp, Oryza sativa
ctcccttgcccgctgtcgtgtggggcccgcctgtcggccccgctaccctttgatgacgccagcaggagccttttcctttgataaaataattaacaattgcacaataattcgttaataattctggaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgcctgcgtgtagaatccgtcgtttcggaagatcacggtcgcaaggataagagttcggaagattgtttgaagaagcaagacaagtcacacattccccttgagcatgttgatcccaatttacaaatgttttactgtttgcaaataaatatgcatattttgctaattacatggggtcagggttttacctatctgctcgcttgtgtcatgtttacttgatatatgtcctttgtcaacattgggtaataaatcgactagctcatgttacttatgtgacctagctagaactatatgcttagccatgcttaattaccactagctcagtcgatgggataattgcagtattagacattctagtatcttgttgagctgcgtgctcgagacatctggccatgcttcgtggtcgtaattatccaactaaaatacgactgaatggtgggctatgggtgcatggttttgctggttgcacccatggcagttaaggaccggttcgcgggatgccctagaagaacttatcgtacttaccacaagccagcgtgggcaacggctgggcttgtagtgtagctttcctctagtcgacgcatccaggcaagggtgggcgtga

SEQ ID NO: 23810 - DNA, 172 bp, Oryza sativa
aagaaggccacactaggaggctaggagaggcatcgccttaagtcggtggtgataatggacgatgacggaagatgacgatgtagtagtttggagcaaggcatacttgggctaggggagggtgggtaaggtggcactaggtgcccgggggatgtggcgcttgagttagcgatga

SEQ ID NO: 23811 - DNA, 530 bp, Oryza sativa
  unsure (1)..(530): unsure at all n locations
cgacagtcgcgtctgttgtgcgcgaatcgtgtttacgcctttcctcccttttcgtccagccgctgnnnntggattgacttnctacattnaatgctttttcctctctnnnnntnnnccccgcgtgngttttgttgacnaccntctnnnnnnnnnnnnnnnnnnnnnnnnnnnnnnnnnnnnnnnnnnnnnnnnnnnnnnnntttacattgagaacaaagctttgcgtaccctcgcaaaataatagctttaccaattacgacaggatatttactccatgaaaataatcaggtattcccaccgattcagttcaaaacttctgaaaaaaatgtaaatgtagatcatgccacactaatctatttgagcaaaaacttgtagaagattggaaaattatgtctttgttgtatcacacacataatatcatattttgtataaattacttgtcagcatatatatattttttagaattttctaaattccacaagtgcaaattagcagaagttgcaaacaaaactccaccaaaattttgaaca

SEQ ID NO: 23812 - DNA, 526 bp, Oryza sativa
attgttcaattcctgcattatttttctagtaattatagagctcctttttgacatatagtcgatgcctaagaagaagcaggaatgttgaatcttgcgaatgatcaactgttagaattagatggctaatatctattataatctggaatgagctgccaaaataatcatgccttcaggtcattcggtttatctttagcagaatttataaaaaatagtagtacctttaacatttagccatggtgagttttcccttttagcacaagttataaaagggaaggaagacgacggtacttgtgaagtatatatgttgggtagaagtatagaacttaattaacctaaaaatggatcattcgaagatccttagagaatacatgggctgaatttcaataagcaattctaaccatacactccctttcccaattcgttgtgtcagattgatctagtggtgtaaacctgaagagtctcattatgtagttctgaacttctgatctttggatatgattctcatctctttgaatttcattgcagt

SEQ ID NO: 23813 - DNA, 242 bp, Oryza sativa
ttaaatggtcactttatgtgttaactgtgaattttatccaggtctataaagtactatagatgttaatatatttctctataaacttgatcgaatgagagaagttttgacttaggacaaaactaaaagaccttgaattatggaaaggagggggtatttctagcttatgtttcttttttctgttaatgctcattaacatctggtagcccctataataatcaagggttaattggatctatgccatt

SEQ ID NO: 23814 - DNA, 151 bp, Oryza sativa
cctctcctaaagaggtgggcctggaaatgatacgtgtggtattgggcctgaagcccagaaaacacccaggaaggcccaaacaaaatcgctgaccaaacaccgatcactcaatctggaccgctcaaagacaatcgaacggcggcacaccgcc

SEQ ID NO: 23815 - DNA, 536 bp, Oryza sativa
gcgtagacgaagaatcctgaaaaatcttccaagatcagggaccccaacgtcctcctattcttttcgggtctgcaaactgttttccaattggaccaagcagctgccagataaagtgtgatctgggtctttcacctttccaaaaaaaagaaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttctttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaa

SEQ ID NO: 23816 - DNA, 596 bp, Oryza sativa
aggtttctgcacttcctaggttgatcgtaacattgttgttactagtctcactagtgttatgcagggggtatgattagtttataatttctaggtgttcctgtcaagcttaagaatatcgaatatgcgcttatattttataatctaaagttttactggtattggttgtcgtaggcctttagcatgtgtagatagtgattgattgaagaatgcaaaagttcagacgacttccacctgttctgctgcagcttgtttgatcactatcatgcatccctgttggctttcgtatggattgcgtttgccctctgaaactaggaagcttaatgtgtgttacgctgttactgtttgagtagttggataatgaatcccatggtagcactatttgcactccggtttagacatagtgattaaaatggaatttctccaaaactagatctggcccattgcaataagtagaattcacattgaacattaaaactttgcagctaagtttgactatgggacatgtctaatgtatcttctaccctttatctgctttaccatgcaggtggcactttcagattgcctatgctagttcatttcacgctgcatatccaaaa

SEQ ID NO: 23817 - DNA, 201 bp, Oryza sativa
tctattcatcatcagccatgccaaaatttaaattttaaagcttaattttgaagatgaatttgaagtttcttcatcaaagtttattttttagcattggcatttaagtcgctaagaacatatatataaaaattttcccaacaatttactgtattattattttgctaatatgccatatggcatattatccgtattatccttagg

SEQ ID NO: 23818 - DNA, 1501 bp, Oryza sativa
cgttcgttccgtagaccgtttccgtgcacccggtccaccgtgaacccgagcccgctgatgcaataaatcatttttccttttcaaaaataattctttattgcgtgataatccaattaaaatctatataaatgatttaatccggtttaatctttaaaaattcataactaattcatcttagctcggatttagttggttcaagtctctaaatttttctaaaattgagatctacatttaaaaatatcaacatgtgctgtttatgattgtttatgtactgttttggtgattttgctcttttatgcttagattgcgacgttcccggagagtccgaatttgcaggagaagactttaaagtgttccaaggccagcaaggcaagtcacacagatcccagacaatcctttgagcatgttgatcccgtttaaacctattgtttctattcaaataatgcatttatttttgaatgtcgccgggtgggaatgacctatttcctttgttatagcctttttatattgattgcctatactttgtcacctggttaataattggattagctagaacattatatggttttagctaaagtaattaggatgcttagccatgcttagagacactagctcatatgaatgggataattaatgatttattacttaatgatgacttaatggtagctcatgatggttaatcatgatatgttgattaattaagatgccaactaaaacatggtaatggtgggttgtgagcacatggttttgatggtcgtgctgatgacaattaaggaccggttcacgattttcggtcgtgaaacattaaccgtgccaatcacaagccagcgtgggcaacggttttaccttttgtatagtgtggttcattttggggcaccagactgagaagtggcggagataagcccacgggggtcgctggggagtccatgccttgttttataagggggtgattatgatccaggaatggtgcgctgctttgaattgtgttatgcgaagggtattgtcacaatctctattcgggtacttgttaagtatcgcgacgcatagttgacatgatgttgaggttgtgtcttgtgggtacagtggtacacctctggccagagtaaaactattcgaatagccgtgcccgcggttatgggcgggtctaacaatgtctttcgtgattagtctcatgcctcacaccataataaatgatgctgtaattggtaataacttgtttagctcctggtttggaatggtatattcctggtttggagatagaactgtgcagccgggaatggttgttcagaatggttgggcctatgcaacgggtatgttgtatagtgttggaataatattgtttacttagatactttactgtttttctaaattctgaagtatttattgaatgccatttatgcaaatgagactatttatgccatcctttgttatcccctgcacttgcatatttgctgcgtggcttgttgagtatgtcatatactcaccttgcaatcattcatca

SEQ ID NO: 23819 - DNA, 364 bp, Oryza sativa
catcaatccccgtgccgatgctgcctccgatggtgcgtccccaacgagtggcggtgagccgtcacaactcacaagacctcactgagatgggctagcaagcttggtgggctgggcccaggatcccaggggcccacaggcccagcctttttccttctccaagaagggcggccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgcggcggcgggaa

SEQ ID NO: 23820 - DNA, 1501 bp, Oryza sativa
atattgaatcaactggtggttcttcttaccattttctctactgagtatttctatgtgtggaatgatatatttttactatgttatcctatctgtagattatttatgttattttctgaaatatactaaaatgctgtaattgtaaattggttagattttcttagatccgggagaatagaaactctgcaccgccatcctccgccgtattagttgtgaatactttgcttgaaagttttgtgactttgtgttgaaagtttggttcatgagtagaaacttgaagatttgggttgaaacttttgatagtttgtgttataattttgagaattataagaaggtagattttgggttgaaataaagggtttttggttgttagatgaacgctttggattttggacatgaagttttgatttcaagttctaagttttgttgatttgtttaaagttctggagatccaataaagataccagaaaaggaaaggaaatggtgttctgcacccatggacggatctacagtagaaaggccggtgtcaggcgacaccgataacttacagcaaaatctatagcgaaattgcttatccatatgttataacaccatgatctaagcataattagtattatgacaccgatagacacgttatgacaccaatgaatcgattttctagattcgccactgtctgcaccaactgtgataaggaagccaaaccacgaaacttctttgccgatttatcttcctctgtcccactatagccccatgatattgaagtgttgtatgcctttatacaacatacaacattgccctagagaaccgtgttttgaaatgggatgaaatggtaaatgcacaattgttctataaaggaaaagtactaccagaagaaagaaatcaacaagtcttgattatcctcgccatttattggaaaggtaagatcaacgatttctcaacagcaaagagaaccatatatacaggagtcccactccggtgctccctactatgcactgtacctatggtagaaagtaatatatactgttgatcttatttgattgaagagtttagatctacttctaactaccaccacacttaattaatggtagtagaattgtggagtgtatttttgtccaggaaaattattcgtggagggcataatcgtcctttacactcactaacccttgctgcacttggttcatttgccattattagaagcaacgaaaaaagaactacatatcaacgaaccttaattcctggtggctaatcgacctaattaaggcgataagaataaccacacttaactatgaatcaaatcgcaccttggcctggtaacatcatataaaacacttacacgcacaacaacaacgcaagaaccaagaacttggattgatcaaacatattagtattagcagataaattttggtgtatggcatcaaagatcctcctagtggtgatcggcgtcgcagccaccacgcattcacgctgcaatatttcaatctaatctacaactaatctgtagtac

SEQ ID NO: 23821 - DNA, 734 bp, Oryza sativa
tattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgaattcaatttcacgttgagaattgctatggccacctaagcttgtgtaccaggagattccctgatctacgctacgtgcacacataaagtgcacccagaggttcgtgattttgctaggtttaccctaatttcttactagcaaattttaggattaattcctatggcgagtttgaagtatgatctaccgctcctggaccga

SEQ ID NO: 23822 - DNA, 1501 bp, Oryza sativa
aaaggatggcataaatagtctcatttgcataaatggcattcaataaatacttcagaatttagaaaaacagtaaagtatctaagtaaacaatattattccaacactatacaacatacccgttgcataggcccaaccattctgaacaaccattcccggctgcacagttctatctccaaaccaggaatataccattccaaaccaggagctaaacaagttattaccaattacagcatcatttattatggtgtgaggcatgagactaatcacgaaagacattgttagacccgcccataaccgcgggcacggctattcgaatagttttactctggccagaggtgtaccactgtacccacaagacacaacctcaacatcatgtcaactatgcgtcgcgatacttaacaagtacccgaatagagattgtgacaatacccttcgcataacacaattcaaagcagcgcaccattcctggatcataatcacccccttataaaacaaggcatggactccccagcgacccccgtgggcttatctccgccacttctcagtctggtgccccaaaatgaaccacactatacaaaaggtaaaaccgttgcccacgctggcttgtgattggcacggttaatgtttcacgaccgaaaatcgtgaaccggtccttaattgtcatcagcacgaccatcaaaaccatgtgctcacaacccaccattaccatgttttagttggcatcttaattaatcaacatatcatgattaaccatcatgagctaccattaagtcatcattaagtaataaatcattaattatcccattcatatgagctagtgtctctaagcatggctaagcatcctaattactttagctaaaaccatataatgttctagctaatccaattattaaccaggtgacaaagtataggcaatcaatataaaaaggctataacaaaggaaataggtcattcccacccggcgacattcaaaaataaatgcattatttgaatagaaacaataggtttaaacgggatcaacatgctcaaaggattgtctgggatctgtgtgacttgccttgctggccttggaacactttaaagtcttctcctgcaaattcggactctccgggaacgtcgcaatctaagcataaaagagcaaaatcaccaaaacagtacataaacaatcataaacagcacatgttgatatttttaaatgtagatctcaattttagaaaaatttagagacttgaaccaactaaatccgagctaagatgaattagttatgaatttttaaagattaaaccggattaaatcatttatatagattttaattggattatcacgcaataaagaattatttttgaaaaggaaaaatgatttattgcatcagcgggctcgggttcacggtggaccgggtgcacggaaacggtctacggaacgaacggctaggatctaatctagacaaaacggacggccgagatcgacctaatccaccacgggtctacggctgacgtggcgc

SEQ ID NO: 23823 - DNA, 161 bp, Oryza sativa
cttcttcatccatcaggataggctgggtcgatgacgagggtttatactacaatgggtttagtttggatgatctttgttgggaggaataggcaaaaaacaaaaaaacaaaaaacaaaaagcacggaagaagagctacactactactcgcttgaatgggcaga

SEQ ID NO: 23824 - DNA, 588 bp, Oryza sativa
caactaatatgaaattaatatttcaataaattgtgaattaatattggacatgtgataaatcgtgactgctgtttattcatggaagtcttaagggagtctactcatttgctttctagaattgtgacactttacttttctcaaaattatacatcaacagtccgttgtttcctagaatgatcgatgggcaattgcaatttattttcaaaaaccgtaaaattgtattgcttagttccagcaactccacttcaaatttccttaccttcattgctctttgaggagaaaagggggggaatttgtgctcaagtagtcaacaactaagttggtccttttgcgatcaatttgacacagtaatgcttagaacatgtctacatcctttatttgttaaacatatgaattcctgccatacccccaaattatgttcaccaatgcacgtgagggatatgggaatctctcatgcgttactatgtcctatctatgtcatatcactggtggactgttaagcataacaaacacctgatctgcattaccagtttaccacttcacctgttttcacgtctgtgacaaggctttccttcaatggttttcagg

SEQ ID NO: 23825 - DNA, 1501 bp, Oryza sativa
aagtgcacatggataccaaaggatggcataatatagggctcatttgcaaaagcagcatttagcaaacatttgagaattataaaacaatagagtaattaatcatcaatattaatcaacactgaacagcacacccatactgcacaggcccaaccatcctgaacaaccatacccggctgcacagatctatctccaaaccagaagctaaataaattattaccaattatatcatcatttattatggtgagaagtgtgagactaatcacgaaagacattgttagacccgcctatgaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcaccccgttataaaacaaggcatggactccccagcgacccccgtgggcttatctccgccacttctcagtctggtactccgcaatgaaccatgctatacaaaaggtaaagccgttgcccacgctggcttgtggttggcacggttaatgtttcacaaccgaaaatcgtgaaccggtccttaattgtcatgagcacgactctcaaaaccatgtgctcacaacccaccattatcaaattttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacaattgaaataaatagagaatttaaatataggatcaacatgctcaaaggattgtttgtatctgtgtgacttgccttgctggccttggaactcttcaaattcttctcctgcgaaaacaaactctccggaaacgtcggaatctaaacagaaagaagcaaaacaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaagggaattattgcgtcagcggctagggttcacggtggaccgggtgcacaggaacggtctacggaacggacggtctagatctttccatccaaaacggacggccgagatcgaccggtccacggccggactacgagagacgacaacga

SEQ ID NO: 23826 - DNA, 736 bp, Oryza sativa
aactttggatgaagattcacaaatagaattcaataattttgtgatcttttcttgcgttggtttttagtacttggtgtgtgttcctgaccttttaggaccgtgtttttataacttttttgccatgcgattttatttgtatgaattggtgtaataattggttgtagctcattgaccaaaggctggattctattccaatatctaaaaaaaacacaattttgcctaattgtgttacctactatagaaaacttgcgactgtagtttctcacgaataacgttatcgtgctagtgggtgggccaccggtccatgcaacagtagccgtgccggcccgacacggcccaacacctccttgggccgttctgcccaagatctggcaccgtacggcccattacagttgccgtgccatcagcgggccccttgccgtgatgggccgggccgcccatttggcctgctacacataatgggtaacatagtaaatctgagctaaaggtggagtactcgagtatctcttcccccttcccttcgcgtaaaagagaaaaaaaaaatctcccgtctcgtcgtctcctccgcttcttgcgcccttcgcggctgaacaggggaggggaggggcgccgatctccatccggcgagcaagggatcctggtgagcatccacatcctctttctgatgattaatctctccctcccaccgggagtgcttctgtctggaatttgcttgcgtaaaccctagcttctcttg

SEQ ID NO: 23827 - DNA, 215 bp, Oryza sativa
ttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcga

SEQ ID NO: 23828 - DNA, 1501 bp, Oryza sativa
aagaatgaaacattatgccgatttgaataggactgaaagagtgttggaggttggagacatggtgtacttaaagttgcagccctatagacaagctgcgtttggcattaggggatcactgaaactcaggtctaaattctatgggctattcaaggttattgaaaaggtggggaaggttgcttacaggctgcaattacttgaaggagtaggaatccatccagtgtttcatgtgagtcaattgaagaaacatttaggacagcatgttgttcctatgcctaatctgccagcagtaggtcctgagggacagattaagactgaaccagtcgctgtgttgcaaaggcgcatgattccaagaaacaatgaaccagtaattcagtgccttattctttggcagaacttgacgccggctgatgcgacctaggaggatgcgacttatattcagtcagcttttccttcttttgaaccttgaggacaaggtccaacttaaccgggggcaattgtcaagacaggagttgagaaatgggagattaagttcagagtttcagagttgggaaggaaacttcagttaagttcagaaaagatcagagctaaggggaaaagaagatcaaaatgggaccactgtagtcgtttttgtcgttgtcattgcttttttgggacagaggaagatgctctgtttcatgtggttgtttaactctagctttacagctgtgtaataatatttgtatgctacttatagcggctattagcccataatgaagcaggaaatgaatctactatatctttgtctttaggagtaggagtaaaattagggttttcttcagcgttcgagtcttgcggcgaccaccatctttactgaattttcctgaagaattccccactcctaatccaatgtcctgacatataactaggtaattgacaaacgtacacactcttgaaactttaatatgctttgagtttcagattgctgtgtactccctccgccactgaatatttgacgccattgacttttttaaagtatgtttgaccattcgtcttattcaagaacttctgtgaaatatgtaaaactatatgcttacataaaactatatttaacattgaatcaaatgatagaaaaagaattaataattacttaaattttttgaataagacgaacggtcaaacatgtttaaaaaagtcaacggcgtcaaatatttagtgacggaggggtaatacgtatgtttagaacatgcatcttggctgcaaatatgcttggatttgcgatgctcgttctgataatgtaagaatattttctgtttgttaagctttaactgaacttatactgtattccttgttcaaatatccttcggttggtgcaaatactttctaccctggataatctttcgtgtgattttacttagattttaatatatacttgtaatcggttttaactttgggcatctataagaaacacagcaaattaaccttttaatttccatgtcagtgttccaccaccaaagttgatagc

SEQ ID NO: 23829 - DNA, 205 bp, Oryza sativa
ggtacagtagttcatcaggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttca

SEQ ID NO: 23830 - DNA, 217 bp, Oryza sativa
  unsure (1)..(217): unsure at all n locations
gaggggattganattcgatgtcnatcccttgctcgcatgccngcatgtctactctataggatccccagtatggacatatcactattcttcctcttggagttcaatttatccacgtagtaccgacgcagctctcgagtaatagttgtgtaaaccctcgtccaggaatcagccggggcacacaataacaaattggtaatagagtgcaattattactcta

SEQ ID NO: 23831 - DNA, 472 bp, Oryza sativa
gattattactccctccgtttcaggttgtaatacgttttgactttagtcaaagtcaaactactttaagtttgaccaaatttgtagaaaaaagtagtaacattttagacccaagacaaatttattatgaaaatatattctgtcagggttatggataccatatacccaatagtaattgactaagctaggcggggccaaccatataccaagtcctatacgaaatcatacctcatatatagaaggagttccggataagggaggatgagtagagttccatatggaaactacaaggaatatttggattttatctatattggtctccctagttctacttggacaaggagatatctatgggtataagtacaagaccccataggaggagagaagggacaacatatcaacgcacaagccaagacaagccaaacatcgatatcagagataagcctaaataaaccctatctggtgcctgcggagg

SEQ ID NO: 23832 - DNA, 388 bp, Oryza sativa
atccgtcaacgtgtactgcagtctggagataattatgtgattaacatgtctaatgacagtgggccccatatgtttaatcgccacagccaatgaccatgcatgctcacgtagtaacgatagcacttcttatttcttttgttttaatagttccaatcttttgaatcgtatatcggatttaaaatccatttgaaccatcactttctattcaattatacaacaaaacgagtccaatatcgaatatattcggacaccataatatttaaaatttctagacccacatgtcatatagacacgtctcgtatatattcagtaaaattgtgctacaaataatattctcatataaaattaaatgcccaataatttattatttcttctatgaatttttagc

SEQ ID NO: 23833 - DNA, 551 bp, Oryza sativa
attcctgcagccctatatatatatatatatatatgggagcgtatcctatacacacaggccctcgcgtgtacacaccgtggacaccaactaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaattgtcagattttttgttttttttttgttacggctaaaatataatgaatttgatgttaagattttaaccctaggtgtaatacaattgaaagtatgtgtatgattttttctaaattttttggtgacattttttagttggtgtgcacgtgtgtacacgtgagggcctgtgtgcataggatatgttgcctatatatatatatatatatatatatatatatgaatattataagctactactgggagtaactacttccagcttatccaccgtacggtttgctacgtggcagtgcaaatttctgctatttcggagttaattagcca

SEQ ID NO: 23834 - DNA, 349 bp, Oryza sativa
tccctcaaccgcaacggcaacaccaacaccagcaccgatcccccagaattcgaacccggaggaccagatcggacgacaaaagggagctcgcggacgagacggagctcgggattcgctcgctcacctgggggggcaggaaaaggcacggggccggagctcgattcccacgggcggcggagctgagatctcacggcggcctcgccgcctcagggcaccacgccgagaccggcggcggaggcaggaaaagtctcgtgtcgtcgcggtcggagccgaagccgatgaggaggaaccggaaacccaacaacccgagaagccaaaatacctctccctgctccccacgcgtccgcca

SEQ ID NO: 23835 - DNA, 535 bp, Oryza sativa
tgccattcgttacctcatagcttggcgaccggaagaaaagccaacacacaaaaaaaaatcccacatattttttttctctctcctccttggaaacaagacaactcatttattgtttccccgagtcgagtccctgttgctttgcacatgaactctactcggcgggggcatccgtctcatatgctaataatatttgaagcctgaatttacaagatgtgtgtgaagaaggcctttatgacgcgtggcaaaaaaaacacgtggcaaaagaaaagaaggatgacaacgtctatgatttccggacggaaattattcctactaagtttactgtggtgttcttattacagtgatatgattacttaatatatggttggatcataccaatgtccatgattttcggacgacaattaatattataagttgtacagtgtaatgtgctttctacagtgatttattatttaattgggtttcacccgtgtccaagattttcggacgacgattaattccaacaattctgcactgtaacgaatttttctacagt

SEQ ID NO: 23836 - DNA, 157 bp, Oryza sativa
ttgtattaaacagagagacagaagagatgtattggttaatgtatttgctatgtgtatgtaaatatgctttgtgccaagaagaaaaaatctctattaattctatggttctattttctcagcaagctttggctgctgctggagagtcagttgcatgaac

SEQ ID NO: 23837 - DNA, 184 bp, Oryza sativa
ggttgtctaatatcaccgtaaatttaccctgttaggatcagtacaaatcattatttacttcatgggcccatcaccggcccacataaagatcagcccatcactgaccgacatagtgatcggcccattaacggcccacgtatcatcgctcgcccccacatcccgacccgttcacctctcccgattc

SEQ ID NO: 23838 - DNA, 892 bp, Oryza sativa
aagaagtttctcagctgaccaaatgtattgaagttcatgtaaaccctgtaaatgaagtctttgagacaaattttgaacgttagacatgtagtctttatgggtcggatggagtagttaatattgcgcaacatcgaagaccttgaataaggttaggatgcgtagttaataacatcctacagtagcagttcttgtcgcatcaatcatctaatattcaaatttattctcatcttatggttcttacttctaactacccttcctcttataaacgtccctcatttgaaaatggatatctacgtcatttttctttccaactaccttcgtaccacaatataaaaatattgagagttgaacgcgggtactaataaagtactccctctatattttaatgtaatgtatgacgtcgttgacttttttatcaatatttaattatttgtcttattcaaatttttttatgtaaatataaaaatatttatatcatgcttaaaaaatatttgatgataaattaagtcacaatgaaataaatgataattacatttttttaataagatgaatggtcaaacgttgattaaaacgtcaacggcgtcatatattaaaatacggagggagtaggtattgaaaatggatatctactgcattagttgaccacttctttaaactgtttgttaaatttatttcttacagaatatctactttattcatataatcaagtggatgattcgtgttaataatcaacttaaaaaactaaatcaaacagtgaccgtggtacaaagtacaagcacacgcgatgcagcggtgccatgtcctgacggagatgacgagcacgcatgaggcacgttgtgttgtttcggaccaaatcgtacgtgcagaccgaatcggcagaagcattcaagca

SEQ ID NO: 23839 - DNA, 157 bp, Oryza sativa
cctgaagcgccaaaacatgcactggcaacacccacatccctagagagaaactgcagatgttatcattgtcaagcttcgttgcaccccaacgacatagtagttccgactctacccgatagagacaaccgaagaagttggatgccaccaatacaagaaa

SEQ ID NO: 23840 - DNA, 1501 bp, Oryza sativa
gcattcaaaatgaaatgggggagtatgaagcaagagcgatcattaggctgctaattaacgtacgtttcagtatttaatttgtaaacggacgtgctaactaaacatataaactttgttaccgtaataatatattagttgacgtttatacatttgtgtagctctaaatttgcctattcttttttcttgttttcaatttgttcttcacttcttctgcttcagttttggacttcaaatatgatcagatgcatgcaattggatacgtaattaaccaattttgatccagtaaacaagcatttattacttttctaattgagagttacggaaagcatttaaacgcgtaatcgagctctaaataatgttgagtatcgtttctttctgaggttttaaatatatgcaacgtaacgcataatgacctggataattaacggtgctagtattttgatcaaacgcttaaacctaacgattcttaaaaataattcatcccatcaaagtatctctctgaaaagaaaaataatatcaagcttatctagctaatgaaaaataataactttgattaagctttttttaaaaaattaatggtagtctactctactctacctacaaacagtcctaacgggattttttttttcattttaattttttaatatttacagaaatattataccgacgaaaatatttacagaaatagaccctgccatccagtatagagcagcaaggtgacatggcacacggcgccgtgtgcgtattttgcgctgaggtcccttgctgttaaatgcagtttttgcctgctcagcggcctccccgagggcggtagggtatatttctgtaaatattttcgtcagtataatatttctgtaaatattaaaaataaaaattttaaaatgaaaaaaaattcgtcctaacggaagcagaagcccactagattagctagaacacccggcccatgggcttggcctacccacttgatattccaggcccattaagcccaacccagcgaagcgaaacatatcccacccaccccaccgtctctctccatttggactccgattccacgccgacgtcgccgcctgatcgtctccggcgccggcgatcccaaccgccgcaaccaccgcctctccctcctcctcctcctccggtaggtgctcgcggccgctcgacggccacgcacgtgctcgtgtctcgctgtcccgtccgccgcctcttctccactcccccacgcttccgctccagatctgcctctccgcccgcccggatctagccaccggttcgccggcccgccgctcgggagctgaaccgtgtggccgagtggcgacctctcctaccgcgtagccatggtaagatccgttcattctatccggtttcgtggtctgtgtagcgagcgctgtgtttgcttgcgcggggggaggaggatgatctcggaggagattagtggtaggaatggatctagtgttgggactgagatggatgaactttctgccatttgctgttgttggtcttctgc

SEQ ID NO: 23841 - DNA, 1202 bp, Oryza sativa
ggtcatgaaaataaactttcaataaaatggaaattctagacatagaaattaaaatgaatttcctagtgttacttgcactatgccacgccagattttgtcttggccctaaagatataaataaacataagatgacttatgaaggaacgaaaattcctcagaaatgaaatgaaacaaacttttgcatcactaatttctctttttatttggattgcaaataagatctccaaaacataataagtatgtaaattaaactgctacctcatcagtacatgctaagttctaacaattttgcttgtttggatcatttttgtccaattcgcacaatatagacgagttattgtactgaaataagcactttgcaacttgttgtacctatttgcatccaccacgcaagttcatgtaccgtgagtgtaatttactctagtaaaatttatgtaggatttgaatcctactaaattgctctttgaattctttgaaagtgttatttggatttaatagtattccctatgttttaggttctaggatgttttaactttggtcaaagttaaaccgcttcaaatttaactaagtttacagacaaatatagtaatacttacattatcaaattaggtctattaaaataattattaaatattgttagcaactttttgtgacaagtcgataagcacgatcgcaacacctaaacgccttgcggtgatatggagtcgccaaccacctcgatctagccaaaaggccaaatcaagatgggttttgcaaaaagaaaagttaaaccggctagcggagccaatttagagatcaaaatcagcctctagaccgatttagatcgatatgaggataactacccgtctcgtgagcaaaacggaaggttttcaggataaacctacaaagaggtgtcgcactctcgcagcggcggtggacggtttacggcgcaaaccaacaaagatgaactaaactagggtaaaatagaaaagagtaaatttcacaaaactacatatacttgtgtcaaattatcacaaaactatatatttaagaatgtgtatcacaaaactacagatttagcgttaaacttttcacggaactacagatttaatgcaccatatcacaaaactacagatttagtgattaagttatcaaagaactacatattctagagtttagatcatagcactattatttatttaaagttataaaatttgtagttt

SEQ ID NO: 23842 - DNA, 1501 bp, Oryza sativa
agattcatataggagcattttcttactgtcttcactattttgtcaatctattactacattttaaacaaatgtagaaatcttaagatacagacaatgataaaattaagttatagaaaacaagagttatttttctaatcaaagataaatatggttatcctggttaccataaaccgtcagaaaaattagaacaaagaatttatggtgaaagaatattttctttaattaattgtagtgctagacctcctgatcaatataatttgctaaaaaaaactattgtacaatattgtctttcaaaacataacataagttcataaacccattattttgaaacttgtgttatggtagtgcatattatgaagataatagaataaaacgaaccaagaggcggtggtcttccagttagcccagaaaatcttggtgatgctatattcttatcggttgctacaacataatcaaaatggccaagatctctcccatccaaactagccagtaaccatgaactcctatcttgaatccagtccatcctgccaatggtgacaccaaatttggccaccacacctaacaggcacaagagatagcatgtatgagcagcaagttctagattgctggtactgaagagtcataaactcataatgctacaaagtaagtctaaccatcctctagacaaagtgatttgcatattgagttcatgcctggcactcccacatacttcttaattgttccctcctgtgcgaatataatgccagaaagcttatgttagtaagtagaaagtatcattttaagcggtgcagatacataagactacatatcattctaatccacccccaactccatcttttgataaggatcagcactacaatagtaccatcaacatcagagacatcacaggttaagttgattctgaacatgtgagtaacggtagttcgatctatccactaaatttttagagtactgcacattatatattcagtgatgagtagatttggcagcagaaagatggcttactattccaagtgcaacctactgcattctgcattcagacattcagttaaggggttcaccagtaaactatcccaattcccacagtcatgctaccactagatacgtgacatgttcaagttgaagcctcaactatgggagggtttcgaagcctagaaccttctcgaaatcagtgaatttgccggcctcccgatcgaagcacgcgaacatggccttccactcggcgacgagcccccgcgcctcccacccgctcacgacccgagcaacctcgtcgttgctcacggtgaagtatggcgcgccgtggtcgaatcgcagctccgtgccgtcctccatcacctccctgcgcccacacaaaccagcaaaatggggtggaaaaaataacagcaccgatcagcgcggaaccaacacacgcggcccgggcagtaaattggtcgagcacctccgctgcgccatgcggccaccggccccgcggccggagtcgaagagcgtcaccgccacgccg

SEQ ID NO: 23843 - DNA, 1218 bp, Oryza sativa
ccaaccgggactaaaaatagatcttttgttccggttggtattaccaaccaggactaaagataaaaaaaactctaaccttttgaaccgggactaaagatatttttagtcccggtttttattgcaaccaggaatattatatattttggtcgactgaccaaagatggtttctccaccagtggctgtggctgaaatttttaaaattttcattttatttattaaaatattttttcatagttctataaaatctacattactaccgctctttaattaggagagcgtttttattcctcccaaagaacctttttaatgatgtggtacacgtttgtgagcgtattttgacaaccgagcagaggggaaactgaccattttacaaccaatccctttgccgctctgctacgtggccgttagcatgcgataactgtagcacccgtattttatttgcttttatttaaaaatcttgtcatttaaaattttggagttaatttggttcttagttgattttgtgccaaatagatctcaaatcctctcttagaattgcctttaaaatttctgtgagatcctaggtcaaattcaaattcaaatcctttgaaatctcctcaaaattcaaactctacaaatccttgcgaaattgtgaagcagtactgttcagttcgggcctcatcctctctttcttttcccctcggcccaactcttctcctccccagtcggccagcccagcctagctcctattcaccttcttcttccttgaggcagctagccacgtgcacacaaggtgttcgacgaaatgtttcgcccggacgccgagtcgtgctgagccgtgtgttgcaccaaaacaccctcccgtgcgccgcgcgtcgtgccaacacccgcgccgcaccgcctccgcaccaggccgaggccgcgccacgccaaaatcgcgtcgcgccaagcccgacctcgctccggtttctctccgggagacacggagccacgtcgcctcgcgtcaccccgtcccgtcgccgtccactccatctatcccgtcgcccgttgcatcgaccccgacggataacggccgccacctcactcgtcgtcatccctaaccctaggccgagtcattctcttatccgatcatctcccttatccgttctcgttgcttcgtgaggaaggagcttagcctccgagctgcgtctctctctctctctctctctctttctctcgcgtcttgtcgccaccgccgca

SEQ ID NO: 23844 - DNA, 175 bp, Oryza sativa
aataaactaataggtaaatataatatatattagtagtctatttacacaataaattagcatgtgttagcataatatatttattttaatcattttctactcttttattagtgtgattaactagaaaataattatacttatcaaaaaattatcattaaaatatatattatactactta

SEQ ID NO: 23845 - DNA, 273 bp, Oryza sativa
aggagccaagcatgaccgtctctctctgtctctatctctctctcattgactcattgtgtgtgctcacttaagattacacgcttaattaaacctgataaacatggatcatacggtagtttatactgcagttttagtagtcttattagttcttattacaattagtctcttttaattagttatgcgcttggttatggtttcttattagtttgatgagtagttatgcttaatacatattgcatgcattttatttttcgcttgtgtgtgacgctgtca

SEQ ID NO: 23846 - DNA, 503 bp, Oryza sativa
cataaatcaattctttattcaaaattccatgaatcatttcccttggtcccgcacgtccgtgactgtcaataatattcttgagaatattatttctataaatttcataaatcaatttccccttgttccacaaatatcttcctttgtccacaaattccaattaaacttccaaaattcatatctcccgatccgtaacaccgattgaccccgttccacttccaataattccgtaaaattgagatctatctaatggaactattatttagtctaaataggatctttcttttggtcttttgtttaggttttttattgtttgcgtatagttgcggttaccggattttcgtcgatcgcgggttttctcgaagattcgtgaagcttcgtgaagaccttgagcaaggcaagtcaccctttgaccaattgctcctataattgaaaaatcattactattttgtttgcaacttgcattattagaatcatacactcaacttgcttggcctcggtttgcg

SEQ ID NO: 23847 - DNA, 1501 bp, Oryza sativa
cggtgatgtggtcggttgcctcggtgtcaacataccaattggtgtcaacaccgtaagcgtgcgtcgcagcgcctcctagcttctcatcggggacgtagttctcgtcgtagcggtgccagcagtccgccaccacatgccctttcttgtgacagacttggcaggtaggtctgttgtcagtgccgccgcgtccattgccacggccgtgcccgccacctcggccaccgctgccgccgccgccgcgtccagtgccgcggccgcgagggttgccgccaccacgtccctgatttccgctgccacggtttccactcgtagcagcgcacgctgttcggatcttcaccctgttttcaaagccaagaagctgtgagtagacctctgcaacagtgacagatgcattcttggcgatgagtgcttccaccactggatcaaactctgaatcaagaccattaataatgtaagcaacaagttcttcatcatctattggctttcctgttgcagcaatttcgtcaccgagagcacgcatcttgctgacgtactcggtgacagtcgattggcccttctgagtggtggtgagagccaatctaacgttgatcgcgcctgcgtgagatcgtgtcgagaacgtgttctcgatcgtcttccatgccgcggctgccgtcggtgcgcctgcgacttgcgaccgaatctccctggtcagagaggagaacagaaaaccaaggacctgttggtccgtggcaaaccattcgccatacgccgggtttgggactctgacggtcttctctcctttttctccttccttctgctcaagctcggcttctggtggaacggatgttccgaggacatggccctccagtcgcgcgccccttagggctgtgagaacttgtgccgaccagagggagtgattttgcttggtgagtttctcagaaacttggacgccgaacaaaggatttgcaaaagcggtggaggaggaggaactcgccatgagatctaatatagatcgagtttttgctctgataccatgtaaagaacagagatgcaagcgtggagaacacctcagtgggtggtttcgtgttaattcagaagcctcaaaaacgggctgatcacaagtacatgcatatatacagccggcagggttgttgagctcatctcctaatacggagggataacagcaaactctatttagagctaacaaccctatccaaaccatatgaaacaatatttcacgtaaatcctaacaggacggcgtttcttccgccatcccggcgaaaaataaagagagaacacgtgtatgttttggctgtgtatatcttttatgtatacagaggttggactaatgaaaatccataattaaaacattgttagctgtcagagatggaagaagagtgtaagcagacttgatagcaaatgatggaaaaaatttcagaaacagcaaatgtagcaaagctgagattttctttatctttaattgtattgacacaaccccctgatttgtatcccaactcgtgca

SEQ ID NO: 23848 - DNA, 261 bp, Oryza sativa
ggaaatgattcatggaattttggaataaagaattgatttatggaaaaggaaatggacgagggatgtatattagacttttttgggcggcaagggcgcggcccgagggttgaaggaggctcggccgagccatttgggccggcgcaggcacgggaaaggcggcccattagggcgcgcggaagggggggagcggttcggtggaccgagtgcacctcgcgggttccaggtggggcccgcttgtcggtgacacggcccacggtggga

SEQ ID NO: 23849 - DNA, 1501 bp, Oryza sativa
ggagaaggtcgtgacctcggtggcggcgtcgatgttggagtcgacgtggtcattgttgctctctaccacgtcagatatctcggcgttctcgtgctcacctccgacgatcaccggagacacctcggcaatgtcctcctctgccgcgtcgagcaccggagcgtgagaagaagctgcgacgtgctcggaagctattcccgagaacgcctggccgtatgagacggtcttaaagaaccccggcggcgaaggcgaaggttgcgacggcacggcctccacggcgatcgccggcgtgtcagcggcacgaccgcggacctgcacgaccgcgaagctgctctcggtgtcggagccaccaacgtcgctgccgtcgtggagctccacgctgtcgccgccgtcgctgccgctgaggacgacccagtcctccatggacggcgtggcgctctcctcctcctcctcggcggcggctgctgcgtgcgtgaggttctcggcggcggcgctcgtgcgtagatcaaagtatcgaaccgatcgtggtgaactctggttggtggggtggtgatcagaattcgctgtgaggttcgaggcggcgagacgcgctgcgtatataggggtggaattatacgggggtaggattcgaactcggcgctgtcagctgtgtcgatgtccgtttcagtttcagaagaaatccagaatcggaaagccggagttgcctccgatttctatcggctatggacaagcgaacacacacgcacgaagcactcgggctcggtacatgctagctgatggggttgtgaattgtgatcagtggcgtgcaagaaagtaaactcattggcttaaccacactggaaatttggcaaagactcacgtttgcagttgcaggggccttcgatgcatgtgcttctgcggtagtttatcagttattggtcttcttgctcgatcggatggtgaaattgaaatatggaattaatgcgaatgtactgcatataaacttgcacgagttgggatacaaatcagggggttgtgtcaatacaattaaagataaagaaaatctcagctttgctacatttgctgtttctgaaattttttccatcatttgctatcaagtctgcttacactcttcttccatctctgacagctaacaatgttttaattatggattttcattagtccaacctctgtatacataaaagatatacacagccaaaacatacacgtgttctctctttatttttcgccgggatggcggaagaaacgccgtcctgttaggatttacgtgaaatattgtttcatatggtttggatagggttgttagctctaaatagagtttgctgttatccctccgtattaggagatgagctcaacaaccctgccggctgtatatatgcatgtacttgtgatcagcccgtttttgaggcttctgaattaacacgaaaccacccactgaggtgttctccacgcttgcatctctgttctttacatggtatcagagcaaaaactcgatctatattag

SEQ ID NO: 23850 - DNA, 329 bp, Oryza sativa
acttcgacaacccttctcactctctctctcttcacttataagcaagctcacacacacctcactctctctctctctctctctctctctctcttccgttggagtaaaaaaggaggggaaagtgagaaaaagaggagaaaagctcacaccacccacctcctccattactagtttacttctcttctcctcctttctcccccattcccccaattcattccttcgccgaaccaccagagtggtggagagtagctagcagagtagcagagcggtgggagcagcagcagccgtagccgcatccggagagattcgggcaggagaagccgccgcagcga

SEQ ID NO: 23851 - DNA, 326 bp, Oryza sativa
ctatagtgtagagggaagagatgtccaacaatttttttttcacatttagaaacatataagaaccaaccatagaaagaaaaaacttaaatgacgaaatatgtgtgacggagcgtggggctcctcaccgggagaccgcgcaggccccccttgtcaaggattgacaaaactgatttccagatatttggtctagaaaacaaaactaacttttgcagaaatatcaaatggctgacaaaacacaaaactagaaatgttagtagttgagaaaactagacatgagaacttgttttgtacttattattgatgaggtattcagatgcacatagtca

SEQ ID NO: 23852 - DNA, 182 bp, Oryza sativa
atgctgggtcccgtcgcgccgccactctcagactcctcgacctcgtgacggctgagggctgacggcagagagagagagggatctgggggaggagtgaattaggttagggttataatagatgggctagatgggtctgaaagttgttgtgtggcctgaaagttgtgaattatccgccaaacagt

SEQ ID NO: 23853 - DNA, 381 bp, Oryza sativa
caattgatatatttttgcttcctagttttacatacactcttcctttaggtccttttgtgaatataactaatgtgattaatgccaagttgacaaacaagcgtgccgcgcggttatcccaagtgaaatcaatgttccaaaagaccgtgagaactgtcaacagatcaacaagaactctacatataagattcagagaacctcaactattggatttggtatcatacttatattggctttatttttttaatatatgagatatttgttttaggctaacatcagcattctgattttgcggtgcaggctatgaaaataacgcttctgtcattaggcatgtgcggctaccatgcacagacaaagctgaactgtcgtacggtacacccaaca

SEQ ID NO: 23854 - DNA, 572 bp, Oryza sativa
tcgccatgctctcatatcacccctccgcctcgccaccagcgtccctgtcattgtcgtcggggattatcttcaccaataccttcccacgacgatccatggcccaggcgccatccgtgcacccaaagcccgatgacctcgcattgcgcccaaagcccaaagatcgagaaaagggactaaatagcctataaacgtcatttagaagcggtaatttcattcataaattatccaagggaagccggtgcaatcacaagacacggatgtgagaaccatttgctcctcctcgccgtcgccccattcggaaatcaagaactctgactctggtttgctaagacataaaacacgcgaatattagagaagaacctaatatcaaataattagaaggggtgtgggcgtgaggcttcgaatccagttcgtttagcccaccaccttgtggagttagccggaagaccctgggtgtttcccttgtttgctaagacatgaagatcaaagagactcttttgtctttgctaaatgatgttcaggctattaagtaatatatttaaatctctccctcccaatctttaaaatttagg

SEQ ID NO: 23855 - DNA, 1162 bp, Oryza sativa
tggaaattttctggcagtgatgagtacaatcatgtaatcaactgcactaattgttcttgagagtcattatctttgattacagcttcttgactttagtatcagtaacttatttatcaaaaagaatgagtaacagtaacaggtaacactgtgttgcagtatctctacaccgacaaaatagaagagaagagctcatcatcaaggggacaacactgggggacaaagacaaattccatctcgctccatttccccaggtattccatagcgattagcagctgatgaataattacaagagtgctttacttcccaagtttacctttatcaaatggtctttgtctgactgtctcacctttcagcaagttcttgtattgtgggggagagcatgatcagatatttcccatggagaaggcatttaaagtagcgaggtcggtacttattccttctaatataattagagtaatacatactctctccggtttcacaattctttaagatttgaaccacataatcttcaaaatacatatttaactataattttctattataatatttataataaataaatatattttacttttattataatactttgtaatgttgttttactgactttgaactaagtacttttaatgttattgttcgttaatgatataaaagtttgaatttaaccctgtccaaaacatcgagtattatggaacatgatagagtatgaagcaaagcttttgctctctttttcaaaaaaaaaatattaaaataattgcaggggaattacatgctgaggctgcaccttgtaatttcacttacacaagatgaattaatgcaaatgcagaacactttcgtgcgaatgctaggttggaaaatcataaagaacaccggccatatgccccacaggaggacccgaaacggttcaatgaggccctcctgaactcttactaccagctccaaattcattgttgtgatgggatatcaatgccagcttcttgagcggctataagcacttgatcaaaatcatatattgtctaatgatacagggtaaagtttgtaccttctgagataaaaatgggaaatataatatagagtatatgcattgtttttcttctcatatacaaaattgggttgaatcctctgcacttgctagtttctacagtaaaataaggggggaaaa

SEQ ID NO: 23856 - DNA, 595 bp, Oryza sativa
accaaacatccagggtccatcctccagagcatgccgcttcccggatgctgatgaaaggtaaacaggaaatggttctcgcctagatctctgcacgttattcccctaatcagacaccagatcttccccagtgcttgcgccaaaccctccgcgttcaccactttctccgccaggaccttcccgatcgccttcggatcccctgatcccatacttccagactccgcctcgcagatccggatccccttcttctctgcctccgacaattgcatgcgcttcatcagtgcctgcatcgcctccatggtgccctccgaaccctaaaactacccctccccggctagcaaggtttggctcggctccaaaacagagaatctaaccgtggacacagaggaaggatgggatgtggactcaggatctagaccgaagagatcgatccgactcaggatctagaccgaagagatcgatccgatcaggcatgagaccgatggggttgagagaagattgaaaccctacccacgcagaacccaccttgagtcgcctaggaaccctaggcgccgaggacatggttggctaaaataaatttaatatcaaagtgaacaca

SEQ ID NO: 23857 - DNA, 860 bp, Oryza sativa
ttgagaaaatgaggttatattccaacttaataatggattatagatatcacaaaatgagagagaagcaaagccattattcagaagtctacttcaaatgggtagctttgctactcaaaaaacttggttgcgtctttgaggctttcagcttggatgatggatatgttttccttcgtttggctagccaacttctttagcttattagagttcagagttctgaccaaactgaatttgactggccttctctgctcacttatgagcttgcaaaacccatggaaaatagtatttcattaggtaagggtcaattatacattcactcacccttgcgagacaagctatagattatgctactagacgttttctaatgctagattacagacgtcagatgaaagtgaggtcacctgtagttgttggatcaatttcaggttgacatagtaatctagtgtgctgcaatcttcccagctgcctcactggctcaagctgattgatttgttcttggtcatgacgaaatctcctaactcgttgactggatatcgaatccctccaaattacaataataacatttcttgaaaattcagaaggcagaaagaacaagaaaccaaaattccacaaaggcgacaacacgcatggccggctagccagtactgttcatcgtcttttttttctcctctgctgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagaga

SEQ ID NO: 23858 - DNA, 608 bp, Oryza sativa
taatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtagg

SEQ ID NO: 23859 - DNA, 1120 bp, Oryza sativa
atcttgaaactgcaggctccagtttggccatcccaggctcccagcacacccgctcaaaaagacagaagtttagagagagagagagaatatgcggtaattttttttagtggagttggttacatacaaatttcttataaaaatgttgattgtgccacgttatgaacgaatcttgattttttttttataactcgcgactaattaaataaaatgttgaaatcattataaggaagaagtttatatataagactattttttctattgcaatgctctttatcataaagacgaacgacctgtcaatggtcatattactattaatacgctgaaacaattggtactagggattagggaaaggaaaaaaagtttgaattagacctccaaactagtgagtgagtaagaattaccacctagactttagattggttttgctcttatgtgatagactagtcaatattttttaaaaaaaaaattggtaggacccgtccatctcttcttacaggtggggttccactgatttattatgaaaattattgattgagctgtcataatataggaccaaaactattttggattgtgttaaggggattttaattcaataaaaaaattcaatattaatattaatatggcgttcatgaaaatatttatagttgagagtgaaaaatgtatgattttcgtgtctagaggttaatttgcactcatccaataatttagagggtgtaatagttgagagtgaaaaatgtatgatttttgtgtctaggaggttaatttgcactcgtctaataatttagcgggtgtaatttggacttttttccatacagaaatgggcactgagtcaaacaacaccacatcattaattactgcagtagactgtgagcctgtgaagatggtataaatgtatgctgagcgcctagaggcacgccgaagccagacaggcagacactaaccgtggagtagtctgatcgatctatagaaatactaagtagtagaacacagtactgtagccaaaaactaggccaagagagagattgggcgttctgagcgtagccaaagacatggcaactgatgcccacataacacacttcgcccatccacaacaccgccttctcaagaccccgtacagcag

SEQ ID NO: 23860 - DNA, 915 bp, Oryza sativa
tgcacggtttttcatggtttttcacggttaccgcggtaaccgtgcttaccgccggggcgcggtaacccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcga

SEQ ID NO: 23861 - DNA, 552 bp, Oryza sativa
tggagtattaactaagttagctatactttcgaacagaggaaataatttttagaattaacatagaaggttttcaactgctttcgtaactcagctgggttatagattgctaggatagaagaatataattattatgctaaaattattttcggttaattcagaaacatgttttcgtttttcttttagaaaaaaaagctttgaacagggttacaataatcatcttctccatttcccttttctgcgtacagtacgtactctgattttattttctgctacgttggacgaattatcttctggaacagtatgttaaggtgcattaataattaatttaaaaacaatattggttcgatgtagggccaggtaaaacgacctccaacaaaccaaattaattaaccaccaacgactgaatgctcatgggaaaagtagcttcctaaatcttcacactcacgagttaaacagccattaaatgcgatcaacttcttgatacttggactgcacttattaatgaacggattgtttgggcctttggttatcctcgcatttaatgcgaggcaa

SEQ ID NO: 23862 - DNA, 1501 bp, Oryza sativa
agctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgttacaagttggtatcagagccacccttgaccctaggacgagccgtagatcccaagccttagcaatattttcaaaaataaaaatcttttgttatttgtgaaaactgtctagtctctctctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatatgcgtggtcttggggtacccacatggagtggactaccaggccaggccgcttccggagcaggagggtgacgacgcggagccccacgctggttgggaggtcactgcagtgatcctctctggctatcccgagcggacttcgctggcagtcaccgcgggtggggattccttccccgccgcttgccagaacgacgctctcctcgccatcgtcactcttcaccagcgctacccggacgagttgcagcactcgccctaccgctaccaccctcgtcgcggaggagcccgcgactacgccaccttccgagatgctagctcggaggatgacgctaccatcgtgcacctggcgcgcatggtggaggcgtacgacgcggctcgtatcgacttccatcagatggtgcatcgcgggatggtcgagaacaacatgaagatcctggagctgcgtcaggagaacctgcagctcaagaaggacctagacgtggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccagaagggggaagcctccggcgttggtagcacggaggatgcgctgttgctcaccttccgtcctggcccgtcgcagcggtagacgagcagttagtaggcttgcgcgtgtgttctttctcgtttgtcttcttgttgagtcgtgtggggcatggttatgccggtgtgtggtataactgtgtcggagcctgtcttattttatttgcctaagcaacttgaactttaatgaacccatttaatagcagtaataaattcaagaattatagtagtcgtgggtggttagttttaattgttagctctttctctgcttgctggttctgtgtggggggttttc

SEQ ID NO: 23863 - DNA, 181 bp, Oryza sativa
tttttaacctagtcctacgcaccagccgttgcatgcagataatttgaaaaaaagaatggtgttttctttttttaatctaattattcattttgaactaatggatatccattaagaaaagatagtacatacacctgggagtacaaaagagagatccgattctatatatatatatacacccagg

SEQ ID NO: 23864 - DNA, 414 bp, Oryza sativa
tttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgca

SEQ ID NO: 23865 - DNA, 1501 bp, Oryza sativa
tatagcagccactagcaaggaaggtatctatgctgctggtgaacctgaatatttacttttggggctatcttttgttgaaatggaaagaaagggcaactgctacttaagttggagtcacttacttcttgcaagagtgatggttgtggagctgagcagtactgggcaatttggttctgtgaacttttccttcaaaggaaaacatgttgacaagctcagactatttgtcatgccaccttggctgccattagtttgtttgctggaagttagagaagggaaatgttgcactactgattctgctgcaagtataattccatggaatgagcaaaagaaaatgatgattactgaaacttgcacttgctttgagcaaaaaatgcagaagttttgggatctaactttccaggtcagtttgacatcacttgctagcaaggaaagcaatctagttattttgtgatcctaaatcattatctgtttggttatcatctgttgatcttcaggggatgttgctcaactactaccaaactagagtggagaaatggaatatgagaataatttgcatggtgatatcagaatctgatcatgtttggaatcaaattacattggtttgaatgttgaaagatatttgctatatgtgattgctgatgaaaaaggctgcaaaagggtgaaagaaatggaagaagttgcattaattcaattcatgatgagaagtatacttttgggttagttcctacagtggtgttgatcaagcgaggttgtcactctttgcagcatatcaaattgttgggaatcaatgttggcaagcgattcgtaacagtgccattgtcatgcatcacccaggtgtactttacatggagtaagcagttattcaagctaaagctacttgctctattcttcttcaatgatggttcattgtctaacaccaaatatttggagcaaccatgggattcgagaggtgttttccatcggcttgtggacaagccaaatttcaagaagaggggattgtcaggatcccgggtgggccgcacacaggctggtcagcccatcgccatgaggcccaagcaaacggaagggagcagcatataagcagcagcatcgacaacaccagggggcatcgaaagatcgtttggacttggcagagctgaagctcctggcggcggcggcgacttgggtggccggtgggcaccctcgtcgatctctctcccctacctctcctccgatctccagccttccctcccccctcggttctagaagtttccagcacttgtattccatagcttcttctcttgtccccaaaacagttgttgcttctatggtggatgcttgttgttgagttggaagtagtgggttcctaacaatgtataacagagaatgtttctttagaacactcacttctatatatgtatagatcttttaaaatttccaattatgatatttccaaagagaatgaccatatatgcaatgtaatagaaaaaaaatgattctgcagcctaccaagtaatgcaaa

SEQ ID NO: 23866 - DNA, 1501 bp, Oryza sativa
cagcaaagtggccgtgcttgccacagttgaagcagggtcctggctttcctacagcccccttcttgggttgttctgactgaactgacacagctggcggatctgactgagctggtgccattagtgggggtggagtcgagttgtggttgtgctgcttactgttgttgtgcctgccaccgttgtagtcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaataaaaacttctcctgcttctcagcatcggtgcgcacgtcctcaggagcatagcgtgcaaggcggttgaactcatgcaagtactctgtaactgacatggttccttgttggagcgcacggaactctctcttctgttgtgccataatcccttcaggaatctgtgccttcctgaaactttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgtttgagaaagtgggtggctggatacagagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcaccatctggaggaggataggtagaaataagagaaaggaagaaaacagacggctcggaaactaatctttcttataagattaagtgcaattatcttaatcttgattaaaacactgaaaaagaggcacacaactcctaataaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacatgtctgacttctaaggtagacaagggataggaatcaatgcatgctcaaatccaaatttaaaccaagcaacaactggcccaaacaactagccaagcatgatgatttttatgcatagaacatttttcatgaac

SEQ ID NO: 23867 - DNA, 447 bp, Oryza sativa
tgtcgtttgtgtaccccggccggtcctggacggggattttaatgcacattctgcttggaattctattcgggaatttctgggcgtgacatctatccgcctcaacagcaagtccaatttgtcttctattgccatggcaccctacttgatgagaactttctcaactagaccaagagctagatgggggaaaccaggctggctctgataccagattgttaggaacccactacttccaactcaacaacaagcatccaccatagaagcaacaactgctttggggacaagagaagaagaagctatggaatacaagtgctggaaacttctagaaccgaggggggggggggaaggctggagattggaggagaggtagagtagagagatcgacgagggtgcccaccgaccgcccaagtcgccgccgccgccaggagcttcagctccgccaagtccaaa

SEQ ID NO: 23868 - DNA, 1501 bp, Oryza sativa
cacggcctctttccggtatgtcgtggtggcatgtcggcgcacgggaacgtgtcgtggggctgtgtcttgtgggtacagttgtacacttctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccatagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaataattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcaccatttttcatgcatctagtttatgcattaagctatagtttagtcagtcgcattagtgtctttatccgggttcatgaaaaatgttctatgcataaaaatcatcatgcttggctagttgtttgggccagttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatgg

SEQ ID NO: 23869 - DNA, 1501 bp, Oryza sativa
attagattagctaaggtatctaccaccctgaaaatcacacaaaaatgtttgattttctagatattatgtttcttttcatacttagtattgcattagttaagtctgatctattaagtcgtgcttagaaccataatctctagcccgcttcttgattgctaataaggatttcattgaggtttcagcaaatgagttatctggacgttgcttcggcttacaaggattgcatacaagttggatttagcccgttgcaacaaaggtttcattgtttatctaatcttgtggattttatgacatcggacattcagccgatgtatgttttaaccttcggatcagtgcttattctattatatcattgttagccgattggtttctactggatgttattattgttttattacattgctatcaatcaattgtatttatatcgttatctatattggacatatatccgattgctcaaaaccctattgacatcggctggtatcggcatcagctgaattactccatcggcttgacaaccaattggcttattgatatgctatttgtatatcttgtcagttgcatgatcaaactgactggcacgcccgtatcttatcaaccggtggatctgcacagaagctaagcagatctcccaggccgttgtgttcgtcgacctagtacgtgccaacacagacccgacattatcagccaaacgtggatttttttgtcaacacataacacatagagaatcatgaagaagactctgaccatgccaatacgaagcgtggcagggaagaaaaaaaaggaagatcatcattacaaataatcttataatatgtatgagtaattgaaacaaaatttataatgaacagacaaacaatccttcaactggctatcatatctgttactccctccgggttgataatacgtgtcgttttggacaaaaatgatatttaaaaatatttttgaccactatttttcttttacaatatatatagaaatatcaatacatatgattttatgaaaagactttttaatactaatctatacatatggtcttcatatgtttaaagtttttaaagtttaataatagacttgttcaaaatgacaagtattattactccgtaaggagtaacttcttattagagtttttaacagtttttattacaacctctgttgatcacagctgaatcatttcctcgttcaagtgttcttgttgtgccatcagaggtgttccttctctgatcagttgcctggctgcttatttctttctataggagtgacaggagtttcacgcggtccatccccagggtctgaaatgatgtaagtaataaactttaggcaaaatttgctacaggatactcaaagattgtggtctttgctgtgagacacccgaagatcgtgtatttgctcgttgacacggtaaaaaagtggttattagctactggacactcctgccattattttattattttcgatgaaaacggagagagaaacttaagttaaagacaagtttgtccat

SEQ ID NO: 23870 - DNA, 1501 bp, Oryza sativa
ttcatgcgtttggaacaattggttgctttttgaaacaaacaaccatgttttttttatgattttgtgtatttgcttcttaaattggtattgattttaccggcggtaaccgctgtaagtgttgagagtgttttttctgcactgagtctagtgaaaacaagttgagaaacaatttatgtgatgatttattgaatcattcttagtcatatttattgagtgaaatatcttctctaaagttaagacgtaataaaactttcatgtctaagagcaagcgcagagtaaggtagtggcattgttttattttttttgtttgtctaagatcttttgtatttgcattctttatattgtaatatttgcacattcgaacttgctggttaatttagtcgattattaatgatacaagacaatatcaaatattgatatatttctaccggcatttcaataagtttgtacatttatagtattcgataattttggtatgtgatgtgatgatgtgaatttaagaacatgattattcaactcggtgtgtaagaataaaccctctcattctcatcaataggcccctactataacaaatgtattctgaagatttcttgacaattaatgttgttgggctttcgaaagaagggacatagtgttaacagtgaaatttagtaagccccgaagtcatcatcgatctagaatcagtatcggcttcagagtcctgtaatcggccgatgggaattatcaaggcggcaatagttggattcttgctatattcggttaaggaaattaatctattcagggaagcttatccagaagagaccgagttcaagaaggatgcagcatgcatggcaagttatctattaattaggaagagtctgttagtttccttttgtctttagaaaaatgtgcttagtgtcaataaggactttatgttttccttttatctttaggaaagtttatttcttatccaacaaggactagtatctacttatgggtataaatatgtgcacccagggttattgtaaactatatcctagatcaatacaactactcttggcacattgccaacctctttaccaaggtttttacttatcattgacgaaacttggcacttgacgggggttgcatcggctttcaatctctgacgaagggataagtcctatgttccgccggccctggcaattgtattggcttcatcggcgtcgttcaaggctgcatcagtgtatttgacctcttggattgctctggttcaattgatatatttacctacctatttatcatatatcttagttaatctggtcttagtatatcaatttagatatatcggccgattctcgctttagggtttatgctggtatcggctaaatcattttactagattagattagctaaggtatctaccaccctgaaaatcacacaaaaatgtttgattttctagatattatgtttcttttcatacttagtattgcattagttaagtctgatctattaagtcgtgcttagaaccataatctctagc

SEQ ID NO: 23871 - DNA, 1501 bp, Oryza sativa
atttccagcgttgccgtagccggtggagtatgcgggcttgcttcctaatggcacccccccggaagtggaaggtcggcctccagtgccggcgaggagagcagtagaagcttagcaaggacgacccttcgtcagttcttcgagcagaagttgagcacgtacttcggcaaatgtggggaaaggtttctgcatagtgaacgcagattgcaagtgaccgaatttttcattcaaacctcggattgtagttagggaaagagtgcggttgcccacatcgtccaagtcgtctgccatggtcttcaacaggcaacagtagtcgttgatgctcaaatcatcttggtagaagttgtaaaactcggtggagaggttgagagcgtgggactcgcggttgcccaagaactgaggtttgaggccacgctgcacgatgcgagccgtggtgttgtgcgtcatcacggactccagtaagtcgacggagatggtgccgtagagccacaaaactacgatgcagtccatgcacatccaatcctgacgatccggcctgtagaggttggtgaggacgtgatcggcgagcgcgtacttgtcgagggtgacgaggatgagaccacaccattgtgtgtagttgccgaagttgagatcgagggtgacgggcatgagagacttgatgttcagcatcgagaccgcctgagcgtggagattggcggtggcgtcattgttgaggtcgacgttgtagaagttctgggcagtaggggcaggagcagcaccggtcatcagagggatgaagccaccgtagccgggaggaggtggtggtggtgcaccagctgcttgaggaggaagacccactagagggagtgttgccgatgcagcgccaggcgtgatgaagaaggcggagacgtcctgagcaggcagagcggatgcagaggcgtcggaggtgccatagaggccaccggtggcaaggatggccgtgagctctggcggtagtgggagagagatcggcggtagtgtcgtgcctaagggggcagtggtgaagagcccggcagacatcgtcgcagccgtcatggtggtggtcgcggctgaggaagaagagttgtcgccgtgtgggtgttgccggcgatgaaagaggtgccagtaccagcttctcgatgaaagaggcaagggctttcctggtggcgcaggcagcagtggtggacgccgtgtcgatgacggaggcggctatggctgggtcaacatcaaccctagatgagggttggaagacatcccgaactgcctcggtgaccacagatgtgatggtgtcaattgcggcagagggggtaaggggagcgttgtcggccatggcgcaggagcaatgtggtggcggcggtggtggcggcggcggcggcgtcagaagcgtgcgtagcagaggagcgcatggcgcgatgcgagattagagttggaggcggaagctaaaagcatctgataccatgaaagcgtatagaagtcaacacgataatagattgatcatggacagaga

SEQ ID NO: 23872 - DNA, 1501 bp, Oryza sativa
aatgcagcaatacatattgatgcggtcataattggctcatctactttgaaaagataattaagatgtatctgacaagggcaaccatgtaatctttcacatcttcatggtttgcacggtatttgcctggataacaagtaaattggaacagagagagtacagttttagactttcagtgtgttccttccaatataagaaggggtaattgctcatttcaccttgtagtctaaccactaatttgacttttcaagtttatgtatttaacatcgctttttaaaatcggagtactcgaggttgatcctattccatgaaggtaagataatggtgctaactaagagacgaattatcttttttcctttcctcatttgaccatgttgtataaacgtttttttttgtttgctcgaaattttttgacatactttaacacattgagcatattttgatatatttgagacaagtctaatagatttctcttctttttaataaatttggcttcaatttgatagaattttgacaaaattaaactttttttttgcaaaattttgagagcatgtcgtctcaattttgttcatccaaacttacatacggtgaagaaaaacacggatatagctccagaaaggagatgctcggccggcaaacagaggttgatccattgtcgccgcccagccggcagccgcccttgaatcaccctttgctgatggccgccccgctgaccttgccgccttggctgtgtgtcacgagggcccgactagatatggacagagcgagccagaggtggatgtcgagctcgatgcaggagcccacctaccgcgtcgttgctatcgtcgccactgtcacgtgatatcaccgtcatcaagcccattgatggctcgattttcttgcaccgccatcgcggcttgttgtgtagttggtcgccattgatagacccaaaaccaaaacctaaactgtgaatcatacacagtgacgaatccagaacaaaagttaccggagatccgatacatataattatttaattattaggtaatatattaattaatatggtacaaattagttagaattgaataatttacacgggtccggtgacctaggaaacactacgtagaaacacccctggccatggaactgcgtgagataagggagagaaatggtcaaatggagatatgacataagatttttttaaaaagtaatgaaatgggaacataaaatagagggaatatgagacaataaaaatgcatacttagagtggtattttcaagttcatttctaactaaagatcgaggaatggataaaaattagatgctagagcaagggaaaaaaagcgagagatgtgtgactcaattactggtcaaagacaaaatatgttttcgtggatgaaatagtcttccccttgacctttgactgcaggaatgacacggaaattctgggtgtgtctagcaaccaaaaaagcaaaagagtagacttatagttgatcaaagttgattacatcacattaatatgatagtac

SEQ ID NO: 23873 - DNA, 1501 bp, Oryza sativa
agcatatctgcactcggcagcatgtgtatacacaagcctattgccatgttttcacggcctagcattctccacattgcaaagaatgctaacgataactacagatttatatctaagaaagagggagaacttcatacatggcacactacatgctacatagctacgtgacatgcctcacgaccttctcccaccactcactcataaccctcatagtaattttgttactctcaagacacgctctccacacacatccataatagtaatatttttactgcaacagcctaaagagtgggctagggatgggaaaaagtgggttttctgggcttagaaggatgggctggcggcgagattggtggtgggtgttgacgatgggcagaaggcgtggcggcggagctacgggaatggaagcactagcggtgggtagggctagcagtatggatgagggaggccatggcggtcagtggtggtgaatcatacccgatggcataggggaatggtacccacactggcttaggatggaagagaggtaggggtggaagggggaggaggccggtcaggtatagggattacaagcaccattgacgtcttctggtcaggtggcaaggttaggggcaccagtcgggcgaggaggaagaggtgctgaaagactgtgcgcgtgagtgcgtgaacgagcgaagcgaagaagagatataaggggatacaagaagagtatgcacgaatctcaatgcaatcctaaccattaaaaaaatacttcatccgtcccataatataacaatctagaattgaatattttatagtacaacaaatttggacatgcattatgaaatatcacatctggttctaggttgttatattatgagacggaaggagtaactgaattgaatggtatttttcagttgactagacggtccttaatttttcaccccatgttactatctacctattgtcataacgtgtttttcttcaccgttgatcaacccaaagcatttgaattgacttgttggacgtctcacgtttgattgggtgcagacttgacaaacgtaatcacttgctttcactgcccatcaatgtcaaaataaatacaatgatgaaatattttctagtgtatatatgaagacagagagcgcatttgtgcatgttaaattggcacgcatgcatgcaaagaagtggtcttcgctgttccttttgacagtttgactgccggaatcatcacacagattgtttatgtctgtcagagtgtcagcagaaacatatcataattatagttgagttgaataggtcacctggataagacattgaaccttacctatgaagtttacgtatacagcaaacacatttttctgaataatcacctagggtgtgtttagttcacattaaaattataacaatatgacgaaaaaattgaaagtttatgtgtagaaaagttttaatgtgatagaaaagttaaaaatttaaagaaaaaagttgggaactaaccaggccccagcagagagagtaagagagc

SEQ ID NO: 23874 - DNA, 1501 bp, Oryza sativa
atgtccattcccttaccgttaattatgctgctagaagatttttctgttaatgcttatcgcaatgttacaattgcgttactatgtgaatgttatacttattttatgaaaagcatgctcatgctgagcaccatcactagatcaattctcattgcaaatgtcatgtttattatcttgttggtggacctgcagccaattttgggtcaagaagaagagaacgaggtagcggagaggtttgaggtgatgttgtgtggtggagaaatgcgtgagatgaggattgtgtccgatatttcacttcgcaccggttgctcgatctgaagcattttcggatttgtgattctattttgaacatttgtgttgtggtactgaaatttccgagatttcagaaaaactttttaaaataattcgaactaattttagccaaatctaaacaaatttggaccaaattcaaaaaaagagaaaaaatttgaaaattatgacgaaatattttggtgtccggtgagggtccgaaatttcgggaattccgaacgaaaattataaacattgtgcatgggagtttaattacggggatgggaatttatcctcatgactccctgcctttcaatacgctgggggaattgggaggaaattcatcttcacttaaaatataatttccttctatactacgtaagactatcggattgaatccaataaacttctaaactgcctaagatatctgtccaaaattagagataaattagcaacaccataccaaaccaaccaaaatgacaaattaattctcagtccaaaattacatgcatggacagtgcagcaacaaccggcatccatgaatccataaaccgagagtggccaaacagctgctacttcacctgcactgcaacttcttgcgaatccttaaccctctgaatctgataggttgtcaagataatcttgcatttgtggctttgacacgacgacgatgacgaacactgcctgattctgatggagcagaagctgccatttcccgatgggcacagcaagctattcgaccgaggaatctctaccttcgctgccgatgcaacctcttgcaccggcagcaagctggtcgtcggtgccgaggagaagcccttctcaatgttgatgttattccaatacactcctataatcgataatattgtaagctaatatattgacgtgcaattcttttacgtcttcgcgaaaaaccggtaatgtcgtaaggaaatgcccccaaaagctcccacgtgttcacccttccaacctcttacaggctagatgttgaagaagcatcctgggccgttggatatcaatccaacgcatagcagtagtcgaccgagtagacattgacttgggccgtgcccggcccggcccatcgtgcttcgtgccaaaacgggccgtgccggaacaaccccccaccacggcggcggcggcggcggcgccatggcgaacagcggcaagtcatcgccggcggcgacctccaccaccgcgccgccaccgggtcggccga

SEQ ID NO: 23875 - DNA, 1501 bp, Oryza sativa
gccgtctggtggtccacgagtggcccgatgatgtcagtcagggggagagcctgcacaacatgaagtcacgatacgatcaaggaattgaagggtaaaggaccatcgactacactcacattgatcgcggcttcacgctcagccgcctccctctcgcaaagaggggtggggacgttgctgccatcgtgggaccgctaatcatcacctgggcaacacggtgctccacggttgcgctgctcagacctgcagatcgagaaccaagtttcgacaagtcaggaggaatgcacttaaaaggagagaaacccaaaatacaagaaaaataccccgagtagaaactcgggtcgcgtcctccggcccagagtagtcaaaggctggatgggctcgagtctggagcgactgggtccgtctaccaacaaagtcggcagcgacttcataccccgacaaccctcgtactcggaggtcatcaataatatcgatgaaagattggagggatggggtcaaggcgggtttggcggtctaagatggaatcttgtctggttgctcctcatgaacaatgaagattggatccgaatcttctatctgaagatagaaccacctcccccgccatttgctacgagacgaggggcactggaaaggaatgtatcgcgacttcagtccatcccgaagtcagaaaccgacacacccggatacctttttgggttccatccagcgcaacttgtagtaaaagcggaaaaggtcaagaaacggctctaccccaatgtaggcctcacagagatgagaaaaaatgctgaggaaggctatggagttggagttcagatgaagcagagaaagaccgtagaagttcaagacgagaaggaaaaactcggaaggcggaggaagaaaaccacagagaatgtagtcctcaatcgcaaccatgcggcctaggacgggttcaggttcagtacctcccggttccctctccatggtcccgtgaccggggagagtgccctccttctgcagtttcttcaaggacgcgttgctggaggtggacttgtcgaggtccatcgccgttggagatcgccggagaagaagctgaggcagacgaacttagggtttgtgtggaaacggagaagacgaagagcatttggaggcaagaaagttctcacaacagccggaccccaaaatggattcccaaaactcccttaaataggcgcactaccgacggtgcgaattccaaggaaaggagagaaatggccgccggaaatttctgggtccattgcgcgaagcggtttcttggacttcaatttaaattcactcataaccgttggacttcgcatggggttgtcgatcactctttgtctctacggtcctcacaccgagatcgaccagtcgagaacgacaacaactttgacatcagaagttgcgattggttacacgagttcatttaagaagaagtcgggggctcactgtcagggttacggataaggtataccctctacccttggatgtacgctatacggcaata

SEQ ID NO: 23876 - DNA, 1501 bp, Oryza sativa
tagtaatgacccagtcctatacgggtaggaaccttcccattggtagacttcgtgatggatttccttagcgtgttcagagaacgtccttatatgcgccgatataccatattgccgtatagcgtacatccaagggtagagggtataccttatccgtaaccctgacagtgagcccccgacttcttcttaaatgaactcgtgtaaccaatcgcaacttctgatgtcaaagttgttgtcgttctcgactggtcgatctcggtgtgaggaccgtagagacaaagagtgatcgacaaccccatgcgaagtccaacggttatgagtgaatttaaattgaagtccaagaaaccgcttcgcgcaatggacccagaaatttccggcggccatttctctcctttccttggaattcgcaccgtcggtagtgcgcctatttaagggagttttgggaatccattttggggtccggctgttgtgagaactttcttgcctccaaatgctcttcgtcttctccgtttccacacaaaccctaagttcgtctgcctcagcttcttctccggcgatctccaacggcgatggacctcgacaagtccacctccagcaacgcgtccttgaagaaactgcagaaggagggcactctccccggtcacgggaccatggagagggaaccgggaggtactgaacctgaacccgtcctaggccgcatggttgcgattgaggactacattctctgtggttttcttcctccgccttccgagtttttccttctcgtcttgaacttctacggtctttctctgcttcatctgaactccaactccatagccttcctcagcattttttctcatctctgtgaggcctacattggggtagagccgtttcttgaccttttccgcttttactacaagttgcgctggatggaacccaaaaaggtatccgggtgtgtcggtttctgacttcgggatggactgaagtcgcgatacattcctttccagtgcccctcgtctcgtagcaaatggcgggggaggtggttctatcttcagatagaagattcggatccaatcttcattgttcatgaggagcaaccagacaagattccatcttagaccgccaaacccgccttgaccccatccctccaatctttcatcgatattattgatgacctccgagtacgagggttgtcggggtatgaagtcgctgccgactttgttggtagacggacccagtcgctccagactcgagcccatccagcctttgactactctgggccggaggacgcgacccgagtttctactcggggtatttttcttgtattttgggtttctctccttttaagtgcattcctcctgacttgtcgaaacttggttctcgatctgcaggtctgagcagcgcaaccgtggagcaccgtgttgcccaggtgatgattagcggtcccacgatggcagcaacgtccccacccctctttgcgagagggaggcggctgagcgtgaagccgcgatcaatgtgagtgtag

SEQ ID NO: 23877 - DNA, 546 bp, Oryza sativa
tcacgtggcacttttttgagtccaaggactatattaacccaaatgattaatttggaggacttgtttggacgatttgaaacatcaaggactaaactgagcccgaagcgaaacttcagggaccatattggctattcacccatcagtaattaagaaaaaccaacacttaccttttccaaccagaaacgcacaactgcaggacaccatacggtaaattaaaaccgataccttcatgaaccgacacctataactccttgcagagaaaagtgttgttccctattaaaaccaactgagaatgttgtcccatgggagcagttgttagtagggtcgggataaaagtgaccaattttctttaaaaaaaatcacaacttttaggtgaggagcggaaccaacccagtcatccttatccttttctctgcctctcttgctcccgtgccctcccccctcctcattctccctctcaagcccctcattctctcacccctctctctgtaactaccgccgcacctcctcttcctcctcctccccttaaccctccatgctgcaaga

SEQ ID NO: 23878 - DNA, 1234 bp, Oryza sativa
tatgtcatagctgtagaattgatcttatcagaggatgattccagacttttcatgggattattcctaccacaatggcttgcctcaccacaattcaggcttaggacagttggtactgttccattatccgctttaggttggcgttcataggtatcatcatgtggctctagttctgcagtcaacatgacttctagtagattttgaggacatgtataagaaaagtgacctctgtcaccacagtcgaagcaggtcactcctgttaggttcggtgtcttatctttcatagctgcagcattggttgatctgactccatgttgcttttgcttttgaggacatttatttgaatagtgacctttgcccccacagttgaagcaggttactcctaaagattggtttggtgccttatctgcagcaacgttagccttgtcagaggatggtacatggcatctgttagggttcctcaaagcagaatggccttcctctccttgattgaagcctaagaccctgggcaccatttcattgtcccctttaggttggcctccattcttatcattatatggctctaattctctggtcaatgtaattggtgtgactgctgtgttgcttgtttctctcaatgcttgtctcagagtagctcggaaactctctcgttgattctgagttattgcagtgagcattggactcaaatgacattgaacagggacatgtccattgccttcacaaagaaaacatgtaatttttcccataggacatctcccgagtggatgatgcttctcacagctggagcaacctaggtgatgccaattatcatagtgtcctttttctccacaacgacggcaagcacgcctctcactctcattctgatggcagcaccataagtgacagtggccaaccttgccacaaagagtacatatgacatatttttctttattcttcatggggcactcacaagtgtagtgtccttctttcccacataccatgcaagtgatcttcccagtttgtttgtcattgagatacaagagaatatagtcagaattgggtatctcccaggagtcattatagggtaccgcctttggacggctaaattgagtgttctccatctacgaagttgattaaaattgttaccacatccaagcgaaaacattaaggctaatgaggaattagtcaactgcttaagtgaagcaagttgaccaaaaaaaaaagacttgcataacattcatgaaaaaaaaatccttct

SEQ ID NO: 23879 - DNA, 1501 bp, Oryza sativa
gaaggggctgtgttgccgttcgtacggtgtagaggaagagaacgaatacgatacggtgaggggaagatgggataaggcatccgaggagggacccagtggggctcacccgccgcgccacgtgcagtttacacgtctcttcgcttcacccacgcgtcttcttcttcttctccttcctcttccgcatcgcctcttcctcccccccctccctcccccctctcgcgcggaagaacggaacggaacggaacaccagccgctgctccggcaagcgctcgccgccggcgaggcaaaggtatgcgccacacgctctctgtacctaccaccactcgttgtcgttttcctcctctcgcggggggtgttttctttgcttgcccgcgcccaccggtggatggcttaatttagcttttccgctctgcgcgcgaggaggatctacctgctagctagacggattccttaccccccgtgtgattgatcgatgaggggctttacgctgatgcggtgaatcgaaccggcaccgctctccgtcatgggctttggaggctggaaatccaaccaccgatggatgcgttgggggagaaaaggaaattggggaatttggtactaggagagcttccttgctgtagagaggaagctagctagcttagacttgttgagaaattagtggagagtgagttcgtgagtggttttattgcgcattgcaagggaaatggaaagagggtgtctgatgaagcatgcgttagaggtgcacaaagtagagattcacatcgttgctgaagagtataggctactagtttgatgtatgctccgcgttgctaggagacatctcgcgaagcaaaatttggagaaatgagcgcactgaaactaggaggttgatttttttttttaacaatagtgtagtcaaagtgatgttggatggttgatgtttaaatgctgaacaaatgaatatgtgtacatccattcaaattaagctcgccattgtaagactaaaacacgacaaaatgacagagaaagtggatgacaacaatttaggaaggaaaaaggttaagcactgcattacgttacatatggaaatatttacttgttaattttcattagtttgcaaacaatctgtagatcctaacacatgtattatatatgcgatcaaattacaggctttaaattgatgccgctgtgactaaataagttttattcagttgtacatctctgatatccattcttcaatgagataagcactccttttgataattttcttttttctataatctctaatggttataaaagaaatccgttagaaacaacacatcattactaatagttcctaaccttcttgacaaagtcagatgattttcctttagaaccatctgacgtcacataatcgcaaatggtttccatatacacctgtttacggtagtaatgccagttatgttttgacttgctcatgtgtgctgccgtgctgcacctagtgaacctataggcactgtatttttgtggcaagaaggatttt

SEQ ID NO: 23880 - DNA, 1501 bp, Oryza sativa
tcctgtatggccttgggatgatattgctatggatttcgtggttgggctacctcgaactccacgaggaaaggacgccatctgggtggttgtagatcgtctgagtaaggtggcacatttcatttctatccgcaccacttattctgcgagtgacttggcaccgatctatacacgcgaggtagtgaggttacatggtgtgcctcgctcgattgtttctgatagggatgctaagttttcttctaagttctgggaatctgtgcaagaggcatttgatactcaattgaaattcagtacggcttttcaccctcagactgatggtcaatctgagcggactattcaaactttagaggatatgttgagatcatgtatcctttcatggaaaggcagttgggaggatcatttgccgcttgtagaattttcttacaacaatagtttccatgctagcattcaaatggcaccatatgaggcactttatggaagaaagtgtcgatccccattgtgttgggattccataggggagagagctattttaggacccggttgggtacaacagaccacagaacggatagcagaaatacgacaacacatgcttgcagctcaaagtaggcagaagagctacgccgatgtcagaagacgagaattagagtttgaagtgggcgatcaagtacttctaaaggtatctccaaccaaaggtgttgtgagatttggaacgaaaggcaaactcagccctaggtatattggtccattctcgatagtggaaagagttggaatcctagcgtatcgccttgagttaccagagtccatgaaaggtgtacattatgtattccatatttccatgttgagaaaatatttgagagaccctgaacatcatattaccgtagagccgatgaccattgagcaagatttgacatttgagtctcatcctgtaagaatattggaggaatctgagagggtgctcaggcatagaactatcaagtatgtcaaggttctctggacgcaccagaccgagcgagaggccacatgggaacttgagtcacagatgcgggagaagtatccagagttattcacgtctggtgagttatataagtcctacctatgagttcctttctatacttgtccgaggtataactggacgaattcgagggcgaattcgattgaaggagggaggaatgtaatatcccgtgttctagagtatgattgggcgaattcgagggcgaattcgatcgaaggggggaagaatgtaataccccgagttttaaattaatatatctcgcggaatattagagcaaacgcgcaaaagttcaacttttaaaccattgttcgtataggcgatcgggaaccgtggatgcgtagagctcgccgagtagtgcaaaatagactataaatttatagtaatcggagtccgaacgaagtcccgaggattgaatagatgtgagccgttagatcttatttagtctctttatataaccaaccaaaaaaaacaaacgaaaaaaaagaaacagga

SEQ ID NO: 23881 - DNA, 1501 bp, Oryza sativa
caggacacgagctctctgtcaaggtttcctgcatgctcttaagttggcagaaactggagttgatctgtatactgcatcttgacatttcaaacttaaaaatcgacacaaatcaagagcaaacactgtttgattgtttcttctgtaggagtttaccattgtttcttttgttgaagaagtccataatgttcaggcaatactggacgtggaggcattagtctgactgaccaatgtagtacaaaacaaaacatgtaacgtgaagcaagttaaaatgtacagtctgttagactgttagatggagatatggaatttcaggcgaaaaccccgtgccttgtgtgttctctacattgtgttgtgttcataacagatttactagtatagtatttttttccggcttatcagtggaaccataattagcgtagttgttatcaatgtttaggatgtgttcggctctttatcttcctaatttttactccctcatttccctcatttttcacacacacgtttcttgaattattaaacaattattttttttgcaaaaaaaatataagaaggttattttaattatcattacctgattaattctccatttattaatcgacacaaatcaaaagcaaacaagtagtaactgagaagaaggcaacaaatgctcaaggattaccgcttaaggtgcaagcagccacctcccgttgaggatttgaacaagcagccatctccgcttaactgagtactttgtttgtctcataatataaaggatttgaacaatgtaaatagtttttttttagataatgttgaacaatgtaaatatataaggatatgtactcgacacctgcttccattgtcaaggagaggttcgggaaggagatgaagataggatgatggatccgggagaagatgcaggggtgctacgaacgacgggaaggagggggaggtggtggctccgacaatgtggcggtgctcctggctggacttccggcaaggccgcgtaaggcggcgactggccaggaaggattggggcagtggcatctgaaccattcctgcttgatccaacggcggtgattatctctctctcacacacacgctctcattttaatacattttgcaaaatcgtcctttattttgatggttggttgcgacccagagttttggttcagatcaccgaccgagcaagggaatgagatgaggaaggctaatttgaaaattttgctatccaaataggggtctatatgcataatttaggatataattattaaggttgtgttcttccctacacttaccgaacctctatttcctcgtttttcgtacacacgtttcccaaactactaaacagtgtttttgaaaaaaaattataagaaaattgcttttagtattaatatatttttcaagattttttagctaatacttaattattatgccctaaaccgttgtttcgctttgtgtgctaaaggggaaggttcccaaccactagtagaagtggctaaggcttccttcgtttgcgctgtca

SEQ ID NO: 23882 - DNA, 1501 bp, Oryza sativa
gttcggcgccagctcgtagcgtaggcgcaggaggagaaagcccgaattggcgaggcgggcgtggacctggatcgtggaggcttcgtcccgggccggagctcgactaggtgaaggccttgagcaagcagggttaggtgaaggcgggacggaggctggaggagtaggcggtgagggtttcttgtcggagacgagctctgatgatttctttccacgaggaggaggcgatggtggccgcggggcgtctgccattggaaacgcgagcgagctcgcggagatgctgctcccatggcgtcaatggcggcggcggcggcacggcaacggttcgcgtgggaacttcgaacggggagataaatttgcagttatggggctgcagaagttataaatttcatatactagatacttttgcatcttgtcagtgaatatattcaatttacatataagtataagaggagtatttgatttgaagcaagttgaatattgttactactccctccgtcccataatataagggattttgagtttttgctcgtagtgtttgaccgctcgtcttattcaaaaaatttatgcaaatataaaaaacgaaaagttgtgcttaaaatactttgggtaataaagtaagtcaaaaaaaataaataataattctaaaatttttgaataagacgagtgatcaaacagtgcaagcaaaacctcaaagtcacttatattatgggacggagaaagtatgttatcccaaaagtttggacgttcccccggcccgtccaactaatgtcccaggaaaaatatcgtcctggccataatcaaagaagtggcccactttcagaaatagacgggcattcctaggcaccaaagcacatactacataggctaattcaaatgtttaaactatggtaatggttgttttctcatgtgtaatttttatggccatggctctaatgtgtttatgcaaatcccacgtggtagtcaaggtgtgcttcgtttactatttaactgcaatatctattattctgtggggccttctagagtgcatgcacatcagagctaaattgaattaatgagggtaaattggtcatttttagtagacattaatctgggtaataaaccttaaaacgtcatgctttacggtacagaggaagtattgaaatttgtttggtaacactagaatttataatattaacaaaacaaccatgtatatttgattgtttgttttagaatgtgatcttcatcaaatcatcacaatttgtccaaatatattgctttcgctcaaattttgtagaatattacagaatatactaattcaaactagcttaaacaagtaaaaaaccatgaattctaagtgggtttcctcaaaaatataagcattgcatcatagtagcaaagatacttcggcaaaaagaactaattttgaacgttacaacgctattacgactttttcttctttagattgttcatatgttggcggcaggcggtagcacaattatactagccacaacagctatagcca

SEQ ID NO: 23883 - DNA, 1501 bp, Oryza sativa
tatcgatagtacttgatagaacagatgtgcaataaactcctgtgtgtgtttgagctctattgcacatggagcttgtagaatgtagttccataaatatgcacgttcagctcggacgaaactgcaattttcaccactagaaacacatgttccttcaccactgtggtgttgtgggtatatttctagaatggaagtaatgcaataggatgttttcatatatatttacttactatttcttgttctctcttccccttgttctgtagttcatctaaatttttcatacaaaattatcataagttgctggagtcaaatatgaaagatatctttacacatgattcattttgttttgactttcagtctttcttgatgcaacctttcttttgtgctcagttactctccaaacatcaaagaaatcaaagtcttggacaggaagaaagtcaggagagcaaagttgtattacctgcgggacaggatgaatgcacttaagaaatgagactacttctgcgccccccccccccccccccctcttttagttgatctgtaaggtttttggtggcataaatctcagtgcaagacagacattttgttagttccagctcctaaatttctggtacttcagctcctaaaggctactgtttgtatttctgatacttgctcctttcaagtaacaggcagtgcagctctttgttttttttttggcccagcatttcaacaaccctaaatttcaagatatgtcggtacagtttgtcagagctaattatagaggtagtgtatgcatgtatgtaattaaagggatgtgtttcgaaagaaaaaaaaagtcgctgctggtctttgtataatagcacttgcttctttctcggttccatcttaatcatttgccttgcattgccactcggtctcacatccaaagctctgcctagaagacccagcgggcaggcgccaaccacgccactaacaaatcctagctcaccagtagagttaatatatacacttaacttgatacgtagtgactgtgacacaagtgtttctttaagctaatagatttattttgctcacattataatagatatacactttacatgaacttcatgacgtactgtggcaacacataatacttaccacaacttagtttttcaaatctcctagtagcattgttgcacccgctccaaaaattatggggctatttaggtagctcccaaatattaccatgccaaatattaggcatgacacaatttggtagtatagtttttggttggttgtcacatctgtgtcatgcctcattttactaatctttgggcctacgcatcgtagacttaaatttttataaaatttagccacgcttatggtcaacaaattgttagtatcatttggtgtagcatagcatacttgtggcaaagtgagatgtggcgaacttagccatcaaccaaacaacccctatgagggggaatcagctccacgcgccttcggtcgtccacacacgggtgaccaggggcaaaccctagcc

SEQ ID NO: 23884 - DNA, 602 bp, Oryza sativa
gacaggtcctaaaatttagtccttgaatccaaacaccaccttaaactcctcccaagtttatacaaatagatattcacatcgatattgtatcacgaacaagaatataaatatgcataaatcatggttggtctattgtcaataaggctcaaactcctcccaaatttatacaaataaatatccagctctgatatttgataagttagacggtccaacgctcgtgagggtcatactagccttgtatttatttttagctcatgttaatcgattaataaagatgacgtgtgcatgtgtttactgtcgctgggatacttaaatccatgacaacaagttcacaacgtatccatgacaacaagttcacaacgtatccatgatatattcatatgtgctctactttacttttctgtcggtcaggtttcgcgacctcacagcactatagcgtatatttgatccctctgataataccgggctatatatgcaaatatgcgcacagcaccgtgatgctgttgtgttgttgatgataaataggttgacggagaaatcatgttgatgaagcgcgactcgacggaagacgaatgattagttcggtgttgcaccagcgacga

SEQ ID NO: 23885 - DNA, 996 bp, Oryza sativa
aatggaagggtctacaagtatataagccgcatacagagggcagggaagacggctgtgtcaaacaatgggctctcggcgcctcgccgttttccctgtacaaaatcaccgattattaaaatttaaaatttaaatttaaattttaataattttatgaattttcaatgtatttgtttatatttgttttaagtttttaataacgcacatataaaaattttgctcataaattattttttaaatcgttaataagttgttttaacttgcaatcagctcacgatcaatcagtggggccctagatattccatgaattaccagggtcaaggctaatactccctccgttaataaatgtttgacaccgttgactttttagcatatgtttgaccgttcttattattcaaaatttttgtgaaatatgtaaaactatatgtatatatgaaagtatatttaacaatgaatcaaataataggaaaagaattaataattctttttttaataagacgaatggttaaacatgtttaaaaaaagataacgacgttaaatatttagaaacggaggaagaattgtttagtccaaagctaattataagtctaaagtgatagtttttttatatgtgtgctcttagtaaagtcatttctaaaatataaactataatgaagacaaaatcaaccctaaacttaagtgatattcgaattttggttgtgacacaagttgcaacacaaacgatggagcttaatttaatttcttagatagtttttttttgtttctgcagtggtggttaacatattttttatttgatattgcgcaaggtaaatacggcgcgcatgatggtattggaactataggtttaagaaatattttgcaactataatttcctatacactataataaaatcacacaatttctagcgcaaatcaataactttgtagcccatatttttggctgacaggtagacgtagagtcatagactaaggctgggttcggaacccctcctccccgaca

SEQ ID NO: 23886 - DNA, 1501 bp, Oryza sativa
ggtgttaggaactaatctctgatctctggtgcatgtaaaacggagttattaaacacatgactaattgcgtattagctatttttaaaaaatagattaatataagtttttaaagcaacattcgtgtgtgtatgtgtgtgtctatatatatatatatatatatatatatatatatatatatatatatatatattaaaaaaacacaccgttcggcggttgtttgagaagcgtctgcatgaaaaaggagaaatgtgaggtgggaaatgaggggaggaacacaaccttaggccatatttagttcctacacaagaatttttaaccctgtcacatcgaacgtttaaacacctgcatgaagtattaaatataggctaaaaaataactaattgcacagattgcgactactttgcaaaacgaatcttttaagcctaattgctcaatgatttgacaacacggtgctacagtaaacatgtgctaatgacagattaattaagcttaataaatttgtcccgcggtttactgacggatactgtaattagttttttttattagttcccgaacaccccatgcgacaccctatatacccgatgtgacacgccaaaactttacaccactggatctaaacacccccttagtctaaatctacctatcagccaaaaacatgggctacaaagttgttgatttgtgctagaaattgtgtgatttattgtagtgtgtagaaatttatagttgtaaaatatctcttgaatgccaataccatcatgatcgccgtatataccttgcggaatatcaaagaaaaaaaataaagctatgtgagccacccctgcagaaacaaaaaggaaactacctaagaaattaaagctccatcgtttgtttttcaacttatgccacaaccaaaattcgaataacacttagagttgattttttctgcattatagttatattttagaaatgattttactaagaacacatatataaaaaaattatatcattttagacttatgattaactttagactaaattatattagccttgaccctgataattcatggaatatctagggccccactgaattgatcgtgagctgattgcaagttaaaacaatctatcaacgatttaaaaaataatttatgagtaaattttttatacacgtgttctaaaaaacttaaaacaaatataaaaagaaaaattgcattgaaaatatcataaaattacctttaaatttaaattttaaattttaatgatcggtgattttgtgcagggaaaacgacgaggcgccgagaggcgagagcccattgtttgacacagccgtctcctctccatctctccgccccctgtatataaacccccccttcccctcctcgcccatcgcggcatcgctcgcctcctctgcttcgcttccttctccagcaagcacccgaccacaacacacacgcgagctcctcgacctcgagagagagagaaaacccaaccccgaattcggcggcggaggcggaggcagcggcga

SEQ ID NO: 23887 - DNA, 1501 bp, Oryza sativa
agttaacaccgttatcttgcctacacaaaatagggtcagtcttcatcttcaattttgaaaaacgaggtcaaataagcaaacctaaaaaaataaggtcgaattagtagttagacttcgtaacagggttaaaataagcaattgcctcaaaaagatatagtggggggggggtcaaatgatcaataatatgttagtaacaaatatgtataacaattaagggatagtgacaatatgttaataataattttctttaactaaaatcacgttgcaaatacacgggcagtatgctagttttttttaaaaaaaaattcctttggaatgaaatgttttattggaattttgaaggattcctaatatgagctccaagttcttggaatttttctctttgtcaaaatcgtgtatttttcgtgtgctccatccaaatggttttctgtgttttatttacttaggatttaggatttaaagtgcgatgacattttactcatgcatttttcctatgcctgtattttgataatcgtgcgctccaaaggaaaatatgttctctatacttagttcattctctctaagatgaattgagaatcaaattattttgagacagatcacttgaaaaataatggtttcctttttacataagaatgggggccttctcgcctacaccaacacgtacaatggacaaataatgctctcgacatttaacagcaacaaaaatgccgaaatgttcagttatctcgcgccgctgctgctttgcccatcagcaagttgcagcacaattggtcaaccttggtgcgctggtcaataagcatcaacaggataagctccagtagttatcccactatcagacaacaaccctgaaagccattgctttgctttcctatagagctgactcatcttccttcaaaaaaaaaaaatagagctgactcattgaatttccctttgcatgttcagataattgtagcccttgattttttttcgtatgtccagcgattcagcatggtagtaaattacctcgcaatcgctggttaatcaatcaagctggtccatggtctctgcagaagactagcaagtagcaactccataacaaactggcaatgcggcagaaataaccagaaaccaaaaatgtggaccgtggacaaattcagtgatgtatttccacaagaatggactactggaattggattgaaagcaactgtctatgcatcgaaaatgaagatgaaattagccaaaaaaaacaacaaaaccattaacacataattaattgaactttaattattacaaacttaaaaaatagaatattgtaaaataatttctatagagaattttgcgcagactttatcatttagcaatttgaaaatcatactaatataaacagaaacagaaaccgatataaaatgggtacctataatcatataaaaaggctttatatgcacagatatgatcaactctcgcatcagtatagcaatttccatgcagtttgcacaccgttcttacgtgacagtgacaccaa

SEQ ID NO: 23888 - DNA, 1501 bp, Oryza sativa
ataaataagatgagagtatcataaagatggaagcactaatcctaagaacacaatccgtcataacgaattttacctcttgttgatgatcgaaatcgatgcagctcaacccgaaagcaagaactcgtcgaaactaaagcaaaaagggtggcgatgcgccgagattgtattgaacgtgtgtgttaaaaattacatagggctcggggtctatttatacccgaggattacaagatatgcctataccggacatgaccactatctctaacaaactctaagataccacaagtctttgcggcagacttttgcccacacttatctataagaaatttacataaaatatcctaattaatagatacaattgccttcccaggactccatccatacgtgacaatcatcttgaagtacattaacttgaacccgatgtcgcgtacaagtcatattgtcggaatcggctatatcggcttatttagctcgactcagactcagccgatcccaaccgtagccgatccgggcatcagccgattcctgctttgtttccgaactcgatcttctcttccgactttgcttcgatctaatcttctctccgaggctgatgttaccaaatttggttgttaacacagaccaacaaggctcaaactgaatttattaaaaaaatgcagtttgttgagaatgatgaccgaaattaacttaaagaaatagggactgtctagtattgtcaactaaaaaaatcatttaattttttgaactgattgtacaagattcatgcggaaacacgcaacaaccttaacctcaccctttttttcccttttccttttcccgtgttcacttaggctccgttcataagtcctagttcctaacttcctccgcctcattttccgcgcgtacgtttcccaaactgctaatggtaccttttttttaaaaaaaaatttatacgaaagttgtataaaaaatcatattaattatttttgaaaaaaaaaactaatacgtaattaatcacattctaatgcattgctccgttttcccattccagcgaacacagccggagctagtcctgcgcatccgcatcttggaagaagaaacgagcaaaatacaacacgcaaaagagtgtttccctatgctgacggctcacgtcttctttttcttttttcgaacgactcacattggatggtgcgaagttctattgataaaacaggaaaaaattaaaagattacaatctgtaaggtcgtaaccaggaaaaacaaggcttaaagtcttcaagataagtttttaaaacgagtccaagccgccgggcagactgcgaatttgcaaacccgtcgaatgccagccagtgcacccacaacttgttacttggcttgaatcaaactacacagtggcaagtgctccttccagctatatattaatcacatcataaccttcaatttgccttaagagatatagcagaaaagaaaggaccaaccaacagcggcagcaatggtgttgatccaccatacccatgaccatgagc

SEQ ID NO: 23889 - DNA, 1501 bp, Oryza sativa
atgtgttcgacatcggaaccttgtaaaggtactgaccgtatgctcaagtatcgattttcagggccgtgatttcaaggccattgtatacaagttcctaccgaatagaaatttagatcaatggctacaccaaaatatcatggaagatggtgaacacaaggcattagatctcatcacgcgactagaaatcgcaattgatgtggcatcctcacttgaatatcttcaccaatataaggcatcgccaatcattcactgtgatcttaagccaagcaatgttctcctcgacgatgagatggttgcacatgttggtgattttggccttgcaagatttcttcaccaggacccagagcaatcaagtggttgggcatcaatgagaggcacaactggttatgctgctccaggtaagctcctaattgttgtagcttttttttatcatatttcatattatatgtatcctactatgctggattcagccaaaatggagtaagacttattggtacttcattttactacatagacaagttttgatgaaactcttatttccctaggaatttgaaaggggaaaaatgaacaagtatatggtagcaaaatgttgtatcctgtaaatggatttcgcacaaacataaataggcttgtggagttattttctcataagccatttcttatttttagagtatggactgggcaacgaagtctcaatccatggcgatgtatatagctatggtatattgttgctggagatgtttagcgggaagagaccaacagacagcgaatttggagaatcccttggcctccataattatgtcaatatggcattgccagacaggacggctagtgtcatagaccttagcttactagaagagacagtggatggcgaagcaaagacatcaaaatctaaccagacaagagaaatgagaattgcttgcattacctcaattctgcatgttggagtttcctgttcagtggagacaccaacagatcgcatgccaatcggagatgccctgaaagagctgcagagaataagagacaagttccacagggagttgcaaggagcaggagcgacaaaccatcaagacattcaaatctgttgatgcgcagcaaccaaccggatcaataaaggcgtaaagagctgcaagatttctgctactccttgccatctaggctagccaaaataaaatcataatgttgcaaattacaaagtttggcattctgtttgatccttgccatgaagatcttgtacatactatgaaccaaccacatcttggcaaatcacattattatatgcttttcctttgttgatatttcttcctcacaaaaccatatatgcctttctattccccttttgtaagtgacacagtaaacctagtcgcagtgaatctctaaaaaaaaaaaaacactatacgcttgcatcttagtttaactacccgcaggattccatccatccaggtgagttccccttcctttgtttccattaggtaatcacagaatcacagtagatcactac

SEQ ID NO: 23890 - DNA, 1501 bp, Oryza sativa
gagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcattacaagggagaggggatccaagtttttgaccagctttgacgaatcctcactctcctctctggcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaagcacttggcgcagcacttgttgcagaacgtcaggcacgccttcttgtactgcgtgttggagcacctccccgcgcacttgggcgagcactcccacggcctcaggttcccgccggcggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagct

SEQ ID NO: 23891 - DNA, 220 bp, Oryza sativa
  unsure (1)..(220): unsure at all n locations
gaaattacttgtatgtatagaagcgttgtcttnnatttactttctttttctanntnngtattttcgtagtcaacatcctcnnnnnnncnccccgcggttgatatttgacagcctctcgagnccctctagagatccccatgaacgtcggcagtcctgttggcccaancctgtcgttgctcttattcatcataataacaccagtacaatatttggggtagcc

SEQ ID NO: 23892 - DNA, 1501 bp, Oryza sativa
aagcgacatatattatagattataccagcgtgtatcgtcatcactatgtatgcttacatggatttagtaggaacatactgaattacttagattatccaaaatattgtggtgattttaaatgtccaaacaatgttcaacatgtacatgaaaaatcataaacatgtttttttaagtgataatggggacgaaaaaacacgaatgggtcttccggctagctccaccggtggtgggttagccgtttttgggttcaaagtatcaccctttctatttctttgatattaggtcatttcttaatatttatgtttttaagtgatattggggacgaaatggagacatccatctgaatttgtatttacttcaaaggtgcttatagggagcaactttaataaatacgcctaaaggataattagaatttagcagggatacatatgaggtgtcacatcgaggtcaaaacacgtaaaatttgcaatccatacataattattatttaggcggagagttagactaataaaccttacctttaataatagtttgagatatcgatgagcaatacagccaatactccatcgggtacttccatatcaaaagtcgttttatatatgtttttcttgagtcaaacattttcaaatttactcatgttatagaaaaaaaatatcaatcttcctaataaaaaacaaatacactataaaatacccacaaaaatatatttagtgataagtttaataatgtaactaatttgatattaaccttgtttgtacagttttgctatggctatagctgtatcaacagtaactagtgctttggtacgcttgtttcagtgctatagctgttggcagtgttgtagctgcagaactacaacaataggacccgagcacgcatactatagatgttatataatccctccatttcaaagcaaagacaatcatttttaacccaaagactaaaaaaataattattatttagatcatcctaataaatatagtgcatgtgtccaataaaattagagatttttagggtgaaagattttaaaaataacacaaacagttactctcttagtaaaaaacaacctcgtactcacatttttttttctgaagggagtatgttttagtatattttaaaaggaagggtgtattttatatagacttaatcaaacttaaaatgtcgtgtaatacagaacaatgggggtactaaatggtggtagtattgagatgatggcgatctcaaattacaaacgaattcttgaattgaatagtttgagaaacgtttttgttaaaaagaaaaaaaaaacaccacctccgttccaagcctcgtgccaataaaatactagccatctcgagtataaaaaatcacccgcatcctcctcattattccgacgaggaagaacccaagaacgaagaagaagaagacgcgaagctcggggcgcggccattctccgatccccagctcgccttccaagccgccgcattcccccgccgttgatgcgggtggaggccgggggcct

SEQ ID NO: 23893 - DNA, 606 bp, Oryza sativa
taaacttcccagtcccatgtcaccaccatagccccgcgcgttatgccaggccgttcgccctcttatggaaaccggccgggcgtaaccccactcctaaaccttgttcccaggtgggaccggtctcaatgttgggcaaaaacccagccgtctcaaaccatgcacaccggtaatggtaatttggctgtaaataatgggcggtctcttcaagactgccacatcacctgaacggcgcacgaatctgggcgagccgatttgcctcgcctgaaaatacggtaatgtcgtttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccaggcacagcgttggcaagggtataaaggcactgaggatgagatttgtctccttcctttcgccatcatttcccttgccttcgccgcttgcgtcctaactccttcttccctgcgcccttctttcgccacacgcgctcgctcttcatcttctcttcgtccggcgcca

SEQ ID NO: 23894 - DNA, 756 bp, Oryza sativa
agctgtagtctttgttctgactgacttaacaatgacttcttaaaagggcttatttggaagggacctataaaaattgagcctttctttccaatttccaaaaaataaaaacatagttcagaactttcagatactaaatcacttccatttactggtgagacagcaataataattgctttgaaactgttattttgatgaaattacaacagcaataagtagcattttaaatgaaaaagaagaacgataaaaaaaagttttggctttcaaattagaagtcaagattaatacgaaaacccccaaaatacagatcataacccgtgcatcagatggcatattatcaagtctacttggacagcatgggaaaatgacagcttgtctgcatatgagatgttactgtttgagcaaactctgaatacaaagtaaacgcatgactttctcaatccaatcagcttcaagcttacatatgtgcaccaagactattggcgcaatcatccactgcttagttagcaatttgtcattaagtaaattcagaagaaataaggttactgattcaaatgtcaactgcttacagcatttgcaagaaaaaccaaaagatgatttggtcacacctgcgtttcaccctggatttgtattctgtagtgtgtgaacacttgcatcggcaacttgggctatgacatcaaacatcagttaagtacaaaagttaacaggacttctcttatccctaatgactgtttatgtttgacattgtaactgaataga

SEQ ID NO: 23895 - DNA, 429 bp, Oryza sativa
  unsure (1)..(429): unsure at all n locations
aggtttggctgacaancnagctggnacccttaaattattgcattatcgctttatttaaattcccgcgttatcactgttttatttagccatgcctatttacctttgttatgaccatattattattgttattgttattattataccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggt

SEQ ID NO: 23896 - DNA, 216 bp, Oryza sativa
caaaggtgagttctttcaagaatgctttctttttttggggggccccaaaagggggaaaccaaagggcccaattcctttcggctaatataaagccaacagaactcattaaggcatagccaacctgccttgtagctcacgagagtacatgcatcttcacttagagagggtatagattggtactctcctctagtttactaatggtttgttcttcccagg

SEQ ID NO: 23897 - DNA, 1501 bp, Oryza sativa
cataaacccccaatcccccccggaaccacagagacaaggacgagcggtgggatcggttgcaccctacctgaagaggcggtaccagacggcgtcgcagtaggcggaggcgcggagcgggcggcaggccacggcgaggctggcgacgtcgcgggcgacgagggagcgggcgcagtgggccagcacgtctccgtcgaggtcggcgagcgaccgcgctggcggcggcggcgccccggccatccccccgccgccgtacagggaaaccctaggccgttccgcggcggcggcggcggcgcgggaaggggagagccggagagaagaggtggttattagttagttaacgagattactcctcctgttatttttctcctttccttcgaaggtttgtactgtgtatatatatagagatttcaaattgaccaaaaaacaagaagaagaagaatcgccgtgtcatcggccactcagctccacgtcgttgcaacttttggtgtcaaaaaggctaaggcgatattggggtcagtagatttataagggtaaaagaactctatgccatgtaggaaggcaatgcaagtatgcaaccatttaattgaacaagttgtacatgcgatgcgatgagatgacaaaccgtaataaacttccgtcttctggctagtgcaactcaatgtgatgtcttccattcggttgtgatcttgaggagatacaaggtgtcctcatattttagataatacttacttttttaaaaatattgtaacccatgaccagagattcccatacagatccagatccatagtaatagaacatatttcatctatttttatattgttacatattccaggactgaggaagtagcacttgttacattgtatttatgataaaaaatacactagggtggaatctagtgaggacaacggcgctcgcgggaggagctggcaacaacgatggtgctcgcaaacacgaggggcgatggtagcaatggcactctagcaatggatcagtagcggcggctaggggtgcaaacggtatggaaatttcccgaccgtaccgataccgtttccgcaaaactaatataataataatatttttaccgatgttaccgttttcaaaaattaatttttaaaatttttatcagcgtggcattgaagttgacactaaatagatgaattcataaatatgaaaatttcctgaccgtttccgttcgttttcgaaaaaataataaaataatgtaccgtttccgactattttcatccctagcggcggcactcacggacggatccggtggtgacagcaacgacgcttgagtgttcttcaaccttctttcccttttcccatctggcaagatttttcttattccttataggtggtccttacatataaatataatttatccaaagagcatttataaggacttctataacgtataatgtaactccagaggcttaagatatcgtttttggctacattgccatatatttttggtgagatagatggactaaaagttacagca

SEQ ID NO: 23898 - DNA, 1501 bp, Oryza sativa
tttgatattaggcacttccctaatattcgtgtctttttataaaatatcttagtactagaagacttcgaataaatccttttttttgtggtctgggcttgctctgcattgatccaacaaggctcggaagaagttcacctgttgttcctcctctttacgttgagtttaatagatatccctaaaccgtaatactagaaatcttcacatctcatcttgacaagaccgtttaagtcaagtcccacgataatatggagggatggtttcactaatgtggtatcctagtgagcaaaatattttttttaaaaaaagtggggcccacatgtaagtggctacctccttcttcctctacaaatctcactttgctgcagcgtggggtgccatgaccacccgagaaggaggatggtgacatagaggggattgtgggggtagacaccggagcaggaggggagcaggagggacgcgagcaatcgtttattagccatttagggaggtgtgtgcgcgtgaagcctaggttgcccatgatgtgttgctatttttttctatctcctcctacacgaatcttagaacaaaaccaacgattcaaaattctacgttttctccccaaaaatccgtcgacgaaaaaaaatagcaattgcaatagattgatccctaatgcgtgcacacctcggccactatgttccgaggaggggagctcgaatgtcggaacaagcctgtgccgccgtcgctttgcctcaaggtcacaacgcgtcgaggccacccagatgcccctccaccttaaggtcaccccactgctgcaccgctcaagggtgcgccgttgccgctccgcctcaggccatcgccgtgcggaatggaactgtcatcctccctaggtccgtcatccgcattcacagccaatggttctagctttgtaggggaggagggagggaggaggggattcggttggtgcgaagttaggaggacaagtgagcccatagtttttaatttttttccccctattctcttacatgtgggtgcacttcaaatttgtgattagactaccatattagtacaagtggactaagtcaacgtgccacgccagtggaaaccaccattgaaactgctaaggcctggttcggtttggaggggattaagagggaataattccacaccataataggtgtggaataaatcccctccaatccctttctcatggggattaactgaacaaggcttaagggagttaaattataccagttttaatagttagagggtaaagatatcatatactgtattacggttgggatacgaattagagtggacctgtatttgagggtatcacagtgcacttatcttaagtttttcaacatgggcagcctgcaatttcatgggccgaacagaaaggctgagaggctgagaccatgggctaggccggaaccgagcagggctgcaagctatgtgctcaagttcgagtcggacattttgtcccggccagtacgtcggttgtacgacgagtcggacatatccc

SEQ ID NO: 23899 - DNA, 1501 bp, Oryza sativa
tcatccaatcaaactgagcttataaacatgtcagttttttttttctgcactggaggcgcctggagatgacatggtactagactgctagtttgtactcctacaccacacaatttttcctagatttcacttcagttttttttcctcatcatgagtgcatggcccaattcttttttatatataattaatctcttgtaaaattgtttttaaaaaaacatttattttctggcttttttttctgtagatatgaaattgaaagggttcaagagcattagctcataataagagtgctccctcgtataggcagatccagcctgttattattggcatattctcctccccacatgcctatgatttcgattagtcatggccctaaatttgcttgcaaaaggccagatcatgtccagtggtataagaaaaaatatcattgagcacactggttacattacaccaggactgtcggtgccatgcaaatgtgctggcaatacagctgaactgcatctccattacacagtagtactaagttacaagaaatgcaatacaacctgtacactcatctaatgaaaacatactcttggatgacaggatagcagcagtgctctggactttacaatttttttttctttttctggtttgcaagtggccttttgtgtgtgtgaacttgtcctcgaacagtgctgtgagaaacagtgtctgtactactgatacatatatcgtatatatcctaaaaacatgcatacatttttgttggtgcatgctgaggagatgtagaacggtagccgctctgctatcgtcacagaataaacagttgttaaactaagatgtcagcatcaggtaattcaagcaccttgtgcgttccttttgatttgcttcctggtctaaattggtttccttcaatgtacctgcatcaaaaaaaaaaaaaagtgtgcgcctaagtaaacctaaaacagagcagattcaagtatgaaataataatgtcgtgagagtagaaattctaaagccagcttacagctccttcaaaaatggatgtttgtataatccttcaggaatcctcccaatgaagttgttattgtccaagtatctgtaaaaccattgtaaaatgagacatatgacatatcagacccaagctgatcaaatatttcactttacataaatatagaaatcgaagcagtaaagctcacaaataggtcaatcttggaatatgaactagctttggtgatatcgatccaatcagcctattattagacaagtgcctgcagagtatacatatgtaaaagaatgacgtgatggttacagggtcttgatacagtgttgacagcaaagtttaagaaaacttacagtatctcgaggtttgtcaaatttgcaatctggtctggcagaacgccagtcaaatcattattgttaagatacctgtagaacacagtttacagtaagcttaggaagacagcatttgccattcaggagagaaggaatggatatggtagcttgtaaaaaatctgcttac

SEQ ID NO: 23900 - DNA, 1501 bp, Oryza sativa
attaaatatctctccaaaattttactatttagaagtattaaatatagattactaataaaaacccattccataacccttagactattttacgagacgtaggggttatggaatgggttttgtcagtaatatacgtttaatacttctaaataacaagatttcggatggctatttaatagccctccggattcaaacaggccctataccggagtttactgctctctccgtctcataatataagggattttaactttttgtttgtactgtttgaccattcgtcttatttaaaaaaatttagaattattatttattttatttgtgacttactttattatccaaagtatttcaaacataacttttcgttttttatatttacataaattttttgaataagacaaatggtcatacaatacaataaaaaaaatcaaaatctattatattatggtacttagggagtattaactcctaccgaagtcagatctaagagtcctctgtttcaacaagctggttcactgacctccattactggatttattttattcaactttcttctgaaatttgttttctcacagtgacagtcactgatctcacacacacagcatctcctgaatcggacacaattcaccgacacaagcaaactctgctgcagcacagagaagtagtactagtagtaggagaaggagaaggcacgcacctcaagatatacctactgtttattcccttgtcctgccacgttgctccaagaagcagctcagctcgccgtgccctgcagctctaccggcagcatcatcatcacctgtatccccgaaaggcagcttcttccggttgtagctaccgagctaccagtaccacccaccctgagagccaagaaatggcggcctgattgggcccccccgtgagctccgaatccgccggcggccaactgccggatctcctcgcagccagcgcgccgccgggagggacggagattggcggcggaggaggggaggtgtccaggccaggtcaggtgggatctccgcttgcttcgccggcttagaaatcggcatctttgtcttgcagatgtgagcttgcaagtgtggggtctccgcgtctttttccaggttagaaatggcatgttttgtgttaagtgagaaaaaaaaaagaaaaaaatctttcttgggcacagacaagtatttattcttgctatatctgatcggttaattcagttaccgttgcttagtatgtcatgtcttcttgttgaattcagatagttctggtgaaatttagaaattttcgcatcagtcactgagtggctaattatgcatacttttcagttatcatatcagctcataatcttccaatccccgcaaaagtttatataagaaattcataatattccagaaaatggatactcttgtagtgcatagaacaaattttgatcgtgatttgttataggtggcaggcatggaggtgaggctgctgcttctagtgttcatatgtctgcatgctcttctttgggcggctt

SEQ ID NO: 23901 - DNA, 1501 bp, Oryza sativa
cggtgtgtgggtggtggtatatttttccctttttcctagttacaacttccagggttgtaatcttataatttttcttctgctctatcaatagaacttcgcaccgtcttatgcgagtcgttcaaaaaatattataacttgtatgtaattataatataatatgtatgtaactttttatgtatttttaatctggtatatttactttaagactctgcaagcgggaaaggaaaaaatcatagcgcaaccacgggtgatgcaatttggtcacgtgtactcctttagtggaaataatgtgttaaacaaattatattatagttatgtgtaagttacactataattatattacaattttaatatttacattggtaatccctttcaataatactttgctatacctggatgagttaacgtttttatgtaatcaattaatttaagtgttaagcagcaggacatgcctaacgcatttcttggctcttaccaacaacatgagaagggttgcgttctgctatagcattctgttagcgtttgcaatgatcaaagccagcttcagtatttcatcaacgctgtttgattacatttccaaacagttgtagtactgatcacttttgctacagatcacactctctatatttcagttactaccttagttttttaaatacttgataccattaactttctgacaaatgtttgaccatttgtcttagttaaattttttatgtaaatataaaaaaatatgccacacttaaaaaacattttagcataaatcaagtcgcaataaaatgaataataattacataaactttttaatatgacaaatgattatacgtatctaaaacaacaacaacattacatattaaaaaagggaggaaatatgtgactagataaattcagtagattcagaaaaccttttgctgcaacgaaaaaaaaaaaagctaggtgcgaattgtggtgggcctatgcccctcgagtcggcttcgggtggcccggccggccggagatagcgaagctggcctgctcgttagcccgcccccaatgcggcccacgtaaatcctgacaatcgcgacagataaccgttttcacgttaactaggtcaaaagttaaacaaaccgttgacaaaccatactttacaataatgtcaaaatgttcaatacaaactcatgattatctgtagtacgctgtacacattagtcgttgttaccttgcgagatcaaccgtcttccaagagttgcctgtgcaaatttgacgtgctcgctagtcgctagttgcccgtccatgtgctaataaaaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaa

SEQ ID NO: 23902 - DNA, 1501 bp, Oryza sativa
acgcgatctcccggggcgctcccgtatgcccttgcgctgctagagatccgggctcttctcggtaagccgctactccctaatcctcgagtggaactgcctgattcgcgtccgattccttcccgcgggcttacgctggtcgggaatttcatgttgctagtctgcgtgaggcgcttgctcgttgttggtgaggttgaagagttggtgtctttcttggatatggaactaggagtctacagtctaggacacatcgccgatttgagtttctatggatatattgatgttcatatttctgctgtggaaataatttacaacatcctcgaccatcgctaacttacaatttccatacggtttgtaatttggatgttgcgggtgatcttgttgtcacttgtcactgggtgcggctcaagagagcggctgcgctgttgttgtgcactggttagggagggacacatgaccggacattgattagttcaggacaactcaatgtttcagacttgaagcagaggcagcagatgtggttctggtggccaccaatagagcagatagtattgtcagtatatgctgtaatcccatggaacttttgtgatcaaataggttgggatcttgatcagggccatttcctaatgcacctgcaggcctgttaagagcttatgatttttaatcatgtccgctgaaattctccgaagttgtggtgtggtatctaaagttctagacactgtttaagctgtgtatttagctgggggattgggttaggctcattaatctgggtgaaacccattcgtctagaagctgtctgtaaactgtaaccaaatttgtttgaggaggcatgcatttatcgatctcagactccaccaattaggctctggatactaaaatgatgatgaacaagtaataggagaaggcaaacggttttgtctccaagttgactgtcagttgggtatcgtttcatagcttaaaattttgagcctgcatgaacttttgcattgtctatttgattcttcaatttattgtgcacttgtgcagtaaagcccatgtgatctgtacttgatggtttctaacaacatatccatgacatcttcttcatttccttacatgctagtacatttgtatttgcttagatattgttacatttttttcagatcattctgtgtttccccattttcgcaatcactactgcactatgaaactgtattactggactacccacaaaactatacaatatgaaataattctatgatttggtgactggaaatgcgtcttctaccgaacatgtttagaatttttttggggcttttatatctgttaagttagatgatgctactttatctactgctatttcttttgctttatgagagcattttgcacttggatttctttttatcaacataaataggagtagtggctagacttagtggagcaacatatatgttatgatttgtcttctgtaaagcaggatctcaggagtacaagatatagtgtaccagctctctctcattcaaca

SEQ ID NO: 23903 - DNA, 168 bp, Oryza sativa
ctatacaatgagttttgtgtgttttcgtttgcagaggtacttgcttgggcgaaagaaaagagaccaagcgtaactaatgcatggatgatcaaagaagttgattggagaccaaaccaagaccttatccaagcctacttctacctcaccatgtcacttttggtccataga

SEQ ID NO: 23904 - DNA, 1501 bp, Oryza sativa
tattatctgaacctaaaactaaactaatctatctagtaacatactcgtggtaatgctacggtggcatttggtaatacaaatgttgtatatccacgtcactgaaaatatgcttttcattgtttgcgtaatataaaatgttgtacataaaaaactcggagtccatttacaaatagaatgaatcactgaaaacaggagcacttttaccaaacattagctaagcatcacaatataaaaaccaaggtaatgctgattttcatctaactttattctttttgtttgaatatacaactcaataatagatcagtctctttttactatgaggtggtttggtcctccatgcaccaagaaataagtacatatggttcaaaagttaaacatggacaatttcttcttgtgatgttatgaagcaatctgatatatacagtgcccttcctccaaccatagcacatgctcatgtcttgttcttgtttcaagatcagagtagaaattacctctagttattaggtcccccctaatttcacctttatttggcttccacttattggaagatataccctgaagatcactcagcaatttctgaatcggaaagggtgtgaaaaataaaccttttaatcattgaaaaggcaaaagagtatggagcaaaatacattatctgtattaaatttgggcatagtaaataattaagggctttctcaatttaaaactccctcatagtaaaaagaggctaatctgaattttgggcatagtaaagaattaagggctatctgaattaagggcatagtaaagaagcaacgatatgcaatttcgtaaagaaaacatacttagcttagcatctttatggagatcttttaacgcatcaaagcttgaaagagaaaaaaaaagcattactgggaatgtttagttccaaaaataccctgcattaaaaaaagttccataagcatctgactgcagattcttaacgtgatttaaactgtgtgcaaaggagaattgtattaaaattggcagcaacacaaattaatacacttcgctaaaaacagtaggaactttttttgttgttatgggaatattatttgtggtcatgggaataatatttgtgatccctctgaacaattaatatacatattgggagtaatcatcacctagatggctgcaccaaattgttttaaacatatgcataagaatatataatttacaaatatgataaactcaatatatagatctccaaactttggacataactcttcctgaaactaaaccacaattcatggatcaaacatacctaataaatatatcatttcggtatgccaccctactccatttatagttaacagatattatgtcataattcactatgtatagatataacatgtgccaaatactgaaaatagggtgagaaacacatatatgtcaaacatgaattaatttaaaataataatggggacttcacctcgcggggacatctctaaatatcgcacaaattgatttcaatttttttttcagg

SEQ ID NO: 23905 - DNA, 1501 bp, Oryza sativa
gcaagctggccggccgccgggtaacatgcacgcagtggtcgtgccccacacgggcgtgcatgcagcgccgcagggagaggaggaggctttgctcgcgcgatcggtcggactgggacgatcgatggagtattaagcaaacaaccggcacggacggacgtgagcgacaagtggttggctggagctggaagtctggaaccagttacatattcgaacgtcatgcatgcgtcttatttgaaaccctgggttttcgtgtccagtttgtccatctgttttatttaaaaaaaatatgaaaaaaattaaaaagatgagtcacgcataaagtattaatcatgttttatcatttaacaacaatgaaaatactaattataaaaaaaatttcatataagacggacagtcaaacgttggacacggaaatccagggtttgtttctttttgggatggagggagtagtctttaaaagagggccattatttcttattattactctatctaacaacaaggtgtcgtcttttgcatgaaccgataaggagaacgaaagctttaatttgacatgctgggccggctcctgtcattctgtcaatgccaaagcggatggcaattcaaactggccactaattttctggtcggtttgcttaattttaatttcaaactgaacgcttgaatactcaactctatatatatgctgatttgctgaattttctgctcggtttcagtacgatcgcaatcgattcttccatcattatagatactcatgtcacgtggacatcacgttagccaaaacagctcataacgctatcgagaaaattcgtttgcatcgattttagaagttgtgggacgacacctgatttcgcggttgagggatgtggcacaaactcaatttgtatagttaagggacataaaatggactttgctattgagcggattgagtacagtgagatcgagagcaccagaagcgaagcagcacgtatcactcaatgatgggccttgaccgaaaacgacgctgtcagactgcgactgggccgagcgctacagtttcctttcagcacgcgcgcaaatcccacccccctggtccccttgcctccctcggcccatcccgccgcgcacgcgagacgtgtcgtcccaatccgccacgtcctcgcccaaagctccacgacagcagccagcagcaggtgaagcagcttggcaatttggcagtggtcgtgggctcgtggctggaaagtggaggaaaccaacctgcaaaacccaaggcggcgtgcgtccgtcggtggaagccgcggacgaatcgccacgcccaccgttcggattggccccgtcgcactcacacaacttgtgtgcagccctgacacacaaccgcatcagatgagagctcccccggaaaaagcaaagccaaaaaaacccccgagattttacagccataccccgcacaccacgccacgcagatcttttctcctcttcctcctcctcccttgactttcccccacggcgaggcgagggcgcgagg

SEQ ID NO: 23906 - DNA, 383 bp, Oryza sativa
attctgtttttctttgaaattactccgtacaccctaggggcgtgggtggtcaccctgaagacgacgttgtgtgaggtaaaacaaactttgttagtacgatctcgaatcagtaattttggagtactcgagttcaggccaaagatcgaacaaggccaaagttcaatataataaagtggtccttttgtattatttaatccaagttctactccttaggctgtgtttagatccaaagtttggatccaaacttcagtcattttccatcacatcaacctgtcatacacacacaacttttcttttcagtcacatcatcttcaattttaatcaaaatctaaactttatgctgaactaaacatagccttagccacaatgtgctgcatcatgaa

SEQ ID NO: 23907 - DNA, 1501 bp, Oryza sativa
gatactaattctatatatcagtcgtctagttactaattaatgttcttgcacgagtcgtgaaccgggtgtaattttgctcattagtcattacgatgcatggtttgtgtatgaaacatgcttaattgcaaatattttcttcatttttattttgagttccggccactgtttgtatatgtactagcgtgcattatgaatcattgacgtgcttattacctccgttgcaggttgtaagatgttttgattttagtcaaagttaaactgttttaattttgagcaagtttatagaaaaaagtagtaacattttcaacccaagacaaatttattatgaaaatatattcaattattgatttgatgaaactaatttagtattataaatattgctatatttatctataaatttagttaaacttaaaacagtttaattttgataaaagtcaaaacagagggagtacttggtaagagttatcgatcgttcaatacactcgctggatcatccggaatccgccagcagcaaagagatcggtgcctaacgatgtatagtactgtagaccgatgtgtacttaaaaattagtccatcattctcaagcaaacaaaatgcacgttttcttgatggaagacggcttacaagtgcacgcatgtaaaggtggctacggcactggcttctccaacatttaatatatgactagttggccaagagcacaggtcgaaaacattgtatctgaacttgatcccagtttttggatgacgatcgatggcgaaatgcatattattattatctcattcctgtcattggtacgtacgtacttaaccggccgggaagtggaaaaagaggagagtttcttttgcgtcctccttatgatgatccactaggctagctaattaataaatttaacggtaatatacaatctacccaatcaattgagcacatgcatgcccaaaaattttaagctaaactcaaaattggctgatataataatatacgatcaaaagataacgtataaatattagaggagtctggttctcagtaaaaaaaaatatcaacgaatttcagtcacttttgaatggctcagatcattcgccgattcttacaaacacagtaactttatccttcccctcgtcctcccgccaatgcatacaaggcaagtcgtttatctacattaaaataacagaaattgctaaacttctgtcgacagaaaatacaatcttaaatcttgtaaattttggatcactggatgtgcttcacgattcgtgctcttcttctctaactccggcgaccacctcttcttctctggtgccggcgaacccaaactccgacagagggccgatgaattagggccccagggtagggtggggttgggaggggggaggggaatgggaagaggagggagttcgccggctttagagggatggccgttgtcgacgtttgatgtctcgactacggtatttggacagtatggggatcgtcggtgctagggtatacgcgagactgaggtaaaagaga

SEQ ID NO: 23908 - DNA, 1501 bp, Oryza sativa
ttatcgtatattctaatgtaaaatcaagctacttaagatataaaaatttacattaaaaattttggtattacctcttgatatcactgaagtaaagtaaattttttcgcattgaattttggtggacaaacgctcatgctattctcaagttgcagagaactttttttttgacacagtaaacctctgctttcattaaccagtatctccaggcaaatcgccggagaccaaaggagatacaaacgtcggggcttggctccagaaacacttggagctagtggccacgatacccacaccaaaagaggccaaacaatcagccactttgttacaagatctagggaaaactgaaatagaaaagacatcaaagtttgatcttaagaaagcccttaattttctgaaaatgacaccatcagggcgacggttcagatcttgggaaataagtgctttgcccagcatctgtgcatccgttttaacctcaatttttgtcatcccctgttgagacactttttctagacttttcatcattgctaacgcctccacatgcagggcgttgcccatccacgataagcttccagcagaaagaaccctttgaatccattgccacaaaaccccagcctccagtgccagtctcagcgaagaaggaagcatcgatattaattttataaacatcttcccgcggcggcttctatttttccatcacttttcttacattttattccccattcttccttatcttctcttacaagttgcagataactggttgtatatctgcagagttaatcagatgtgccattcctcataagggcccaagaacagggtaagccggtaaggccttgcttggatgaggctcattgcaggcccatctttgtgtgtgggacccaacattcaggcccataaaaggaggcccatctaaacttgcaaatcgttcagtccaatgcaggagcacttcgactagctcagttttttttttctctttttgaataatggacctttttaagtccagtatcatccgtgaaatatggatgattttaccatctttaagaatataatagaatttggtacctcgaaatactttctctcaataaccgtaaaatttctcatgaaatattatttcaaattaagagggtgtcggacagtcggaaagaataaatctatttcaaggattagagtgagattttaccaaactaacaatgttttcagtgtgttccatctggtcttagtattcccaactcgtataatcactatcttctttttgtccaagtaatatacatatactgcaccatgtttttttcctttctaaaatccaagtatttatctacctacttttctattttatactttcgctggtaattcaaaaagggtaaaaaagtataaacgttatagcatatatatatatatatatatatatatatatatatatatatatatataagaaatttatttgtatcttgtgatcactgcagttgcagaaattaaagatcggctttgtgaaagcaagatttctgaa

SEQ ID NO: 23909 - DNA, 228 bp, Oryza sativa
atgttccggatttgccgtgtaccgactccagcaagtttcgcactctgtcattttcggccgttattctatcgctttaaataccaaccgttgccctcaaaaaatctcatgccgtgacttccgttttcaccgcccaagcgaaactttgtcctttctctcttcggcgattcctccgacgcaaaatcgatccccaggcgatttcgcttttgatcaaatctccgcctgcggcga

SEQ ID NO: 23910 - DNA, 1501 bp, Oryza sativa
ccgtaaaagagctagaacaagagaggataaatcacggagcacgcaccggcgagcggaggcgcgcgcgtcggggaggatgaggtgccgaggggtcgccgacgagcgggcgagggcttcggcgccggcgaggcgaggcggaggcggagggttagggttggaattggatcggtgggaggctatcagtatcagcggcgtgggaaaggtgggggggcgcggagaggtgggccgtcggggaagtacagggagaggagcccgtgtgcccccgctgcgggctgcgtgacgcggcccaaatttctgtttctccgcggcccaatgagagcgggggaggctttgccgcggcccacgttgtcttatccaaccaagggcccgtttcgccgtctccctctgctcgggtcggccccgcgcatagggtttgttagggtctcccatccgcagcttcttttataatctctatcggttagaagttcctttaataatctaggttttttttctcggaatcaagtccatagttatagattctagaaaataaaataggacatgtttggagagcttaagattctaaagaatcatctggatagtagccagttctgataatatggaaaagttgtgtttttcaatttctgacttttattttattttctggattctttaactatattttcttaaaatctaaacgaaaagctaacttttaagggaacggaaaactagactgttttgaaaagcttgtgatcctgaaaaaagctgtagctacataatctccccgaacaggctcatgtaagctaaaagttgggttctcatccagattatcgtcagctaatttatcatcagttgtttcccaaaatattaaacactccaaacagactcgtaatattgtacgctacacgatggggaaccttatcaatctactggatcggcgtgcgagacgccgaccaaaaatctgaggcgattgtacggtgcgcggctgcgaagccagcaggcagcggctcagagccaccacacgagtacacgaccaaggggaattcacgagaatggagaatggcacacattagctttaggtggaggacagctagcgtgaatgacaaggactaccttagctcgatctcatgtaatcggtgtaagcgtgaagcatctgtgagctggtggaggcatgcatgatcgtcgatttgtatgggtcgggatgaccatgagcttattatccttttctatcccgtttgttctccgagcacacatttcggcctatttgaatcaaatgcaaaaccataggaattttagaggattttatcctatgaaaaataattctatatagtcatttgaaacaaaggattatttcctattaattcttttaaaattcctatggaatgagtaactttggagaaaaataagcatgaggtctcacctcatgttttcctcttcatgtgtctaagattcctgtgtttttcctgtgtgctaatcaaacgatagtttggagactttcctgtgtttcaaaatcccataaaaatcc

SEQ ID NO: 23911 - DNA, 1501 bp, Oryza sativa
ctggagcggccactcgggccgccgcgggcgcgtctgctcctgcgacgtggtggatccccgcggcggcggcggcggcgagcagccaccgccggcgtggaagctcgccgtgaggagccacccggcgtggcgcgccaggtcgaggttcttgagcgtggcgctggcgcgcatgggcggcggcgagttctgcgtggtggagtggaggtcgcggaggggcgtgagcgaggaggagctccacgagcggtgcctgctgtacgcgaccacgttccggctccggtacgacagggacgggtcgctggaggccacggatcgccgcgcgcgcgccttcaccgcgcgcaagaaatcggacgagttcgaatggtgcgcgtttgggatctgatcgtctatctgaacatcgagcgcgcgcggtgtctgacttgaaatttgcgttgaagatcgtgtttgaatccaaagcacatttttaactctcatataattcattttagacttaatccagaccatggaacaactcaaaacaacgttacctaatgtagtataaaaccttacgtttgacttgttattagctctccgtcccaaaataagtttattaagtttatttttcatgcatcccatacatacaaatagaacacctacaatattataataccactttattaaatcctctttatctactctcaatactccctccgtcccaaaaaaaaagataaaccctaatttccgtgttcaacgtttgaccgtccgtcttatttgaaaaaattatgaaaaaaaataaaaaaaaaacaagtcacgcataaaatattaatcatattttatcatcgaacaacaatgaaaatacgaattataaaaaaaaattcatataagacggacagtcaaagttgaacacagaaacccagggtttgtctttttttgggatggagagagtacataccttactttcacaaacttattttgggaaaaatgggaaaagctaaaaatgaacatgttatgggctagagggagtatttactactccagtacaacattggcagctgataataatatacaacgtcatgatggtctataaagtatataaaccatatgcaccagaaagataataaaaacactagagcaaaaaatcagacattgagatgtcacagtagtgcttacttttgattttcgcaagagtagcataacatatatacatcgtaaaaaggtagggtcggaaagacagaattacagtaaaacctgagtgattcatgtatatcaatgcaataattagagttccatcttacaactactgtccctgaaggcctcaatcgaatggataagaaatcacacttgacatcctcccccagagcacatgagattgcaaatgctaaattttctgctgctgagttataaactgtaatgacatggagtacaatataactcaattgaagatctctctaacgagccaatccaaactgggataagcaaagtagaggatcaaaaaggacggcagtgcaaacaaaactgtaacaaggac

SEQ ID NO: 23912 - DNA, 1501 bp, Oryza sativa
acaatgtgtattacagacatgtatttgtgtgtgaccctaaagagctcaaaaacttttttttaaaaaaaatgaagaaatgaaaccttattaatttggattctggcagaacgaagggaacctggagataaatgatcaatgttgtttcaacaatttcatttccatccattcattcaacaattttaccttacgaacataagaaaatataaatctcccctcttattgatctcagtatctcacgcaatcacgctacatggatgggccaagcctatccacgcatgcaggagtaaataaataaaaacataaacaccacactttggtaattaatcaaagcaatctcgatcgccggagtttcgccgtcgcagagctagctgctcgatcgatcagtggatgggctcgaaggagacgagcttgcgcgcgttgctccgcgggtcctgctcgtacaccaccgcctcgtacctgccgtccttggcgccgctgctcgacgcctccagggtgaggcggtagttcacgccggcgaccacctgcttctcgccgtcggtcaccctctcgaacgtcagcccgcccgccgccacccccctgtcctcctccgccaccgcccaccggccgagctcctggacgtgcgggtcgttgatgtccaccggctcccatgacccgacggtggccgccgtggcgccggcgacgatggcgacgacggcgacggcggcgagcaggaggctgctggtcctcatggtcatggctagtagcttagctgcagctgctgcggttaaacttttttttttaacagtgggtgaaggtgaaaagagaagcaaagtagaggtcgtttaaatagatggaagggtgtggctgccaacaggtagaaaattataggctgctaattgctacctatccaattgtatgattcaattagcatccttttaattgctggtgatatcttaacatgtatatgtattatgctcactaaataagaagaaattaattggcaggtttgtaattttacaaattgggatatgctttgatttgctctcatgcatgttactctatctggttataagtacatatagtttgggatctctaaatgatttccaaatcaattatttagatatgaaatctgagagcaaaatagtaggcaatttttgggatacagtaaatgcaattgtgtattgacgggatgggagcaattctactttttgccactgacatgtgattgattcaacaaaatagccgtagatgaatgtgagttttacaaaatgccataacatatactccctccgtcctaaaatataagtatttttagactctgacacagtctccaagatactattttgatcaacaatatctataaaagtaagatatttcaaatgaaaagagttgcgtattagatagtttgtttaacataaatatagtaatatcaattttacatgactgatcttttttattttctcaccattaatagttaaagttgaaaatatttgacttatcactatactgaaaatgtttatat

SEQ ID NO: 23913 - DNA, 1501 bp, Oryza sativa
cctctcctcttgtactttttggcaatagagtcgtttcctctcctcttgtactgaatatgttaccctttgagtctaaatcaagcaacaattcgatccccaaattcactatttgacacttttaactgccccacgccggcaaatgcatgaatgggaaatcacataaatggggaaaatacatttttataggaaattaaatgcatatgtaaagttgataattttaaaacaaggagtaggaagaatacataaatataattctttggatggttaacaacactggaaaatagatgaaagaaatatactgaaatatgaaagagatgtactgaaatggaagcttccaaacgattggaccttctgctatcctttttctttttagaaaaatcatgcattgtgccattgcaaaggaattttacatgatttggaagcgctagtattttgttctaaaggtcaaaggagaaattttcctatatatgtgactttgttaccaagggcactttatcaaccttatgtgaaaagttcattttatcccgagcagtgcatctcacctttgggaagtgcttcatatgttctggggtaagataactcttcccgtgaggtcaacaaagtgcatttggctaaaggctaacggcgatggtaaaaagaaagaaaaaaaaaatactctctccgtttcaaaatataaacattttcagtatagtgataagtcaaatattttcaactttaactattaatggtgagaaaataaaaaagatcagtcatgtaaaattgatattactatatttatgttaaacaaactatctaatacgcaactcttttcatttgaaatatcttacttttatagatattgttgatcaaaatagtatcttggagactgtgtcagagtctaaaaatacttatattttaggacggagggagtatatgttatggcattttgtaaaactcacattcatctacggctattttgttgaatcaatcacatgtcagtggcaaaaagtagaattgctcccatcccgtcaatacacaattgcatttactgtatcccaaaaattgcctactattttgctctcagatttcatatctaaataattgatttggaaatcatttagagatcccaaactatatgtacttataaccagatagagtaacatgcatgagagcaaatcaaagcatatcccaatttgtaaaattacaaacctgccaattaatttcttcttatttagtgagcataatacatatacatgttaagatatcaccagcaattaaaaggatgctaattgaatcatacaattggataggtagcaattagcagcctataattttctacctgttggcagccacacccttccatctatttaaacgacctctactttgcttctcttttcaccttcacccactgttaaaaaaaaaagtttaaccgcagcagctgcagctaagctactagccatgaccatgaggaccagcagcctcctgctcgccgccgtcgccgtcgtcgccatcgtcgccggcg

SEQ ID NO: 23914 - DNA, 1501 bp, Oryza sativa
ttgttgaatcaatcacatgtcagtggcaaaaagtagaattgctcccatcccgtcaatacacaattgcatttactgtatcccaaaaattgcctactattttgctctcagatttcatatctaaataattgatttggaaatcatttagagatcccaaactatatgtacttataaccagatagagtaacatgcatgagagcaaatcaaagcatatcccaatttgtaaaattacaaacctgccaattaatttcttcttatttagtgagcataatacatatacatgttaagatatcaccagcaattaaaaggatgctaattgaatcatacaattggataggtagcaattagcagcctataattttctacctgttggcagccacacccttccatctatttaaacgacctctactttgcttctcttttcaccttcacccactgttaaaaaaaaaagtttaaccgcagcagctgcagctaagctactagccatgaccatgaggaccagcagcctcctgctcgccgccgtcgccgtcgtcgccatcgtcgccggcgccacggcggccaccgtcgggtcatgggagccggtggacatcaacgacccgcacgtccaggagctcggccggtgggcggtggcggaggaggacaggggggtggcggcgggcgggctgacgttcgagagggtgaccgacggcgagaagcaggtggtcgccggcgtgaactaccgcctcaccctggaggcgtcgagcagcggcgccaaggacggcaggtacgaggcggtggtgtacgagcaggacccgcggagcaacgcgcgcaagctcgtctccttcgagcccatccactgatcgatcgagcagctagctctgcgacggcgaaactccggcgatcgagattgctttgattaattaccaaagtgtggtgtttatgtttttatttatttactcctgcatgcgtggataggcttggcccatccatgtagcgtgattgcgtgagatactgagatcaataagaggggagatttatattttcttatgttcgtaaggtaaaattgttgaatgaatggatggaaatgaaattgttgaaacaacattgatcatttatctccaggttcccttcgttctgccagaatccaaattaataaggtttcatttcttcattttttttaaaaaaaagtttttgagctctttagggtcacacacaaatacatgtctgtaatacacattgtcaaacttaacaaggtcagtcatttcctagcgaataggggccgtagtgttggccgttctgagttttggccggacgacagttgtaaccttatctcacacctggtgagtgtggacaattcagtaatctaatgaattccctttccccgaaaaaaaaacttaacaaaaatctaaatatttggatcaactgacacatgtataaatcacatgacaatttccggtgttattaaaaatttaaaatgaaccgtaaaaattttgacggcataaaacacaaagcatgtcacatttgg

SEQ ID NO: 23915 - DNA, 192 bp, Oryza sativa
aagagctcaaactatgggaaagtattttttttctagaaacagaacatccaggtagattttatgattaagtctctttatctccataagaaatccttacattatgttaagatcaccagaaattttatacatcttcaatatctggctgaaatatgcaaatctctgttaaacggaaattgtttttcatacaacagg

SEQ ID NO: 23916 - DNA, 211 bp, Oryza sativa
ttctttaagcatgacataagtatttttatatttgcataaaaattttaaataagacgaatggtcaaacgttggttaaaaagtcaatggcgtcatacattaaaatacggagggagtatatattatcactccatgatcagtactgtttgtacaaaaattatgcttacctgacactatcacgcatgcatgtctagctccttgaagcctggaaatc

SEQ ID NO: 23917 - DNA, 888 bp, Oryza sativa
tatagattatttatgggtaatccctataagtaatcgattcacggtagaaatttggatttaactactagggattttaccagtgtattatatttaatcatttagtcatagactaaattaaatcgtataatatttctaggattccgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaataataaagttaatataaagaaatcgactttcgcattcgactttcatttggattcatttggatttttatttgaattctaaccgaattcaaatcaattttcgcacgtaactatagagcccgagggagttgcggatccaagcgaaggtcaagacccgcaagacattgagcaatgcaagtcatcactattccttgaacatgttgatcccaattgcgaaattgttttgtttacaaataaaattgcatgcaatgatgaacatcccagttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaagaagaaataaaattaaacaactgttttcgactggggcggacggaggatttgggtggtatctggaaaaggctagtactgtcgccggtcaattaaggaccgagcca

SEQ ID NO: 23918 - DNA, 1501 bp, Oryza sativa
cgccaagacttaaattagaagtgatggattattgatggataaatacagtaaagtactcaactgacacagctcatacacaccctagttaattttcacagaagacctcctttttcagatttacaggttctgtaattttcacagaagactttgcagttaactgaccaatatcatcaagacttgtacggcaattcttggaacacatgaaaaaagaggaaactttcaaaggaaaacactagtgggaaaagtgcatgggcattttagtagttagtacgtgaactgctagttaatatttcactttctgcatggaaacttgacacaggtttggccttttcttggtgactgctaaaagagatgaccatgaatgctaatggttgtcaatgtgtaatctgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgccgggcgtggcgtggctggctggcggcgtgcgtgcgtcacgtcactatccttttgcagccactaacccacgttcccacgattccctccgcaacagcgcgtccacgttctttctcctgatagataaggaggccgcgagtccgatccgagttcctcgcttctttcccggtgttagtttctccttctccgcgtctgagttgctctcgcttccctgcttctgatctcttgcgcgcacgagagattggaagaagcagtgcctccgaaaccacaccttcgcctgagatctgcaccgggtaggcgggtgagcgggtgatcaggtttttggggagtgcctcctgcacgactgctcatcgccatgtcgtgcctcctgcacgactgctcatcgccatgtctggagttgctgccgccgctattggcggaggtggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgtaagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 23919 - DNA, 1233 bp, Oryza sativa
cccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcatcccaacacatgagacgtgtcacggcaaaacttttcgataacctcgcattggcagtacccgctccatgaacttcaatcctcatgcactctaggcgtccatgtttctagcagtgagaggagttctggcgctcccgggaaagagaagtctcacacacatattaaattatggttcaagttaagttctctctctcacacactcatggcagttgtcacgcctggaatttctatccaaaattccaaacgcttacatgtgtgtgaaccctcgtccaggaattagccgaggcacacaataacaaattgataatagagtacaattattactctaattaataagcgaataaaatgtcattacagaggtagatagttcctgtcaatcaataaagatctaagcagcgaaaaataagataaacggcgcagacggctccactccacaggcagcttgaccaaggctacacctaatcctccacaccatcagcttcactgtagaactcttcctctgatgaatgattgcaaggtgagtatatgacatactcagcaagtcacgcagcaaatatgcaagtgcacagggtaacaaaagggtggcatagtagggtttcatttgcacaaacagcatttaataaacatttcagaatttaataaaacagttaagtaataattaaacaatattaatccaacgctatacaacataccctgttgcataggcccaaccattctgaacaaccatcccggctgcacagttctatctccaaaccaggaatataccattccaaaccaggagctaaacaaattattaccagttatagcatctgttatcatgatgagaggtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccgcggtacctcggaaaggagctgtgacaataccccttgcacaacacaatccaccacagcgcacctttcctggatcataatcacccccttataaacaaggca

SEQ ID NO: 23920 - DNA, 354 bp, Oryza sativa
ggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttaga

SEQ ID NO: 23921 - DNA, 1501 bp, Oryza sativa
aagaaatcgataccaaataatgaagcagaaccgaagaaaaggaaggagacaaagaaaaaatgaaaacagctagtaatcaattttatgtggaaaacattagcatatgtttcagtcagagagttttatttagtttcataccaaccagatagacatgtttcataagctacattagtctgatttccctgttcttgaacagtgtttattttgcaccttttattttgttatgggcatgttgatttcttcctgaatttcagtatgaaaatttctaccttgatttatttatggacaagaaaatgtcccacattatatatgtgtatagaaattccctacattgcaagtggtggtcaaaacaagctggcaaaattatgacagattatcgcttgggctgttgggcataaagtgtaccaaatgtctcattcagacagaagcatacaattctgaatttttcgtaccaatttggaaacaaattatgtgaggcagcttttgatgcatttggaaatcacttacagagtacttaataaaagcacagaggaactttatatcactttcatcataattccgtacataatgaaatcactcccaaagtacttacaaaagaacctacaggaactatacatcacttgcatatatacttctaggtacatatattgcagaacatccaaacccctgtataggcagccaacacagagaaatgtcacttcgtcagtcccaaaattgctcaccagattgaggcatagctcctgcgtgactgtgactgcgtctgctggttgcttgtcgttgcgacaggaggtccggcggggatcccctgtactcgtcgtgtccagcggcgcggcggggatcccctgtactcgtcgtgtctggcggaggcggcgccgctggctgtggacgaggaggggaacagagatttgatgttgtcggagactcgatctgcgcccagcgaatgtggaaggaaggagccagcacaggacgcggcactggtcatggcgccgccagtgttgccgaacctgtaggacgtcgaggtcgcctgctcgatgaccttgctccgtcgacgccgcggcgggcggcggcagggcctatctttccaatctttctaccgaacaatgggatcgtaatataaaagttactatggacttttctgtaaaatgagatggtcaatgctaatgtggcactttcgcttaggtggaacaatggcgtggcaacttttgcaccatgagcgcacccacctagccaagttattgtaccgctacgctcggttttcaagtttttacacctaatcgcacccacctgccaagttcctgtaccgtcaacgcaatttactcttttttttataatcagcaaaagttgttggttttatatttttccactccataggggtgggaaaaagtctataagtatcgttttaactgttccagcacgtattgtgcctacttctttgtatgtttttagtactagttcgattgtcatttatgtggcatgttatagatatatatttcttgatgat

SEQ ID NO: 23922 - DNA, 1001 bp, Oryza sativa
ggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttagattccggcgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcatttggtggaattaacctattgtttgttatagccctttttgttattggttcctttattccttgataccttgggttattttaacttgactagttgggctatatatattggttcgactagatattagatgtgattgcttagccatgcttagaaacattagcacactattgggataacttatgattcattattatttaatgatggcttaatgctagttcacgatggtcaatcgtgattggttaattaattccttgcctactaaaatttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataag

SEQ ID NO: 23923 - DNA, 1090 bp, Oryza sativa
cttgctttcgggttgagctgcatcggtttcgatcttcaacaagaggtaaaacttgttatgacggcttgtgttctcgggattagtgcttccatctttatgacactctaatcttgtctatataattcgtcaagttatcatatattttacataatctttggcaatatcatcatctaacctacaatcggctaacatccgttaatagaaggcagctgattaggttaaatagtgaagttgtcctagattatatgagatatctaccactttatgaaacacccagtggcttgattgtctagatattattcttcttttcatacttaatgctgcatcagttgagtttgatctattaagtcatgcttagaatatcaatctctaacctgtcctctggttgcctattatggtagtatcggagtttcagccgatcttatctgatttaaccatattcgatctatatgcttcaatgacatgttaaatccgccttttgtgtcaagatatcgtcgcaatctaaatatattaagcttttgtttaatacattatacctgttttaatatcttgatatatagtagtatcggagtattagccgatacaagctagatctatctgatcggctatgctataaacatatataatcctgttattgatatatatttcgatctaagtgatttatactatctcggcatggtgaccgatctatcccaatcacgtgatttaagtatatattaatataagaattatatatcgttaatatctacagccgatcgaatagatttagttccttactatctatttataaccgccgatcgattcatatatgacatcggcttaaagataaatgatatgtcatcggcacctagccgatcggctatcatttatagatttaaccacgaattctttgtctctatttcttgttgataacaggatcaaatcaactagcacgctcatacattcgaaggcgagctttggacctgcactggagttaagcagatctaccctggtctacgtgttttctcatcaagcagtatacacagataatttctatatatagtgcgacaacgttggtgcatactcaatggcacaacagaaacggaacacc

SEQ ID NO: 23924 - DNA, 365 bp, Oryza sativa
cgcagtacagcgcgttcctttatccggtctgtgaccagtcacagaccggtcagatcacgggttaggtggcgacaggcggtcagacgcatgcttcgccccatcctgtctagacgagagcttctaggcactcgtccccggctggagctagcgtgttatatcccagagatgacacgttagccccggtcgatttataccaggcttcatcctaaccattacaggcaagatgttgtgtgaagaagggcaaacatgcaagttgctaggctgacgcgtggtgggcaagaatgaccgatttgtgaccggtctgacattggtcatgtcatcggcagacagccacgttcccacgacgcgcctgcctccggcagaaa

SEQ ID NO: 23925 - DNA, 234 bp, Oryza sativa
gttcttcgctaataatctctatctctattcgttcgattcctaacttctttcgttctttcttgcattatatatatatatattatattgtgttcaaccatgtaggcatcgactggctggactacaagaagcagcgcatccgctcgcccagtcgcccaccgggaaagttgcttcgcccattcgctcctccggccaggacagctcggccgtcgctggagcggcaacaacggcgagccg

SEQ ID NO: 23926 - DNA, 1501 bp, Oryza sativa
tgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtacaaaagcaatgatctgaaccttggtactaatgcaaccatgctgttagtgcttgcatccgaatttattctccttagcccatcactaaatgttttcccaggcaataaccaataaaccttaaccttcctcttagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatatgaaataattggtgatgtgttatacccgcataaggaaaataatacactaagattatttgcagattattgaactaattatatgctgctgataggggtacaaaatacatatagcaagaatttatcattgccaatgttactcttatatcgtatacagctacaggaaacaccaataattacagtacaaccaatctcgtggctagtaccattatatcacttcattgcattgtaataacaaataacaggatattcaagtgaaagaccaaaataatgcagccatcgtacagatcaatgagaccttaactttgcaatcatccatcaattgaacaaaaaatagaaatctactaccatcagcaagtgatttaccataacaaggagcagaagctccaagaactcaccgagtcggagccatcccaaagcttgcagcaatcacgtcgacagcagcagtttgtggacttgaattggcttggttatggtttagggcttgaattagtgtggcacacggagccctcgtcgccgccgcgatgtagttgcacggtttccctcgtcgtcgtcgtcgccgtcgccaagtcgccgccgccgccaccgccgccgttgcgtctccaccagtgcaaccacctctcgatcaggatcacgtaagaaagatgaagggagatatttgtacgttaagaaatcatattagggggttttctataaaatgagataggtctttcgcgtcaatgctaatgtgccactttcgctgaggtggaacaatggcgtggcaacttttgcaccatgggcgcacccacctagccaagttattgtaccgctacgctcggttttcaactttttgcacctaatcgcaccctcctgccaagttattgtaccgtcaacgcaatttactctaaaaaaaaaactgataccaataatataaatttcattttttaacaaaatgatacccaagtaggggttaaaagtgcgggtactttaatacaaccgaaccgagacgagcggaggggagtgaggaatctttttcggcttatttt

SEQ ID NO: 23927 - DNA, 607 bp, Oryza sativa
gtttggctgcctcttctggaaaacattcaataccctatttctcctgcaaatttattttatctacaaagtacttcatccgttttacaatataagtcattctaacatttcctacatttatattgatgttaataaatctagacatatatatctatctagattcattcatgtctagattcattaacatcagatagatatatatgtctagattcattaacatcaatagatagatatatatgtctagattcattaacatcaatataaatatgggaaatactagaatgacttacattgtgaaacagatggagtataatataaagtgagggttaataggagccatcgatatcgtcgtgaaggtataaaatcaccatgttaataaaaaaaaagagagaaaaaaatcatatgccatcatggtgaggctgacatattatagcggtgtaaactacccaaacaattcaactaattttcgcaaattgagactaatattatagcggtgtagattaatgcacaaacaattaattcaactagtttccataaagcgatagattgagattatagcggtgtagattaatacctgaaaaattgaactagctttcacaaaatttgcagt

SEQ ID NO: 23928 - DNA, 1501 bp, Oryza sativa
agatcttgatgattgttgatgacttttttagttgaaatcatttagtatttgaaaatgttgtttgaagttgtcatattttcaaattcacattcaaactgtcaaaaaaaagttatatagaaaaatgatcaaaataaaaattgtaaatattgaaaggttatacaactttgttgttgacaatttttccatttgaaatcatttactacccgaaaaattattttgactaataaaatgaattattatactacagttaattattttgcttcatgtcaactcacaaatataaacatttcatatgaaaaatggaaaaatactaagtcattgtcagggttacggattagggataccccttacccttcgatatatgttacatatcgatatggcatacccgtgcatacatggacattctctgtacgagttaaggaaatccttcgcggaattggcagatgtaaagagatctactcggacaagactaggttgtcagcgtaccgtgtgcggtttgatgtctccgagtcctgcttggagactacttgacctgcggtataaaaaggaccccctgggaggacctgcggggtcgaatctcatagccaacaccaccaccacagcctacgaagtcggagcccgcggaagccagatcgccgagaggtctagtcgaattgactcgattacgatctcgtcggttttatcgagttccattgttccctttgtaacctgtgatttccatcatacaatcccataccactggattagggctattacctatcaaggggcctgaacctgtataatcttcgtcttctgtttgcttgatgtcgtactacgtagacccttgtaccaacgtaccccaatactctctatatccggtctacgggtatcatccgtcgacagtggcgtgctaggtagggggacttggtgctcaaggatctactactatttcatccagcctcgtcgacaacagcgtcaacgccaacctcaactacgagcttcctgcctcgacgacgcttacgtgcactcaagtcggcgaaattgtctttccggtttacaccatgatgccgatctcagctgggccgtcgaggaccagaaacgagaacgcagtggctgtagcccaagatgactccacgtcgaaggatcctcccgccgaagcggagaacggaacatcgacgacatccgagctcgagaagaattctaatgcggccaaaccttgtcgttccgacaagaaacacaggccgacgagaataacttccgaggtgacagggtcctggtgccctatccacaaaaccaggaaacacactttgcaagcctgcttggtcttcctcaacgcccgcaccgagatccgcgcctgcaaagagcgtggaattcagcgtgtttctccaactcgtggtgtctattgtcctattcacaagacaaagaatcacgacctttcaagctgtaaagatttcctcatcgtcaccaagatgtcatctcccaaggtccagcagccaggcaagacccttagagatgaagacaa

SEQ ID NO: 23929 - DNA, 1501 bp, Oryza sativa
cgggcaccccccgagcggcgctcaccttcaatgaggccgccgcctggtggtccgcgagcggtccgatgacgtcagccagagggagagcctgtatcacatgaagtcattttccgacccaggagacaaagacaaagattgtggtttcgcgctcggtcgcctccttatcgcaaagagggacggggacgtcgctggccgttgtcaggccgctgatcattaactgaccgacgcggcgctccacggtggcgtcactcaagcctgcagatcgagaacagaactcgataaatcaagaagaacatgaacggaaggggatcaatttaaccaaacaagaaaaataccccgaggagaaaaccgggtcacgtcctctggtccagagtagtcaaaggctggatgggcacgagcctggagccgctggatccgcctactaatgaagtcggcagcaacttcgtaccctgacaaacctcgcgctcggaggtcatcgatggcatcgataaacaattgaagagcaggggtcaaggtgggttttgcggtccaagatgggattttgtctggctgttcctcgggaacgacaaagatcagatctgaatcctctatctgaaggtagaaccacctcgcccgccacttactacgagaagaagggctctagaaagggatgtatcgcgacttcaggccatctcgaagtcggaaacccacacatccagataccctggtggattccatccaacacaactcgtagtaaaagcggaagaggtcgagaaatggctctaccccaatgtaggcctcacaaagatgggaaaagatgctgagaaaggcaatggaattggggttcaaatggagcaaagaacggccgtagaaattcaagatcaagagaagaaattcagaaggcgggggaagaaagccacagagaatataatcctcgatcgcaaccatacggcccaggacaagttcgggttcagtacctcctggttccctctccatggttccacggccgggaagggcgccatcctcctgtagcttcttcaacgatgcgctggtggaggtggacttgccgagatccattgccgccggaaatcgccggagaaggggccgagatgaacaagctctggttttgcaggagcggaggagacgaggaatgcctggaggctggagagctttcttccacaatgggcggacttcaaagtggatcctcaaaatcctcttaaatagatgcgcttccgacggtgcgaatttcaaggaaaggagagagattaccgccggaaatttctaggtccgttacgcgcggcagtttttcagacttcagtttaaattcactcatgaccgttgggtttcacatggtattgtcgattgcgtcctgtctccacggttcatacaccgagaacgacaacagcttcgacatcagaagtcgtgatcggtcacatgagttcatttaagcagaagtagggggctactgtcagggttacggattagggataccccttacccttcgatatatgttacatatcga

SEQ ID NO: 23930 - DNA, 1501 bp, Oryza sativa
ctgaatctggaaatttatccctcacagctggcaccaatccctacaatttaattaaaaataaggtgaattctagtccatcatcaagtttaaaaataaaataaaatatgatgaaatagagatgtaaggaataccttttgtctatctgtcataatagtatacggtgccgtgttgtcaataaggagatcttctttcaaagtattcaagaaccaaccccaactagctctactctccacttccacaattgccatggctataggatagatgtagtcattggggtcaatgcctactgcagtcaataaatgtcccccaaatttggttttgatgtggcatccattaagaaaaatgataggtctacaaccacttaagaagcctcttttgcaagcatcaaatgacaaatagcatgtatggaagcacatattctgtaaattcaagaaaaatttgctacctggattagatgtcctaagctcttgtccataatcccataacatatcatactgagctatttcatcaccgtgtatagcctccaaagctaaccttctcgctcgtcctagtttgtatcttgatggtgttacatttaggtctttttgaactactttacaaaactcttgagtgtcatcttatcattatctctaaagctttcaatgtacctatttgcaagatatctagcagtacataattcaactcccactctttttgacatttgtgaccatccacatattgttttatcataaaacattttgtcctgctgtcctcagaggcatttaacatccatgggcattcttcagaacatttggcctctattcgtttcttggtgtttcttgcaaatctgattgcaactctatttttcacactatattgttttattgcctgcctaacttcaatagcatcattaaacaacatcccaaccttaaagataggtgactccatgtccacatcagccacaaagttcttaaatttcaacttgatgcccccataatcttcatcagatgactctggtagcagcaaaccttcatcatctggatcacatgcaggaagctcaactactagcttgctagcctcagcattttcagtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtacaaaagcaatgatctgaaccttggtactaatgcaaccatgctgttagtgcttgcatccgaatttattctccttagcccatcactaaatgttttcccaggcaataaccaataaaccttaaccttcctcttagaattatcatatcctagttgctcaataaaatcatcaagccataaggaagac

SEQ ID NO: 23931 - DNA, 195 bp, Oryza sativa
aataagatgaatggtcaaacatgtgagaaaaagtcaacggcgtcatctattaaaaaacgaagggagtattaaaaaatcaagaaaatttcactcttctggaaatcagcaaggcaaacattaaaatgtctaaagctgctctaccgatggagtaagccactgcagcaacacgtatacgccaaaaaggataatgatata

SEQ ID NO: 23932 - DNA, 962 bp, Oryza sativa
gttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcttttccgaggtaccgtggtggtattgaggcacatggtgatatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcctttga

SEQ ID NO: 23933 - DNA, 413 bp, Oryza sativa
gttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataag

SEQ ID NO: 23934 - DNA, 1501 bp, Oryza sativa
gagggttgcctgccaacgatctttggaggggattcatggtcgattttgtgcagcaagtgttaatgaccaaatttggtaatatctgcattggaaaagaggattagatcgaagcagaatcaaaggcggaaatcggtcctgaaacagagtgagaatcggctagagtccagatcggctacgattaggatcggctgagtccgagtcagactgggtgagccaagacagccgattctagcaatggaacttggtgtgtgacattttgagttgatatgcttcaagatgattgccacgcattgatagagtcctgagaaggcaattgtatctattagttaggatgttttatgtaatttccttagagatatgttcgggcaaaagtctgccgtaaagacttatggtatcttagagtttgttagagataagagtcgtgtccgatatggacatagttcttgctttcgagttgagctgcatcggtttcgatcttcaacaagaggtaaaacttgttacgatggtttgcgttctcaggattagcgcttccatctttacgatactctaatcttgtttatgtaattcgttgagttatcatatatcttacataatctttggcaatatcgctatttaacctgttatcggctaacatctgtcagtagagggcagccgattaggttaaatatcaatgttgacttagattatatgggatatccaccactctatgaaacttccagcggcttgattgtctagatattgttcttcttttcatacttaatgctgcatcagttgagtttgatctattaagtcgtgcttagaatattaatctctagcctgccttctggttgccgattagggtagtatcggggttttagccgatcttatctgatttaactatatttgccctatatgcttcatgatatgttaaatctgccctttatgttaagatcttgtcgcatttaagtatatcagacttttgtttgatatattatacttgttttaatatcttagtatagagtggtattggagtattagccggtacatactagatccgtttgatcggctatgctatgaacatatataatcccattattaatatatatttcgatctaagtgattcatactgtctcagcatggcgaccgatctatcccaatcacttgatttaagtatatatcgatataaggaatatatattgttaatatctacagccgatcgagtagatctagttccttcttacttatttatgcccgccgatcgatatatagatgacatcggctcaaagataaatgatatgtcatcggcacttagccgatcggctatcgtttataggtttaactgtggtttctttgccattatttcttgttgattgcaggatcaaatcagctggcacgctagcatacccgaaggcgagttttggacctgcactggagttaagcagatctcccaggcctcatgtcttccgtcaacacgcttttggcatgcctagtgggaccgattagaagtcaaaggtttctctca

SEQ ID NO: 23935 - DNA, 1501 bp, Oryza sativa
gaccagtacctatccactgtgcacaaatcatgcattttagagcattttggatttttcgcataattcggtgtttaattgcataatgtgtactttatttagatgattgcttaaacggtgaagaagtgatttaggtgctgattttttccagtttcaaggaaagtcccacctccctctctctttgatcaagttgatcctatgtttttggaggttattgaaaatgtttgcaaatcttgcatatcgattgtacactaatacattaaaattttgtaaaacttgttagacaaactcttattacttgcattatcactttaaccccacatatatccatatcactcattcctaaccttagtaattatatcctattactacttggaatatgagttacattgtcactagtttactatattcttagccatgcttagaatgattttacttatcacttgggctcatattaacatgaaaaatgattttatttagattctggacatagatgaataaatgaagtatttgacaaataaaatgatggaaaacttgaattttaggtttgggcctcaagtggtgcacatatggtgattagttgtgtaccgatagggggagtgtgcgcccaaaccgacctaaggttttcactcaatgtatgttcattatgtataccgtgcaaccacatgtgctagtatgggatggccttagctcattaagttgtttattatctatccttgcattagggaggccgttgtagtagcgatagtgtctacgagtgaactgtagggctatttgtgtttatgcaaaggggacgactgtaccgatccgccttttatgtgtatgatgtttatcaggggacgactgtaacgtttcgcctcacttttatttatggtttggtagggaacgactatactgttccgcgtgaggggacgactgtaatgttccgcctcacgtacaacgttgagtgccacataggaagcgactgtatcggcttgcctatggcgttatattggtaaagacccctccaatataatgacattaagattctagacttagtgtggaacaacactcatcgtgctcatgcaaggattagataataaataatgtaaaggcttcgttatgacctctagaccacattcaatgtgaggacgtcccaaagcctaggtggtgcaacgctccgaggcatgtcagcgcgaaatatctggatggatggggtctcaaataaagcccaaataaatacgataaccatccaacctcatcgcagaccccgacatgtcttgaagagtgcactacataggctctaagccattggatatgaaatagaagacaaccgttggaatagccacaccagtcatttatgtcatatggccgtcaaccactcgatggtggcgaccaaaagcgtaccccagagactcgatctcaacaaaggcatattccctggttatctcaaccatttcaaacccatcctcatgtgggactagtcgcccaggaatgcaacatagtctcacataaatcatctcaa

SEQ ID NO: 23936 - DNA, 1501 bp, Oryza sativa
gctgctgatagtgacagctcagtacgggtattcctccgcgccgatatataatcctaagttaatttcctagggagggtattcctccgtatttaaccctggttgtatggtcatgacgggctgtcgtaaggaactcggtagtcaggggtggcttctcgaagtaccaggagggcatcggatagagggtattagctagtatatcagttaactagaatgtatgtatactatgtataatagaagtatagaaatatattttatttctcttttctttccacttagcttagatgatttattatgagaatgagtagttcatgcttgtgtgtcactctacccttggattatcttaagccctgtttagaatatgattatcacaagtaatatataaattattagtcaagctctctctacatgatcttcccacgggataaaataaatacgatacccttggaatactctcgggtgaaatgctacaatggtatatccgtgcgcttgcggatgaactctgtaaccataatataccagaagtatttctgcgccattgctgggaattatatttctagtaatgttgttaagaaataccaacattgacacccctcgttgcctgggtactactcgccgacaccgggtgatccgctccccgcgcaggacagctactgcgttgccgactgaaggctcgcaccttcgagccgatcgcatacaccgccgccgggtgatccgctccccgcgtaggatggctactacgttgccgaccgaaggcttgcacctccggagctgatcgcatacgccgccgccgggtgatccgctccccgcgtgttggcccgccaacatctgcataaagatcagataataaaacatccaacatagtgataggtgcttaatctcacatattccacaagtgttggtgtatatttgtatgcagatgataaaccttggtgttgggaggaaaatcagactaaagtgaggagaattttgcatccatacaaggaggggttgtgaacttcatcaaaacatcagtgaataacctcttggttagttcctaattagcatacgggattattgttcactataatcaactaaaatatagtgattgctttggtgagttataaacactaaagtagatagtaattgcttagacgtggtgtgtaggtaattgttatccagtaattgttgcgtatcccacagtacgttgaggtgggtgtagaggtggtgatagccctcgagatcactgaagtcctccctgtccgggtatgtagtagagcgacatctcggaacagcgggttgccagtgcctgaagtattgcgttaggattaaaattaagctttccctagacactgtttctcactagtgaatcctctctatcctggcctatcatttgcttggtgtccttggatgaaccggaggaagctctgagcacacatgttcccttggattcgatacccttataatactccgtaggggaagtgctacatcggtatatccgtccacttgcggattctatctgtga

SEQ ID NO: 23937 - DNA, 1501 bp, Oryza sativa
cagaccaaacattcattttagttgttaagtaagttttaagaattaaaccactaacttggatacattgctaggcctgcccataaccgagggcgcggctattcgaatagattatactctgatcagaggtgtacaactttacccataagacacatctttacgccgcattccatggccttggaacccgtcataaaaatgtgacataaccctttacccatcttagctgtaaacaaaagcaccgacccaacacccgcctacggccggaaccccttggacaggtaagttatggttgagcccctagcagcaggacatccaccgggtgtgacctgtgccacgacatcttgactaccgaacacccgcccatgtagccttcatttgcctcagagatatccatcgcaacgacttcagccatctccatctgtgtcttttttgttcaggattagactgagcaccgagttaagccttacccattagacatgtggttagtacggtagtgctttgcaacagaggcccgaagaccggtccttatgatggctgaggtgctactatagcccagcctagaaccattttgggggttttgaatagagtgggaggtgtgtgtccaattccacataagccaaccattccataatgtccaaatgatatgagaattcccaaagtctaaagttataaaaccacctagtgttgcctgattaaccagccaagcatctacctaagtttatactagtggaaccatgaatagtgttcccactagttagggttttattttcctaaggtaaacaaggtgatactaacaatatcaatcatgaggctataacaaggattaataggtaatgctaaataaaagagtgagaacgcgggaatttaaataaagcggtaatgcaataaattaaaataaaataattttataaactgggattcaatatgctcaaggatgatgcgacttgccttgcttagagagaacggccttccgaaccttcggcgacaaccacgaaccacgctttaggaacctgcggaacgacaggagctacgcgaagcacacaagcaaagctacaagcctataaagaagcaataacagtacataaaagaaaggcacatggttctttaggttataacaaaaattaagagacttgaacgggtcgattcagagttcgtgtgatcaaaatatgatctttcgaagtctatgttaacgaccaaatttggtaatgccatgggacggattcgaagctagagtcaaagccgatttggggaagttcagttcgagaaagcagaacacgcatcgcttacaagcagcattggctaccgcatgaatcggctgctacatatcggctaaacatcagatccagcggagccaagctgatgcaaccagtcttaggaaggattggagtcctaaaagggcaattgggcaattgtatctattaattaggacatttttcagtttccttagagatattttggtaagagtccacctaaaggactcattcgtattttaagttgtgtcaga

SEQ ID NO: 23938 - DNA, 365 bp, Oryza sativa
gcgttatcactgttttatctagccatgcctatttacctttgttatgaccttattattattgttattgttattattaccttgttcaccctagattaaacaaaaccccaactagtgggcactctactcatggtaccactagcatgattttaggtagatgcttcgctattttaattaggtaacattaggtggtttttttcaactctagactttgggaatattcatatcacctggactctatggaatggtttggttattgtgaaattggcttcacaccgctccttctattcaaaatccccaaaatggttttaggctgggctcggggtgcatggttttgatagtagcacctcggccatataaggaccgtt

SEQ ID NO: 23939 - DNA, 1501 bp, Oryza sativa
ttgcaaatctgattgcaactctatttttcacactatattgttttattgcctgcctaacttcaatagcatcattaaacaacatcccaaccttaaagataggtgactccatgtccacatcagccacaaagttcttaaatttcaacttgatgcccccataatcttcatcagatgactctggtagcagcaaaccttcatcatctggatcacatgcaggaagctcaactactagcttgctagcctcagcattttcagtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtacaaaagcaatgatctgaaccttggtactaatgcaaccatgctgttagtgcttgcatccgaatttattctccttagcccatcactaaatgttttcccaggcaataaccaataaaccttaaccttcctcttagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatatgaaataattggtgatgtgttatacccgcataaggaaaataatacactaagattatttgcagattattgaactaattatatgctgctgataggggtacaaaatacatatagcaagaatttatcattgccaatgttactcttatatcgtatacagctacaggaaacaccaataattacagtacaaccaatctcgtggctagtaccattatatcacttcattgcattgtaataacaaataacaggatattcaagtgaaagaccaaaataatgcagccatcgtacagatcaatgagaccttaactttgcaatcatccatcaattgaacaaaaaatagaaatctactaccatcagcaagtgatttaccataacaaggagcagaagctccaagaactcaccgagtcggagccatcccaaagcttgcagcaatcacgtcgacagcagcagtttgtggacttgaattggcttggttatggtttagggcttgaattagtgtggcacacggagccctcgtcgccgccgcgatgtagttgcacggtttccctcgtcgtcgtcgtcgccgtcgccaagtcgccgccgccgccaccgccgccgttgcgtctccaccagtgcaaccacctctcgatcaggatcacgtaagaaagatgaagggagatatttgtacgttaagaaatcatattagggggttt

SEQ ID NO: 23940 - DNA, 234 bp, Oryza sativa
tgatccatattgaccatgttttggtacataatattatacattaaaagtccatgaaactttctacaaacgcttctaagctgccacgtataccctataaatgctcctaagccaccacgtggcactctgataaattagagaaattcttaaaatctcttagaaaaaggcaaaaactattgaatttcatttaatccggtggacctaatatttttaaccattagatcaatctctaaaaga

SEQ ID NO: 23941 - DNA, 321 bp, Oryza sativa
ggcttctccttgtttccactgcctagggcatcctcgcaccgacgccgccgtcgtatctcgccgtcgtctcggacatctacagaaaatgttacatccgcctccctctctctctcgacgacctcgatctctctctctccccaaaccgccaccggccgcctcgttgccgacgccgccgccgacgtcgacgcggtcgaacacgactccgcctcccgccgatgccgaccccgacctcgatgcggccgccatcgccgacgacgtcgcgccggcagtgccaatgatgccgccgcaacgcctccggaccgcgtcacgcccgccgtgcca

SEQ ID NO: 23942 - DNA, 255 bp, Oryza sativa
tcaagaaactcatttttctaagtagaatattcaaaaggtttaatgagctgtagaaaaaaaacactaactatatatttattggcatatatgtatgtaatggtgataggagctgtatttatggggggggggtgataatgtacccaacattttagtctacaaaatatgaggactgagcctgaaaagggttaggctaagatttaatagatttttgagttaaaaatatttaaaggctgaggtgggttgtgaaagagccca

SEQ ID NO: 23943 - DNA, 628 bp, Oryza sativa
aacgatatatatttttatatattaacatatacttaaatcaagtgattgggatagatcggtcaccatgccgagatagtataaatcacttatatcgacatatatattaataacaggattatatatgtttatagcatagccgatcagatagatctagcgtctatcggctaatactccgatactactctaaatcaagatattaaaacaggtataatgtattaaacaaaagcttaatatatttagattgcgacgatatcttgacacaaagggcggatttaacatgtcattgaagcatatagatcgaatatggttaaatcagataagatcggctgaaactccgatactaccctaatcggcaaccaaaggacaggctagagattgatattctaagcatgacttaatagatcaaactcaactgatgtagcattaagtatgaaaagaagaacaatatctagacaatcaagccgctgggtgtttcataaagtggtagatatctcatataatctaggacaacgtcactatttaacctaatcggctgccttctattaacggatgttagccgattgtaggttagatgacgatattgccaaagattatgtaaaatatatgataacttgacgaattatataga

SEQ ID NO: 23944 - DNA, 1372 bp, Oryza sativa
atgacagctcagtctagatccgatggggctacgcgatgacaacgttggaggcgaggacaacagcttggtccaacgtagctcagggatggaaccacacgtgtcgatagacgcgacgtgcccatgaagagtggatctagtgacggcaagtccttggagcagtggatcaatgctggctgctagtcctgggtgcatgtatccgtaggtagccacgagaacatgggccggcggatccagtggccgctggtccctaatgcgttgatcctgcattcactagtccacgggatggcgatgacaattgcaactctgctactgctgcaacaactactagggttagggtgctgatagcggcgaattgccactgtagaggggatatagggaatttgttatggggtttttgggaaaattgtaggcaagaagaaagttttattttggctctttttataaatttcctatagttttatttccaattcaaattcatccatttaaattcatttctaactttataaacatctcaatttatctttgattaaaaccttattctgtaagcacatctctttcctgtttaattcctagaaactaattattttatatcctgctccacacaaatttcaaattcttatacccatgaaactcctcaaccaaatccttagcctactcctttaagtcccttttgctttaccttcgaataagctccaaatcaaaattccaaattcattcctttgaaatttgtttccatcaaacccaatgctattcatcccggcaaaaattcctataaaacttcatttacactcagcctcgaaactcaaaatagtccataaattcaaccttcgaaaagttatcatcttcaaattcctaaaagacatcgtatttttcatgggctaaaattcccaatcgaaccattccttctaccactcctgacaccctcccatctgggccagatagccacttgcatgcatggcacaaccaagccaaggtaggcagccagctccctccatcatcccgtgtgccctgccatcaccgctgataccatgagcaccatgacgcgtagaggtaggcggcaggtggtgacagccatattcgtcctttgtaatcgttcacattcggagtctccttggaagactaggggtaagccggcgcctgaagcaattgatagagttttaccataacgtaattaagaaaattaatccgtaggaacactctctattcccagcctaccatttagtttttgtccttggatgaatcatgttcttagattatacatatatgttccctgtgaatacgataccctggaatactgttgggtgaaggctacaacggtatctatgcgcttgcagataattctgtggtcgtaataaataccgacaacaggtaa

SEQ ID NO: 23945 - DNA, 189 bp, Oryza sativa
tgatggattaattaggcttaatagattcatctcgcagtttacaggcggaatatgtaatttgttttgttattaatctacgattaatactttaaatgtgtgtccgtatgcgtcaaaaaaaaaatttttagtacatgaactaaacacagcatctgttactccctcttttcccatttccatttctttttcaga

SEQ ID NO: 23946 - DNA, 350 bp, Oryza sativa
tggcacggcacgttggcacgccacatatgcaaaagtggcaaatacttaagaaattacctctctccagtggcaaattattaagcacaaacctaagaggggtatttggataattggcaaacctaaaagtggcaaatagttaaattcccaagtcccttgggcactggcagcatcaacctctgcttattcaacaatagtatctttagtctccttgaactctaccattttgtcaacagcgtagatggcgagctaagagtaaaggtgttcctttgccatgtcgtggccctgatgggaccaatataatctgcaaaaggttccgagctcagttcggacgtcattcgtattctccaata

SEQ ID NO: 23947 - DNA, 1501 bp, Oryza sativa
ttcaaatcctagaagaagcagtcaaaacctgcatcactcaaagactaagtttaaaacctgcaagcaaaaggttaattcaacggcaagagtcagtacattatttgaaataatatactggcaagcaccaagacaagcctaacactctacttgtaaggaatattatcaaggaaggcataatatggttcgttttagcataaagcaagttttgtttgcataaaacacatttaaatctgatttgctttcaaatagttttcagcaagctagtacttagcatatgggcatcaaagtagacattaatcatgtatgaatatgcacctcattgccatccatggcagcaaggagatcattctcaaatctcatcacaatttgaaagtaaatttcagcatttagaagaataaacacaagtctatactcaacacatatccatatgccgctcataaccgcgagcacggctaatcgattaagttttagactctgcagaatttgtacagctttacctacatgatatgaacactctagtttgtttcgagtttgcaagactctaccacattctacacgttgaatataacatacccaagcctgtaaacctgagaactaaatttaatttaaatgcatcatgtggttttggagtgattttaattgtttttggatcttaatcatctcatcatcacatgcaatgataggcctagagtcacaaaaacaattaatctggaaattatatgcatccaaaaaaaattctacaaaaattctcaaaaataccttgatatgtcagaaatcaacccacaaattttcagaattttgtttagtaaggtttgctaactccttgatctactttaatatctccaaaatcctgaaaaactgcttagcagattcaaacttgctctccctgtaaaatttatttcaaaacctctttttgatgtttggtttcagccaaagtcttctactaactttcttctaacaccccgaggagtggcacaccctggatcactctctaaccctttcttctctccctccaaaaatccaatcagctgttaactgcactgtcaactgctgctaaccaacactgtcaacacatgttcattactccatcgaacctaaaccagagacttctaacccaacccacttcagcacatttactctccacatcacccccgaccaagaggatctctagcccaggtttcttgctgttgacagaaaacacgaggcctgggagatatgcttaactccagtgcaggtccaaaactcgcctttgggtatgctagcgtgccagttgatttgatcctgcaatcaacaagaaataacggcaaagaaaccgcggttaaacctataaacgctagccgatcagctaagtgccgatgacatatcatttatctttgagccgatgtcatctatgtatcgatcggcggtcataaataagtaagaaggaactagatctactcgatcggctgtagatattaacaatatatattccttatatcgatatatacttaaatcaagtgat

SEQ ID NO: 23948 - DNA, 1501 bp, Oryza sativa
cataaataagtaagaaggaactagatctactcgatcggctgtagatattaacaatatatattccttatatcgatatatacttaaatcaagtgattgggatagatcggtcgccatgctgagacagtatgaatcacttagatcgaaatatatattaataatgggattatatatgttcatagcatagccgatcaaacggatctagtatgtaccggctaatactccaataccactctatactaagatattaaaacaagtataatatatcaaacaaaagtctgatatacttaaatgcgacaagatcttaacataaagggcagatttaacatatcatgaagcatatagggcaaatatagttaaatcagataagatcggctaaaaccccgatactaccctaatcggcaaccagaaggcaggctagagattaatattctaagcacgacttaatagatcaaactcaactgatgcagcattaagtatgaaaagaagaacaatatctagacaatcaagccgctggaagtttcatagagtggtggatatcccatataatctaagtcaacattgatatttaacctaatcggctgccctctactgacagatgttagccgataacaggttaaatagcgatattgccaaagattatgtaagatatatgataactcaacgaattacataaacaagattagagtatcgtaaagatggaagcgctaatcctgagaacgcaaaccatcgtaacaagttttacctcttgttgaagatcgaaaccgatgcagctcaactcgaaagcaagaactatgtccatatcggacacgactcttatctctaacaaactctaagataccataagtctttacggcagacttttgcccgaacatatctctaaggaaattacataaaacatcctaactaatagatacaattgccttctcaggactctatcaatgcgtggcaatcatcttgaagcatatcaactcaaaatgtcacacaccaagttccattgctagaatcggctgtcttggctcacccagtctgactcggactcagccgatcctaatcgtagccgatctggactctagccgattctcactctgtttcaggaccgatttccgcctttgattctgcttcgatctaatcctcttttccaatgcagatattaccaaatttggtcattaacacttgctgcacaaaatcgaccatgaatcccctccaaagatcgttggcaggcaaccctctttgacttagcctccaaggctattttcgaatttctttcactgacagtgggccccacaccccctgggacccacatgacagcctcccactctcccctcgcagcatccaccgtcccccatgcccgatggatgcccaaggaacacaatgagtgcaccagccacctctctctctctcaatcccccactccactcttccttatttcccaagccaaagcaccggaagcaacagcacactccccacactcgcgttccaagtccaagaaaacaaaccccac

SEQ ID NO: 23949 - DNA, 1501 bp, Oryza sativa
ggtgaaataatttctattttatctctttttatttgggagttatgaattttagaagtttgcttcggtataggatattatttgccaaggtagtgttataaaatattaaaatatttttacaaagtgattcttattaacttttactccacagagatgtagggaagtattttctaagactaacacatttggtttcacaatttttggagttataatgattttcttatgaattttacaagttataacgtgttgtatgcatataatgttttacatgcatatgtcttgagagctttatatccagaacataatacttcttgattgagttgagtaaaaggaataatttggttaactaatccatttttagttcataagcttatggtcttattatcgtggtttagttcataagcttatggtcttattatcgtggttcatatttttatagactaggggagatctagtctatgctagtacctagaaattactatatgagctaagttcttctaagttttggtggatggggatagaactatggctccactggtcctaataagttttatttggatttatttggagctaccatgcatatatatacttattcatatgtattgtttaaccactattatgtgtttagtacctatactaccaaattaaggtttagagctatggtctgaacagaggttgccatatttcactctactaggttgaagtatattacttgctggttctatagaaatttggttcacttcatttagactaaagatgaattttctacaaaatttacaatttaaggtatgctctatgttggttatcacttacataaatatttagaggcttttattacacagtaagtatataattttatattataacttggaagtatatgttttggtaattctacagaacttgggtttactcaaaaaggatctaacatgaattttatataaacttctaaatttcagcccacagaaaactaattattttgtttatactagttttagagacattaggtacaaagtaagtatattatcttatttcactttacagtggagaataagttggtgattctgtcgaatgtgaatttaccctaaaatgagttgagatgaattttgtatacattttataagtttatgtatactttatgtatgatttatcttatatgaattttagaggctaaatttgtactgttagtggaagtttttattccataacattaaattacataacttggtgagttcatagaaatttgtttcatctaaaaatgagctatatttaattttatatggattttacaagttttaggtacttttcttttataatctcggatttttgtttccaaagggtccactgtcagtgatttgcgaatatgcagaaagacccttcaggttttctaagaataaacccgcagtcctaggcccatatgccattgagtggaaaagttacatattgaatcttggaaaaagtacaaattacccctccgaactatcacggtcgtccgaattacccccta

SEQ ID NO: 23950 - DNA, 1501 bp, Oryza sativa
cttaccaagataatccaaggtatctcccggcagtgctttgtttatggtcacaagctcaacctttgagacatctcactgcaagattagtgccacaaacacatacgagatttgcaatatttatgataaataaaagtatccacaaccacacttctaatcatgttagaaatgaggaccataaggtggttatggttctcgcacaaggaagtgatactattcggacagaactctgaggattctttatgtgagcatgattcctgaggaaatttgaaagagaaactttcatgctcaaaagtgtcgttctcatcctccagagttgatgtctcaaggttgtccatggcctgcagtttctccttctcaagagatgcatcgtgcaagaatgaggttgtttcttgacaactgtcgagaacaacatcttgatggcaagagggacaaggttcaggctcgataggaggttgtgatggtggttctttggagtgcaattcaagagtctcgccataatctttttgaatgaaatgaagatcatcttgttctagaatagattcaggggactcataaagcagaaccgccattacttcctctatcggcgtattattaggaagatgaccgtcaagattttctcataataggtatgaggatcatccctgaatttagaagcacaacccggagcttgaatttctttggaatccagtgatagctccagggaggactctttagtcagacccgaagctgttgaaggctcgggttcaggctttgcaaaagaaggttcctcccttcctggcacaaatgcctctagatggagttcaacacactgcccgacaaaggatgtattttccgctatgcgatcaagaatttctttgctttcgacgggagttttatgcatgaatgaccctccagccgttatgtcaaggtagaatgcagactccctatctaaacccgtatgaaaatgctgcaatagcatgtaatcgagtatagacagggttgggccagactgaactaaattagtgaatctggactaggctgcaccaattgattctttatttatctgctggaaactcaggatttctacacgaagagtagtaatacgggttactaggaagaaggcaagacagaatctgtctcgcaacttttcccaactaccgtttacacatccaacggtagaggtgtaccattgctttgctctctcttgaagggagaatggaaaaaatttccaccgcacattttcttgtctcatgccacgaatcttaaggcacgagctgacttgctcaaagtctcgtagatgatggtagggattttctagatcaaagccggaaaatggattttccctcaccatactaattagttcgggacgaatttcatagccagtggtataaatgggctccgatgaagaaggtggctcatagaattcgtcccgaggaacagacaactgttggtatttcttatgatcacagatagaatccgcaagtggacggatataccgatgtagcacttcccctacggagta

SEQ ID NO: 23951 - DNA, 338 bp, Oryza sativa
ctgtagaaaaaaaggaaagtgggatcagcccgcggaggatgtcgtcgccgcggcggcggctgctgctgctgtggcggggttgcccgtggtgaacatcggtgccctctccggcgtgtcgatcccgggagccgccggtccgttggggaatatagtcgctgtgccctatactttgccggtgcatctggcgccttcggtgctccagaccgccgcggcagcggtccagaaattgagtcaggtgtgacaatgatgtatttttcgtaagtatatcaatatgtgttgattaggcaattcagcacacggttctaaaattttgtctgtgtacatcttgtttcttcagg

SEQ ID NO: 23952 - DNA, 1501 bp, Oryza sativa
tgatgcgcaggtgccggtgaagcgttgctgccgatgatgcgccacgctgctgcccgtggctccaattcgtgccctacagaactggacagaggtgccactgtcgaggacatcctgaaccggaccaccaccgtcgaggacatctccctggcggccgccagcaaggccacctccgaccaccactgcgtggctggcgaagcccaatgcgggactcatgagacggcgcggctggatctgagacggcgcagcggatcagaggcggtggctggatcgcgagtcgtggggagacgatactggcgtaggggctcgggtgtaaaagtgatgggaggcggatggcgcagggggtgttttgcaaaacagacagaggggctggcgggcggttatttgcaaatttagcccacctctatccctagccatcggatgctcatcctgtggatgtgattgagagtttccaaggttgcacaggctccctggtttccacctgatatgctcccaaaataaatagggcctaactcaatttggctaagtcagtcgcttccaagttccaacgtagtaattttacatgaatcaattcaatttctatgtttgaagcagtatctgaacatgctttaagctttgtaagattactcaaatacaagaaagattggataaactaagctcagttaaagtattttattctttctgtcggatgacagttggcaaattcattgattttatttttttctctccaattaagcaacctacaggagacatcacgcttttggtgtgccgaggtaggatgcaccgtgaagaaaagggagttcaaactaacgttagttaaaaccaaatgaatatctgccacgccattgaccaaaagacaaaacaatcctataatcctatcaccaaaattataaaattcatgccggctttagaacttgtatatgatgtaattttgggtttgaaaggaaattgtgatcggaacgtatacacatttttttatgggttgaaaaaattattatacaaacactaccagtgccaacattctttggatgttgggactacttggaagaccctccaattaattcgaaccataagtccataactacagatcgagagagttcccatctgaaccccacgattaaaagaaccgaatcagccgagacacggagacaccgagagagatcccaatatcacatattccacacgcgtacacaaacacaagggagagagaggagaggaacagtagcacgcacccccaccacctccatctctctccctctccctcggctcgatctcctcctcctccatcgtgtccaaaccaaagccaaaccccgtctcgtctcgcctcgcctcgcctcgccctgcgcgagaggtagaaataggaagggaaacaggagcagcgcgtgccgcctgggcctcctcccgctccccctccccaaccgccgaacccttcacattatcggtgcgcgcgcgcgcgagagggggggcgccctgccgcgggagttcgccgtggtggtgcggacgg

SEQ ID NO: 23953 - DNA, 424 bp, Oryza sativa
caaaatctgtcaagagcaaaagcaaggctccaatcggctatcaagaatgttgttgacgtaaccgagtccctgaagatcattctcgggactgatgctcaagatgcccaagccattgaagaagtcgaacaaattaggcaaagagatatttcggctatccagcagtacttgtctcaataacttttgtgtaataggacttagaaattcttgtaatcggctaagataccttaataccctgctgttttcactatcctttatgccgattaacataacttctaatttttcattatttttcattttttgtatatatgtgccccccaattttataatgtcaacagcattgataaaactaaaaaacaactaggggcgatataacaatttcagccgttatatatcggcaaaccataaccgattacaattagaaaaa

SEQ ID NO: 23954 - DNA, 1501 bp, Oryza sativa
gaatgtatataagtaatttagtcaaatctaaaagtaacttatatatatatatatatattataaaagtaacttagtttataataaaagtaatttacaaatataaatattttttcatcgtaatataatcatgtaagatcttgttgtgaatatttaattgtaacgaacacaatgatgtaattggattgtaaatcggataagtaatttgaaataaaactttataagaaggaagaaaaagacacacatgtctaagaggaaaaacagcacgcacatcagcacgtgtagcagtaattcttctcacaattaattcgtcgttggttaacactaaaccgagattttacctatcacaatatacgtgatgttggtgtagcctcagccatattgactccactttactgtaccgggcattgggcattgttaaatgtcaacgactaaagcaatcaaaaattcaaaaatgtgcattgaatacttgcccaagatggttgacaacgtcctccctcttcatagatcaacatgagaaagaaaaagggcatgtgttgattcaaagcagagctcattggtccccctcagtaatttatttgagtattacatgatatcattagaacacgagaccaaaccatttagccaccgccatctatcaggctaccacatgataggtgatgtgatacaattgttggtttcggtgttttggtacaagcacaaacaacattcccaacaaatattgcgtctatccgtagtgtaacttctaacatggcaatattttccgtcaccttagtgaagatggtagtgcctctcatccatacaacacggcttcctcatgcaatacgatcactaggccttctctcgttgaggtcaagcagccaaagccgtcatgtggcataataaggtaggaaatcaattggagacttcgagcgagatatattggggagactgggagagtgagtttgggtttgtcttaggtaaagagttagttattgtggtttcgatccgatccctgctattttatctttgctccttttatctccgtattttgttttaatgctgctataaaatattttgtatagtacattaatacatgttgtcagattatgactacctcaaattctcatacgaaatgaattaggaaaccgcaagcaagcctaagatgggctggcccgccagagcgccaggcccggaaaagctcggccttgctggactcgtggcgatgggccgttgcaccgagcggagggatctatcgaccctcgcgcacgatctgggcctctcgatccagatcgaacggccgccccgtcaccgcgaccgccgcggcgaatctggcacaagccgccgacgacgcagacacgagcccagcttgggcgaagccaagcaggcaagcatccatcatccatggcgcgccgttcaaaaccctaaaccctgaggcgaacctcgaggaatcgcagcggcgcgtcgtgtcggcacccatggcggcgtccccgtccgctcctcctccccccgccgccgccgctgg

SEQ ID NO: 23955 - DNA, 1501 bp, Oryza sativa
tggcccctgcagaggacagttgccctttgctctccacatggagtcatggacataaaggtctacatttttcacccagggaggtcttgcaatttatcaaaatgtatactaaatagtcgggatatgtgcttttgtaaaccataaacatttcaaacaaagttgcgtgaaatgtaaagcagcctcggttatatcattttcagtggttctttgggagttctggtataacctgagcagctttaaacttgtgttctttttaggtggagtggcatgaaagtacaacgatgcaacccaagcttacaaatgcattccacatacatttcaaatttagttgccgtacacgcatagcaaacattggatccgcactttacatctaatcacctgctatcttcggtaatctccggccggattacggacattatgacctggtggttagcaaaaagccccctcaagaagtatctttcaagcccagcaaatcgattgctctcgctgggtgtctgttgtttctattatttcatggcttgatggggactccattggtgaggaaacggcagacctgttctggctacagatatatcatatccagctgacagtgccttccggggtcatatacaaagccgtggccagtagccccttgcaaaaaggaagcttcaacatatcaattattaaacagaacttcaacgctacaaaatatttaaataaatgaatctcatagctgtcaagctctaataactactatacttaaaaaaaccaatgtctcattttgattttagataataacagagaaaacattccttgtggtacggcgtactccctcccaacccacctttgtccagcggtgttgacgcctcccaaatccaaattaacggtccccaactcccaacgatgctgccggaccacgccagccagcgtaacgcaccaactcgctcgccacgatgaatgctcctcccctcctcgctgcctcgctagctcctcctctccccctaccagcaagcacccaccaccagtccactccacagtctcccacagcgccaccacggtgtccgaccgtgcgagagcccaagagcgagagcgaccgtgcgcgcgcgcgtatgtggctcgaaatcgcgagatatccacgtgagattgcgcagcgagacgcgagcggtcggcgcggccgtgccagccagctaagccgatgaaccgatccccctccctcccacagcccacacgccgccacccaaagcagcaatccaccaccatcatcgtcatcataacgatcgtctcctctacatagcccacaaccgccgggccgccgctcctctctcctcttcttccaccaagccaccctggtcccacccgtccgcggctcgagccccccctcaaaatcccccaaccccgtgcgtgcccgtgcccgtgccccgcccgcccgcccgcgtgccggatttcgccgtaaatcggcagcgtttccccgtgcgggggggcagcggcggcggttggatggcgctgtccgcgtcggcggcggcgt

SEQ ID NO: 23956 - DNA, 440 bp, Oryza sativa
catctaaaataagcgtatatgaagctttttccatcattttgactcctcatatggatatagatttaaaactaccacggtagcacctataacccattataagtgccttttcttaaaaaaaatggcaccaataatgtagccgagccgacggccacgcagggtagccgagtggagcacaagatgggaaagaaaaattctcgctcttatcccctcgcatgtcgagccaagctgtactcctctccctaatcctcttgcaccttctactcttcatccatcttctcctttgcctctcccactcccttgcacggctggccgacgctaatccctcccccctgcgtggtcccgtggtggtcaacgcctctccttctcccctgcgcgcatggcggctagcacctttccctctcgcctgggcggcaagcaggtgcctctccctctcccctaga

SEQ ID NO: 23957 - DNA, 824 bp, Oryza sativa
acaattttcaaggatttagggtcatgtggtggtaaaattcttaatagccactcaattcatagatggttaattattagaatatcactgcttccgcctggtccggggtagccattcattcatctttcatccaacgggtaattattggctatgtgaggttttatgtgattgcacctatttattaggctttcactagaccccttagtattattttttcttgcacatgcacaaatatggatcataatgacccaaaggaatcgggcaatagaaagaagctgtaaatttgaatttaattgagttgcatataagtttatataatccaattaataacttgatacatgtaaattttctacacacaaaaaaaaaatatttcacatctgatatcaagtcagtgttgcaaaattagaatgagatgatgtcattctgagcataatactttcgataagataaggtgtattggctgaagctttttttttttttaaaaaaaaatctatatctgttgaccattgagtattcatgtgtatatactagactactggcttccttattttgtatggcatcctatttctcataaaagtggatatttgttattacagcattatgtgaggcatgcatacatttttttggcttgtgcaagctcttgacagactataaaatcctctgttacctggattgtattcaaatgtcgtgcacatttttatacatgacagattctgcaatatttatgtgttaattctagtcctattggttttataattaatagtagtatttttttgctgttttgggccatctcagaaagcatgaaatccatcatacgaatgatgcaa

SEQ ID NO: 23958 - DNA, 481 bp, Oryza sativa
cggataatgaggcatggcattgataagtgaatggtttaccagtttacgatataaatagaacttttaagtttgtctttttgtgtaaatgtgcagtctctaagatgcttccatttagttactgtaactaacaatccgttctgttgtgagagtggtgtgctattggtgtctctgtacctgctgaaaggatgatagaaatgatacttgtgcatacttaaatcttcgttgaatttataagaaaataaaattgtggaacaagacaaatccttgtatgaatatgtatgctgatatgagctacgtcttctactttttccgtatatgaatatgtatgagttctaggttgtgatacactttcagttctgttctacatacatgcgagatcaatagttgtttcattgactaaggccctatttggaaaggatgggataaaatcctaaggactaggttcaaatcaattcaacatttggagttcctttattgcagg

SEQ ID NO: 23959 - DNA, 184 bp, Oryza sativa
aaaagaagcataatatctagacaatcaagccgttgattgagttttcagggtggtagatgtctaagctaatctaatctagcaacgcgatttagccgataccggcagaaaccctaaaacaagaagcagccgatagagctaaattgatatgctaagactagattaacatagacatatgataaatagg

SEQ ID NO: 23960 - DNA, 1501 bp, Oryza sativa
aataacactggcgagcccaatcccccctccctccctagccagcctccccgttaccaacctcttctcctactcaagtcgttggctgccggccgtgaggtgccccgctctgcccttttcctcgtctttagtggctcctcactgcctcctaaccataaatttgctccagtataccactctctttcatccccacagctccagcgtcgtcattgttgcctcgtcgcctgctcgtgtccaccgcctcctacttccatccatctaaacgcatggatatccccttttccccctcctccttccactgccacccaacccccggggccctaatccgttgctactccactagagtttgcagtgtcaccggtgccagagaagaaagggagatcaccagagctacaagataagggtctacagcacgaatcgcaaagcacatctagtgacccaaaactataagggcctatttagattgtagctaaaataaaccttaccaaattttagcaatgccaaaattttggcaagatggcaatattgctaaaattttggcatgatttcttatgtattgactaaatttggcaacaaactaaacgtagatacttttttttgacaactttattaaaaaatggtatagttgaaaatggcattaaagtaaacaggccctaagatttggggatgtttttttatcgacaaaaggttagtgattattatgaaatgaccatataagtttatgcttacattgtaaaacgtgtgaacggtctccttttttgaccgcttaggcgtactcaaagtagaaattgggagtgatgggtttctatgctataggccagaggagatgtaggacttgttcatttttcacttggaaaaaacttatcaaattttagtaattttaccagaatcgaagtttagtagtaagataataaggtaaggatgtggacgatgtttggtttaacacattactaaattgtgtagtagctagagtagaaagttcccgaattactaaaatatggttgcattggtaatagtatgtttagtatgctgccttgttaaattttgatattaccaaaatttaaaaggtcttcgttttaaatatttttttaaaaatagaaataggaacaaatctaactatagttcacaatagatacatggcaatttctatattaacatggcagaaggaaatcggcaattgtaaatctgtaaccagagtcccatgccgtttggatccacagggccaaaagttctggaaggcactcgatgattcggcccaggcggccaggctccaaatcaggtgttttccagtgcattcttgaactgacgagaattatcaggatcccacctctcaacgccgcccacagcccgtataaatccggcctcccctcccgctctgcggcccagacaaagatcgaaagcaactcgcaaatcgcgatcccttgtgctcacatcccaagcttcccaagcacacactgttttagtgttcacaaacacagccttccttctcgcccaaatccgtcaa

SEQ ID NO: 23961 - DNA, 1501 bp, Oryza sativa
ctgaaaacgtaaaacctataggcatctttcgaaacaagtgaaatttttgggacttctgttggaatcgaatcgattgctgtgaaaatgctgaaacaagtgaaatttgtgggacttatgtggaaattgagctctcaatttccgaaatgaactctccagtctcgacagaaggattcaagaaccaaaggctaaaagtactgaaacatcgagataaaaatggcagaatataccggagattagattaaacaaacaagtgtaggactagtataatctcaggttcgttcacaaaacaagaaaagtctttattgctcacttccaacatagctttgaactttttcacagcataaacactgaggaccagatttgacgcttttatttactgcaattgatcacaaaccgaaggctcgaatcgaagctctccaccgtgcatgtcacacccgaagtttcttactagccggtaacctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgctgcgctcgccgctgatctggaggacgttgccgtcctccacctccaccttgacctcctccttcttcagccccggcacgtccgccttgaacacgtgcgcctccggcgtctccttccagtcgatgcgcgcgccggcgaaggccgcggtctcggaggaggtgccgcgggggaaggacgggaagatgctgccgctgcttctgctgccggagccgaaggggaagccgtcgaaggggtcccagaggtcgagggagaaggggtcgaacacgttgctgcggcggatcagcgacattgtgtattgtgtcttgctgttttttggttgtctggtttgtgttctagatggaaagagggtgatctcaattctcaagagagcttgttgatctttcgatcgatgagctgatttccttggcacctgtcgctgcgtggtggcaacaatttatatagcagttcgtgatggtccatgggttctactggaagttttgcttccggatagttctcgtttgttcgttaatttgggccgaaattggaagtggtcttctggattgttctaggcctgcttatggcctagattattctggagagtcctggacgctatgggctacagcccaccccgctaccggtggtgtaaacttctagcccaagctatctcgtactaggttctagcccatgcgggggcaaactggaagtttctagaagcttattccaagctccacgatgccctctcgctgccctctataaaaccgcgctccccttcaccggcagaaccacgaagaaaacgcaaagcaaaccaagcaaacatcagagtaagaactcagagaagtccgatcgttccacctccaaattcgcagctattccgacga

SEQ ID NO: 23962 - DNA, 370 bp, Oryza sativa
catgggaactcttgaagcagttagggaccagctacatgaggccaaggagctcgccaaaaagacagagaaggaattaagggaccgttttgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaa

SEQ ID NO: 23963 - DNA, 1501 bp, Oryza sativa
aacactggcgagcccaatcccccctccctccctagccagcctccccgttaccaacctcttctcctactcaagtcgttggctgccggccgtgaggtgccccgctctgcccttttcctcgtctttagtggctcctcactgcctcctaaccataaatttgctccagtataccactctctttcatccccacagctccagcgtcgtcattgttgcctcgtcgcctgctcgtgtccaccgcctcctacttccatccatctaaacgcatggatatccccttttccccctcctccttccactgccacccaacccccggggccctaatccgttgctactccactagagtttgcagtgtcaccggtgccagagaagaaagggagatcaccagagctacaagataagggtctacagcacgaatcgcaaagcacatctagtgacccaaaactataagggcctatttagattgtagctaaaataaaccttaccaaattttagcaatgccaaaattttggcaagatggcaatattgctaaaattttggcatgatttcttatgtattgactaaatttggcaacaaactaaacgtagatacttttttttgacaactttattaaaaaatggtatagttgaaaatggcattaaagtaaacaggccctaagatttggggatgtttttttatcgacaaaaggttagtgattattatgaaatgaccatataagtttatgcttacattgtaaaacgtgtgaacggtctccttttttgaccgcttaggcgtactcaaagtagaaattgggagtgatgggtttctatgctataggccagaggagatgtaggacttgttcatttttcacttggaaaaaacttatcaaattttagtaattttaccagaatcgaagtttagtagtaagataataaggtaaggatgtggacgatgtttggtttaacacattactaaattgtgtagtagctagagtagaaagttcccgaattactaaaatatggttgcattggtaatagtatgtttagtatgctgccttgttaaattttgatattaccaaaatttaaaaggtcttcgttttaaatatttttttaaaaatagaaataggaacaaatctaactatagttcacaatagatacatggcaatttctatattaacatggcagaaggaaatcggcaattgtaaatctgtaaccagagtcccatgccgtttggatccacagggccaaaagttctggaaggcactcgatgattcggcccaggcggccaggctccaaatcaggtgttttccagtgcattcttgaactgacgagaattatcaggatcccacctctcaacgccgcccacagcccgtataaatccggcctcccctcccgctctgcggcccagacaaagatcgaaagcaactcgcaaatcgcgatcccttgtgctcacatcccaagcttcccaagcacacactgttttagtgttcacaaacacagccttccttctcgcccaaatccgtcaacca

SEQ ID NO: 23964 - DNA, 323 bp, Oryza sativa
tcttcctcctctctccccaactcccatgtattcatctctctcccatctcctttgtcctctctccaagcgtgagtgaggaggggtggtgcacagcgactgccatctaaaatgagaccaccggttttaacagttgagggacccgttgtatctggttttccggttaaaggacgaaaatcggattcgttgataagttaagagacctcagataaacttattccttaattagtcacatagctccgctggcccataaaggaaaaggcccaaggctcattcaaagctcctacccaacccaagtcacctcgcctttcccctctcaaaaaagg

SEQ ID NO: 23965 - DNA, 305 bp, Oryza sativa
agtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccatta

SEQ ID NO: 23966 - DNA, 385 bp, Oryza sativa
tcaacttgtacatcaaggaaataccttgagacttagtcggttacgactgtattttatctgtatctgcatattccgttagggatatagattatcttttgtaacacggactctttcccatatataaggggggtccgggtgcctctaggggcatgtgttgattatccccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggtccgtcaagcttttcgccgatcagtgcaa

SEQ ID NO: 23967 - DNA, 1501 bp, Oryza sativa
tacttggcaaaagaacctggttttcttatgtaagcgcctccgttggaggtgccctatgacggataaaggccaaaccattcaaagtgttcctattacaaggatagggattactatcataaaaattttgagatgataattcccttgatttaaagacacaaataaaaaagtttatatttaatttaaatcgtttaaatatcctacaaatattctttgttataaagaagcccttattattaccaacaaattattgatcaaatgaataggttcccaagtccttcaacggttcaaccaaaccgtgtacccgcagttattctagccggtagtaggcaaccgctacaaaaacatgaccagaaaaatgaaggggttgaccctgttactaacaatttgattatctttttttcaactttgttcgtatgaccattctttttaaaattgaagatacaatctgactctattatgttaagggcatgtaacggtgttaattagagaaaaaaatgccccttctgtctttgcttatttgactatattttatcaaaaatataaatagagtataacaatttttgtattcgtgagccaccatcctcttagccatggcgtcatcatcatcgttaccaacccagtggcggtgctcgcacggaggaagacggaggcatcacgcgcgcggagagcttgctgacgcggggtcatgcgttgttgccgacccgcagtccctgagaccaccgccgcgccgccatcgtcgacccaccgccaccggatccacagcccacatgcctcagcgctgctgtatcagtggctcgcacgcccagtcaccaccggatccaccgcctacgcatcctgacaacctgagctccgccgccgttgctcctcctcatcgtcgtcgagccgctgtcgcccgctcctcctttcgcttgccgcagcagccgccgcggccgctactttctccgcgctcgcaccgccacgggtccggtcccctcacgcccctctgcttccgccgccgttacctccgtcgacgagctgtcgtgccggctcgtcctcccggtgcgccgccgcctcaaccggatataagagtgagtgggatgggagtgaatggatagggtttgagggcagtttggtcattacgaataataattatatatattttttaaaaaaataaaaacttcacggtgtagtggaaacatagtcagatgggatgttcttttttaaaagcttggttaaacaagcaaactagaaaaaatatatcagtttaattgttaagctttaaaacgggtgaacaaagcaattctctcaaaaaagaaagaaagaatacctcccgcaacacgccatccataacaccaacgccaacggcagcggcaacgcctttctcacacattccaagacccacaccgaggcaacgcactgtgcccgctacaagtgtgaaggcgcgctgcctccctccgccgaaaacccgaaatcccagccccccctctccctctctctccccagcaccaccacggcagcgcga

SEQ ID NO: 23968 - DNA, 1501 bp, Oryza sativa
cgatgatctgcggaggaggagtggcgaccgaggatctcctcgtccttgcggagccgagggaggcgatggcatgggtcggcgtggacgggagcggcggcgaaaggcggtcggaggcggtaggcattgatgtagctcgggtcggcggtggcggtgggatttcagcgacggttaggggaagaaaggtgagggccggggtgcggtgtggagcggtgacgccagtggtggcgatggcgagagcggtggctagaggcggccggagcttgccggcgacggcggagagagggagcgatgcggggaaatggtttctatgtgcggggagcacggggaaaggggaaaaagggatgagggaaggtgagggggccattttatagcgcttggggagggaaatcgtggctgggaggagcgaaaacggccggcgaagtagggcgccgacgtgggggtggtgggcgggttaaccggcaccgattttcatggggagagtggaggaaatggtggaggacatggaggggaccgagtccacgctattgaatgcaagctcaggagacgggaggtggcggatttggcggtggagtgggcggccatggcggcggttgggatggagctgaggttggggatgggactgacaggtggggtcgccgggcccacctgtgattgtttcacttatgttgatcttgctggaactattatatgcttagccatgcttaattaccactagctcacaaaatgggataattacattattcacacttatcttgatgagctgtgagctcgagaaatctggccatgtttcactggttgtaattattcaactaaaatatgacataatggagggttgtgggtgcatggtttttctagttgaacccatggcaattaaggaccggttctcgggaatccctagaagacttaccgcgcttaccataagcaagaatgggcacaataacatgccattgggttgtgccttgtgtgtacagttgtgcacctttggccagagtaaaactattcgaatagtcatgcccgcggttatgggcgatcaactagccatcgtgattagactcaattctattaattaatttaacttaaagaactggtgtagttcaggtggtttggttgggtctgttcaatgtggggtagcattgtccagtggagatttaatattgccttaattaatcaatagtttttctgctttcaactataatatgtttgcaaccacctttatgcaaatagccacaaacccttctttgtctccccttgcacgtctgcatcatgggtgtggcttgctgagtacagtggttgtacttagccttgctaattattcccccttttcagaagtgtagtgcttctgagctaaagatgatgttagaggaccaaggcttatacccagtcgagtttgcctgtggagtggagctgaagcaccgctaggatcgtctatttttcacagttgtttcttttcggtctggggactaagtgcctcttctattagtattttacgctttatttaggt

SEQ ID NO: 23969 - DNA, 1501 bp, Oryza sativa
acttaaaccccgtgtacatcaacaaaacattttcagcttttcaaacgattgaaacattttcgatctacttagtgaaatagttctgatctacttggtggaactgcgtgcaacatttaaaaataattcaataataagctaaatatttttttcatcggattatatccatgtgtggtcttgttttaaagatttaattgcaacggatttaatggtgtaatcggatcagggtttggataaataatttaagagaaaaaatagtttaaagttcgcttagtaagtttgcatgacgtcatcatgatgctaggggcagaggttgcatggcataggaggcaccagggctgcggcgtgcagcgtgatagcagtgctgggaggggagcccgatttttctatggctggatcggacgcccgggcgccatcattttcgaaagaattagtacctttacaaggatcaatatggtcttgtcctactcccttgtcctcctccctccgtttcaggttacaagacgtattgactttagtcaaagttaaactgttttaagtttgactaagtttgtagaaaaaggttgtaacattttcaacccaatataaatttattatgaaaatatattcaattatcgatttgatgaaactaaattagtattataaatattactatatttgtctataaaattagtcaaacttaaaacagtttaacttagaccaaaatcaaaacgtcttataacctggaacggagggagtattagataaacaacaacgcaaaccaaaatagtagtaggcctaagtgacatgcccataggcacttgactagacctagttttcgataagcacttcgatcatctgctaagtatgccagcaagctagcagagtcttcctcttctcctgctttcatgtctaaaacaggagaaaatagcaacggtgagtacatagagtactcacaagccaccacaacaacatgattaatgcaaatagggttaaaggaagtccaaggttcatttgcacaaagctaattttcgtaaatatttttacaatcctatgacctagccatctattatttctataaagctaatgcccactaaacaactaaagctcaacatacaaatatagtatttattagaactcctaaaacctacatataagcatgccacatcaactcattaagcacataaagctccacgtgcaagcatatagtaattatatctacaatttatttcataaaaaactaaacatacacatgctaaatcatcattctcaaatcattttcataatatttcaatcaaaatcgtttcattatttctccaatatgtaacatatatcctgtagcaaagcatgggtcatcatctagttttaacttaaaaacaacatcaagttttcttgtttaaccattcattgagtgcacttctttgattactcgcatagcgaatgggcttggggttatacctaatgatcaaattgcttacatttccaccccccgttgatgaaacttatttagtgcaaggtcacatac

SEQ ID NO: 23970 - DNA, 1501 bp, Oryza sativa
ctcaatttgatccttcacgtttcattttgtccacatagctcctccaaatatttgttttggcttgaaatcatccttggaccctcttaatatgccatttggctatttctagtcaatatttctattaaaaactatcatttttgcccttaatttgtatacaactatatactagaaaagagaaagtaaacataaataaacaatattacagatgttcttcccattatttcaacatgtgcacatgaaacttaagcaattgctatcgtatacacttgctagtacataatttattttctttttacataatatactatgtattatctataaaacattcaagcatgcaatttttctcttatatatgtgaatgatgaggggtataagtatcatttatgaagagagttgttggttcaaggataagtttgaactaaaatgaaaacttgaaggactaatatggatagattgaaacatcaagaactaaactgagccttaggtgaaacttggaggatcactttagctattcacccaaatttttttcccaaaaatgtcatatcgaatctttgacacatacatggagattaaatatagataaaatgaaaaactaattacacagtttgcatagaaatggcgagacgaatcttttgagcctaattagtccatgattagccataagtgctacaataacccacatgtagtaatgacggattaattaggcttaataaattcataaagcggtttcgaggcgagttatgaaattagttttttctttcgtgtccgaaaactccttccgacatccggtcaaacgttcgatgtgacacccaaaatttttcttttcgcgaacggccttagcatatgaagccactgcttcgtgcggcgccgacgcttggtggcgctacaatcttgatcccaacaaatttttgaatgagcgcttgcatcgttgcaacggtccttgacaaaccaaaaaatttggaggcaaacaaataacccgacaaacccgcatccatattgcatcaaaaagcaatgtttctcaactactccgtccgtttcatactataagtcgttcgactattttcttagtcaaacttttttaagtttgaccaagattgtagaaaaatatagcaaaatttccaatacaaaacaaacatattatcaaaatgtactaaatgctaaattttatgaaactaatttggtgctataaatgttgctatatttttctataaatttggttaaactaaaaactttgactaagaaaaaagtcaaacgacttacaatatgaaacggatggagtattcaaaaaatgcgatccaatcaaccagatagtaccaagaaaatacaaatgagatcaaatcacccgtacacagagaactatgcggggcaatccaacaaactttccacataccaacgcctacaaaaggacccaccctcattgtgggtgaaatgggaactagggtaccctattcccctgatgaattagtaagtaactcataattaagataaatggcaggcataa

SEQ ID NO: 23971 - DNA, 1501 bp, Oryza sativa
catttcaaaaatgtaattacatagggtgacaagagaaactctatcaactcttaattttctacttcttgtacttcttggttttgtgcttcatattttttgttatttgcacccaaatgataatttgctgtttacatttgtcagttgaaactaattgacatgggatagaagtgtgtgaaaggactaaatgcttataatctaggcttgatgcatacatcagaaaactttgccatgatagttaatgacttgatgctttaaatcctgaacagtttgtttcatgcctcgagaaaatcttgaaatttttattagctcattactaatgctgagaataagaacaactattagattcttgaagtacttgagtctgaatttattgaacaattgcgggtgtggattttcagaaccagcaatggcatgtattttatatctgtttgctctttagagttgtgttcccagcactgaagttattgtgcttctatcatttggccagcttatattgaacacagatgaaactaaatatggtggacgtggggagctgacgagcaatcaatatatgaaaagaaccagtgacaataggtgctgtttttcagttttcatatgatatacattgtgagtttattattttatctggaggtatccatattttgcaatcaaataagcattgttactttcatatagggttggtggttgccgcaactccttggaattgacattaccatctaggagtgctcaggtgggtgggtgtaaagatatgtgatgccagaactccttggagttggttgttgccacagctccattacaacagatatgcttctcttttaaaagaatacacacgcttgcaggtattcaagttggtccgaattttgagaatttagattctcaaggatgagcattgttgatagaccaagcaattcgggtcctcagaagacggaacttctctgttaatatctgaactcttgcaaacttaaagattcgcatggcaaaaactgaggtaatgggtacttgcggtcttttccccatgtaattatgatctgcattgataggtttattaacaatgcattttactgcaaacctcatcccagtgacatggaaactcacttatgttttcatatgccctttttgactgaatgcaattctgaccttagctttgtcttaaagagaataaaagaaagtaaaacatttttttttcatattcgagcatatttatcctatcgtccacagactggagatgctttgcacagtgcaatggtaggtatgtcaaaaaattttgcacatgcagactcctagacagacaaaaaaaatacaactagaacagttcacgtcagttacacacttaactacatgactgctacctccgtctcaaaataagtgcactcgtgggaatacgtgtccaacatttgaccgtccgtcttatttgaaaaaaattataaagaaattttaaaaaattagtcgcacataaagtaatattcatgttttatcatctaataacaataaaaatactaat

SEQ ID NO: 23972 - DNA, 1501 bp, Oryza sativa
catacctcgcggcaagggagagggcggcgatcggggagagcatgaactcgtgtggcaactagaactgcgaatccccgtgtcaaagccccacggccgcctggctaccgcacgcccgccctctccacggttgccgccgccgcgcgtacgccctcgcagccgcccgccctcgagtccctgattcacgcacgcacaggttgagaggatttagtccctacccattctctcaggggtacaaacgtaaattcatatttcctaaaacctttttttatttccttttgtattcctttaacacaaaacgtgggacccaccaaacgattgttacaagtaggggtagacggccggttcagattcaaaaagtggggctaaaaccgcaaaccctaaaaagtgagggtaaaacaacaattgggtttgaaattgggggcatatatgcaattgtcccattttaaaaatggttttcaccaacgtggcaagttggtccaaccggatgtgggggtcacatgtcagtgagtatgtatcagtaggccgataggtaacaacagctcgaggaggttgtggaactcactagggatggaggtgacgactctgtggcctcatcctgttggcaggaccctctaacactacgacatgagcctcccctcccatcgccatcgctaccaatgttgcgagcaacccctctctttctcacccccctctccttttccacaccgccacacgagctcgagtggggacaatagtaggcaatggcgcgatgatgacggcagagaaagccgcccctcctcatcttccccttcagacatcttccccatcctcgcctgcttcagtccttcacagtcgctgcctaccttgccgtccgtgatcccggtaggggagtggtctgacaccatctctctcattgggccacgcacgtcactgatgcttgagcctctactggcaaacccatatgagccagcagcctcatcatcgacagctgaccaccgttttgctcctttgtcctccggaactatgtggatctgggctcatcgttccaatcgacactgaactttgtgccgggccatgccgacccaacgtgccgaggtggcagcccaagcacgacatggctgttaggctgggccggcatggcccgacctgccatgcctgggccgggtcaaatcacctggccttgggctgggtcatatgaccatctatattcataggtacgaataatagatctgcctaatcaaaagcacaagtatatactgcccctgagcaaggcgatgctacttgtatgtgactgtacgtgacgctggctgaaggacaaggagttgcaattaggctagtatctgaggcaacgccatcctcacaattctcccccaatccacacactcacctcccgccctctctccggccacacaaaccgcggctaaaaccaatggaacaaaacaagaagccatcggcaccaagaccaggtagccgcagcgagaggagagcgcgagcagagcaagcaaccaagcagcagcagcga

SEQ ID NO: 23973 - DNA, 519 bp, Oryza sativa
  unsure (1)..(519): unsure at all n locations
gtggtgantttataaatctattcgtgctgcctgcggtcgacttagaggatccccatcacaatctgcactgagaacaccttcagttgtcgcatgtttattgcaccgttaggacactctccagactttgtttggttaatccccgaggagaaaaggatttgaagagattgaggaggattatgtgtaaaataaatcatctcaagagaattggaatcttgtgaaagggattaatcgccacgcaagcgtctctcccacctgacagctgctacactgcaacaccacatcgaccacatttgccctagtcgatgaaactgggccccacccacgatcctggcccacatcccagtgggtcgggtaagaaacggcccaggtgcagaaagtagcaccaccattttagccacctcgggtgggcccgccttgcgagaaactagccgttaggatcgcccgctcgccgcaacgttctctttttttcccatctccttccgctcccccctcccacaatctccaattcttcatcgtagc

SEQ ID NO: 23974 - DNA, 229 bp, Oryza sativa
acgagagcaaaaacacgggcacccagatcagggaaatgcagagcatggaaagaggggaactaccaggagaagcgaggttgcagaggtggccggcggcgaggccgccacggcagggcattgattgggcttgtccccgtcctcggatgcgcggcgaggcgcggcgcggcgaggcgggcagagggagacatcgtcggcggcgggaaaccgagctcccacgcgccgcgacagg

SEQ ID NO: 23975 - DNA, 532 bp, Oryza sativa
ctgcacttctctctctctcctcgtcctacaggctacagctgctgcctattgatgacacacctctactgcaatggcggagccgtagaaggctcgatgccatgtggaccccctcgtctccgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggcta

SEQ ID NO: 23976 - DNA, 613 bp, Oryza sativa
ttggtcatcagcgccaacaatatcggtgccgtcccttttatattagtgacttagcttccaccaaggggcatccaccaaggggatatggggatgacgcaaacgtcattggcaccgtcatgttggaccacggcgccaatgaattggctccatgaaaatgatcatttctaaaataagttttctaaaaggataaaaaatgtgaaaaatccaagaaaactaggcaaccaaatcaaattaaaaagaatcaattaatgatttttccactgtactgacaaatgaagctgctcggagaatatagctttttagtttaaatcataatgactctttctttaactatctctaaaatacaagttttctctaaatcagcaacccttccactttcattatcaaaaataacaatccttcctctttatgcagcaacttggaaccagcactgacgaactccatcgagctaaaaatggcagcataaaaaatacggggatggatagccaaatctagttgacaggatacgctcttatgcaggagatgagcatgaataccaccgagaagacgcaaagaacaaactgagatgccttaaggagagtctactgacaatccaagaagtgagacacaaaga

SEQ ID NO: 23977 - DNA, 1501 bp, Oryza sativa
aagaaatgacaatactgaatcattatttccaagcaacagacgagagtgaaagtgctacaaaaagaaatttggcaggctaagtttcacttataaactggatattcacctttttggaatgaacggccgatcaaagtacggcattggctgagctttaggaaccagctctttcctgagctgcttgatcatctcttcctcctccagcttctgctgccgctccctctccagccttagttgctcagcgaacttgttcctttctgacacctgcattctcaaccaagcataccaagtatatgcaataagtaacgttgtggtttacttaaatataatacacaagacatataatgagtttgtggtgcgatgctcacatattgatcaaattctgcacgttcaattgctcgtacatcactgtgcagaacaaggtcaacaggctcggtggtttctttgactggtggctttatcaagcactgcagaataaaaacgcagagtcaggataccatagaaaataggtaaaattattcatcatactgatttcaaagaaaaataggtaaaaagctgtgcaaatatactcaatcctgactattttgatatgttaactaacctagctgcaatgagaacagccaggacaaacaagcgcaaacaacaaattttaagccaactcactttgctttttgaacaaactggtaatgaaagccttgctttgaagagaaaacaagaatgctctagtctagacatacctcaggttcatctgttgtccatggaagtccttgtgcaatatgtatacgttgctgctcttcctccataagcatttcttgtactttttgaataaactgttgttccttcacccttccccgttgctgttgcaaaaaagaaaaaaaggagtgattgattttgatgcactagtttatttgagggaacagctagagattgtcatcaaaagaatcataatctgtagaaaatacagagcaatgcactgagcaaattgtatttgcaaaatccaacgagaagcaaagtaaatcagagattgaaccaaatgttgttgcattggatgtatcaacatggtactagcaattggcatgtcaaagagaaacactaaagaatagtatggcacgacacatttcactcaagtactgtaaatcttgggctaagaatatttcagatatctaataatctttccataagcatcagatgtatgttgccatgtttatccttataaacacatacaaccaactcattgaaacgcttcataataaaaagtatacttttatgctaccattctacccattgtcacttgatggcgcatttcagtttgaagaacagtaacactggctggtaatggacttaataaacacttcaaaattgacacgaagccaggtataggtcgattgtgctgttgttgtcactgtagtatcaaattaacccatagggcccctttgaatcgcagggtagaaaaaacggaggaataggaaaaacacaggattctgacaggatttgaagtgtaaaa

SEQ ID NO: 23978 - DNA, 168 bp, Oryza sativa
ccacttgcaagcattgagtctgcagtctcggtatgtgaatagactaaaaataggactcgaaaatggcatcagcaggttgacccagttaagatacttagatgctccaccaggaataatttcaggcataaaattgattggcaagctcacattcctccaggaattcaacca

SEQ ID NO: 23979 - DNA, 488 bp, Oryza sativa
aagatatgggtaggttttgcttgtcttttgctctttgttcgttccaggatactgcagtaagtttcatttcttcatcagtaagtttcattttttttgtcaacctttgtgcggccatagaagatgaatggagaacttggattgcagcgggcttgattgtagcttcgtaagcggcggaggcggccgtgtgctgtagccttttttcttttctgtcttctcgcccttagttttcgggggcgtgtttgtaataatgcacattcttgcactctttcttaatatactctggccggcatccttttgctggcccggcaaaaaataatacattttcatgattaggcagttgaaattagatttggagttaggattctatactttcaatagctttttctaccaagcaattgcaacttttaagtgattgtgccgtttgttgccaccatagtgactgtgagtgaaaatgcattccaatgaggcctgcctggagggaggagcga

SEQ ID NO: 23980 - DNA, 1501 bp, Oryza sativa
gcaaataaaatcgggtccggttgagtccagtgtgtgtccgtgtctgtcttgaacagtcgtgtgtcgcgtcgtgtcactgggtcagtgtgttgttccagtgcgccgttcatcagccgatcagcgtctgtaccggtcttttgcaactagttaagtgatgaatactataatctgttaatacgtgatctgtctgatgcattctgtgctttaatttgattgagtttgggtattactacctgacaagattagaaaccatacaagcacctttcgaatttcgtaactctcactggcggatttaacccctctagccgccaatgctcgttgccgaaaacctaaagtttttttatatgttttcaatgattgaagagtttttctttagcaatatatagaattctgttttttttcaatgatttaaaaatagtttttctttagtaaatgctctatatagctagaggctaggtttgggttggactttttctgtatctatctaagattatggtagcttgcagtgactttagaatattactctctctgttccttaatatagggcgtggctgttgtagttgcaaagaccaataaaaccgtttaaatatcagttacgctgattaattctctctgttcgaagagcgacgtttaggtagttgcgcggtagatacgctagcattaaccatcatgcagcgtgcgctcgacctgtactttccgcgcgaatagccagcatgcatgcagatgcatttttgctagcgtgctttgctcgcctggcataacgccatgtatggattgttttgattcaaaaatttggaaagccccatgcatgcatgcttgatcgaaaatttggatggcgccatcagcgataaaaaatgaatagaaaattttcacttggcgccactatttgccagcaaaattttctcctataaatatgggcaatgcaccacacatttttttccatctctcttctttcctcccatggttcaacgtacgtaatggctggttttgatctaaatctacccatcatcaattgggacgaagttgaggatttcgatggagatatatctgatttgaactatgactttgtttgggattatgacaatgaaggtgttcataggagcttcttctcttgctttgtcttcttttttttcttgtgcatgtgtgactataattttgtttcaacgcacagatggtgaagatggcaatggccgcggcagtggcaacgacggtggctgcgacggcagcgacgacgatggcggcggcagcggcggcggcggcgatgacgacggtggtggcgacgacggcggcggtggcggcgatcaaaccaccgatggagcagtcgatgcaggtaatacacgttcattttctttttgttgctgtgtctttttgctgcacgagttgaaggcctttgcatgtacacatgcacagtgccatgcttaagcaaactagccgatgcatgccaaccatagtatagcctgcacgttctcagccatcatccaccatgcatgtgtaggtatca

SEQ ID NO: 23981 - DNA, 777 bp, Oryza sativa
acataaaggcaagctatggatgtagcttactgccccctccatctcaaaatgcccttcttttttaagagattgggggagatgaagaggtatatggaaagtactatattttaaaataaattaaaatcctagagatagctatatttcgagatggagtaaatagcttaaagaaacacacctaacatctagttattcgattagcagaactactggcctaatgcattgatatgcatgccacgtagctaaattagatcattaacagcccaaatatgtttaattgaggcattattggtgctgtggtggattgacagtagcataacaaataagctactactatattgttttagctttcatgagctccagcagattagcgggctgaccgaggtcatcaaactttgtttgctggggtcattagctataaaatactgagcaattcatttggttggttgaatgccatcggggtcatctgaccccggtgatattactgtggctccacccctgatatgtgaatatcatgtatctggggctccaagctatgtctcagaaaccccgatctgagccccaacctccctgattgtctcatctgttatgagatccaagggaaaagaattcatccggattggaaccaaccaaaagaaattgaaactgggggtaggacttaggaccacaatcattcacaagaacacaaacaaaaaaatttcaccaaagaaaatgtagaaatgcatcaccaaatgaaagaatattaattggccgctggcggagagaaggcttttacttaga

SEQ ID NO: 23982 - DNA, 1501 bp, Oryza sativa
aagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttg

SEQ ID NO: 23983 - DNA, 425 bp, Oryza sativa
tgcttggtggactagccatcatggaaagagggattgaatcaacaaattcagtgttccatggcttcagatgtagcttcatggattcggtaatcaaataagtcaacatcttcagcttgataagtagtttgccagtcttccatgcttgaattcttgtttcgacatctctcagctgcacggttgcacctgcacctaaggttgctttgatctcctgcacaagagcatactggcatagctcactcggcctccagaattgttacgtgttccttggaataaattcaatttcacgctcgcagacctagtgatggtgacatggtgttgccgaaatcttagtaacctaatcatgtggtgcttgaatttttagagctgtgcatcagcttgtactgtactgttgataacttgaatttgtgaattcttaactgtaacca

SEQ ID NO: 23984 - DNA, 1501 bp, Oryza sativa
tcgctcgccgttgcgcaggcggttttggccgtggtccgtggaaaattccgcggaaacgatcggaaccacctccaccaccagcagcggttcacgtgccgcgtccgcttgcgaggagaagacgagaacgcatggggggacgtggccctgggccctggccccgcgcggcctaccgcgaattcgatcgccagaggcgcgcggaccaggagtagttgggggcgccttggcggttggctggctccgcgccgcgagacaccaccgcccagtccaccaccaccccgcgccgcgcggcgcgccggcgcccagcttctcacgcattctctcgccgtctcccgcgcgcgcggcgcggccatcgtgagatcgtggcgcccggaagagaaggcttggtgaccagagtatttttttagataagtcaccggggggggggggggggggattccccacctgaattttcattaaaaaggagggctacaaagtttgttacacattcgtcagagtttgaagtggagccgaaaagataagcttccaagaagttattacagagcgatgctcaaatttgaggcgttctagccaaagaccacattcctccatacatttgcgaagaaccgattgcagagacggggacatgttcctgaagacaacgtcatggcgatgtttccacaaggaccaaaaacatagcagatagaacaccctgaagtgcaattcaggcagattcccatcgggtttaagattggccatatcagtaaccatgtgtattcgagggcttaaacctattgcctcccagaagccttgagcgaaggggcaatttagacaaaaatgacttccgtcttccacttcaaggttgcagatgtcacaagtagcagaggaaacgattccttttttaattagattatgtttcgttggtaacctttcctttgctagaagccaggcaaaaaattgcacttttagaggtgctctgttgcaccagatgaacttccaattcacacagcgaaggcggtcattgaagtttttgaggtaaagtttctttactgagggaataggcacatttgaaagctctgaacaaatcctcacatcttcaccagcatggagagaaaccccctggagctctgcttggtgaccagagtagacacgaaaacaatcggaaatgatcataaacggtatcattattttatcatttttataaaaacgatcgaaaataattgagatatttttatattatgaattaattatttagtgccaatttcaatgtaacattgatagaattaaaaaaaactaaattttaggaatgataaatatttgtaaaaattgttacttattatattagtttggaaacggtataggtacggtaaccagattcagttggtttgttcgtttgacgacaagacacgctacgctaaaaataccgacgcgaccatgcaaatagcagcactgtgagtctgattcagattcgtgtatgtattttgatgtgaataaacagtgggtttttgtttttttttatttcgta

SEQ ID NO: 23985 - DNA, 415 bp, Oryza sativa
tcatagtactattcaagagcacattttctcatatatcaaagataactagataaggtattctattctaagtaggaattgcgtcagaaaaaaagggaaattacagggcacaaggtggctgtccacatcatctgcatccatgctgactggaaggatgatcactcattctgtttcaccttctcctgttcttgataccaacctttatccttatccaaccttcttgtgtttttcaccccaactgctgggattctgggagcatattagtagaatattacctaaccaatttgcacacactagctgccaaagatgccatccctaggaagccatgttggaacagaccacttgaagcatcggtgctcacacgacaaaaccataaaactccagcagctgtttcttttcttgttgtcattgccagaca

SEQ ID NO: 23986 - DNA, 1501 bp, Oryza sativa
taccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggttttaccgttttacatagcggagtagttcgagcggcaacaacacacttgaaaggaaccagagcacaccaaaaacaccagtaattacacctcacataagtgatcgatacacttgaagccacagataaatcgttttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctcaacctccaccttgacctcctccttcttcagccccggcacgtccgccttgaacacgtgcgcctcgggcgtctccttccagtcgatccgcgcgccggcgaaggccgccgcgtcggagttggcgcgagggaagaggctgccgctgccggagccgaaggggaagccgtcgaaggggtcccagaggtcgagggagaaggggtcgaacacgttgctgcggcggatcatcgacatcgtcggaatagctgcgaatttggaggtggaacgatcggacttctctgagttcttactctgatgtttgcttggtttgctttgcgttttcttcgtggttctgccggtgaaggggagcgcggttttatagagggcagcgagagggcatcgtggagcttggaataagcttctagaaacttccagtttgcccccgcatgggctagaacctagtacgagatagcttgggctagaagtttacaccaccggtagcggggtgggctgtagcccatagcgtccaggactctccagaataatctaggccataagcaggcctagaacaatccagaagaccacttccaatttcggcccaaattaacgaacaaacgagaactatccggaagcaaaacttccagtagaacccatggaccatcacgaactgctatataaattgttgccaccacgcagcgacaggtgccaaggaaatcagctcatcgatcgaaagatcaacaagctctcttgagaattgagatcaccctctttccatctagaacacaaaccagacaaccaaaaaacagcaagacacaatacacaa

SEQ ID NO: 23987 - DNA, 561 bp, Oryza sativa
aaatgattcaccaggatataattaattaagttttaattttaatttttgtataggtaaatatgatttttataacttttctatgaatatttttatataaaacatatcgtttagtagtttggaaaaaaaaaatactcctaataagaaataagaacaacaaagtaaatattagaaaaaaataaccaattgtacggaccctttacccttacttaatactctctccgtctcatttcaagtgcaaccataagtttttcgcctaattttaattgtccgtcttatttaaaaaattttataattagtatttttgttattatgagatgataaaatataaatagtattttactcgtgatttatgttttaaatttttttttaaataaggcagacagttaaagtttgacgtgaaaaaccatggctgcaatgggttgaggctgtcaaagagtttattggaaatgacaaaggaccttagtttaatatttaacaaatgtagtcccttttgtgaatatgtacaaggggatatttgctaaatttgctgccgtccaattctcccgttttaaattgttcagt

SEQ ID NO: 23988 - DNA, 238 bp, Oryza sativa
attaatagaatatgaatattactagctatgacaaaacacccgttgggggaagtttcagacgacaatagtaccttcttttgcctattcagattgtttctttgagacttaaccatgcccacttagctaaattgcagtacttttacatgtatgaaacataactagaaaccagcccatgtctgctccttagacaatcaggatggaagcctcatttgacagagtctgcctgcccctatgcagg

SEQ ID NO: 23989 - DNA, 1501 bp, Oryza sativa
cgtatagtaagataaagatcgataatgggaagaacgcagcagcaacacattgacatgggaagaaattcagaacggatcagtttgtcaccttgtattttgtcctgtagatgctggcggcggcggcgtgggcgaggatgaagtggtgggcgacgacgtagggctcggtgccggagttgccggccttgcagtagaggtggagcagcacggagcagcggccgggggcctggagccctgcgtcgtagccctggatggccaccgtgtgcggctcgttgagcgtgatccagtgcttcaccctgtccccgaactccctgaagcacgtctccgcgtacgccgcgaaatcgtccctgcatttttggataggtacattcaccaagatggttagtgtacttacttaattaactgaaactaccactgggattagtaattctgtcatgaagattgatgctggattagttcaagtgtaagttctctgcatttttttgatacattcattcatcaagatcgttaatttctcctacttagttaactgaaattgccattgggattggtaactctgccatgaagattgttgctgggttagttgaaagtgtacgtttttggtgttttcaggtgtttagtgctagcttcgaggaatgatcttaggtgcttgtaggatggtgttttcagtatgaaccctttctttagttgatgtgtatctcttttttatcaatgaaatgaggcagaacttcttcctttgtttttttttttaaaaaaaaggaaattgaattgtaagtgtgtaactggttagttaattgagggagacgacactcacactatctgcctgtcaagccagcccttgtacttgtcttcaagggcctgggggaggtcccagtggtagagtgtcacatatggctgaattcctgaaagattgttatactttttcagcaaattcagaagctgtcaagatgacctgaatttatcactttcaaatctgtgtgctcaccttttgctagaagtgcatcgatcagcttgttgtagtggtcgataccagcttgattgacttgaccaacaccatctggagtaagcacgagatgatgcaaaggctaattagaatatggggacagaaagtgcaggtaaaaatttctgactgaagacgcagtttgacatcatggtcgacttcgctagtttctcagttggagaccacgtacttgggtagattcttgaccatgctatcgagaaccgatacgcatccatccccatgtctgccatgagctgtatatcctcctgaaaaaagcatccatttcgtaggctacatcgattatattgtgctcattttgcaggataaatggataagatatgaatacgtgtgcacttgatctgaaagatagagagaatcagagagagtggtgctcacctcgaaacggtggtactgatcaactgcaacatcagcattgctgaagtcggtgatctttcctgcacaaaaagatgagaaataagcaaaacattagcgttacggtagtga

SEQ ID NO: 23990 - DNA, 782 bp, Oryza sativa
gcagtttaacaactccactccatacccaacttttgaagctaaatttaggagttgtagctctaccaaacatgcactaaattattatattttgggacagagagagtatattatatatggcatgaaagatactttccttacattgaatttagctacaggagttgggtctgaagtggagttgtgtagcagcctaaacccagctccattcatctagtttattttgtgagagaactctacccaactccgcttctatttttggtggagttgaaactatttgacatggagctagaactgtgctaaactagccctcaacacgaaaatcaccatttaattagtggaataagttcatatgaggtcccttaactgtcaacaaatccgacatgtcattctcacccctcttcttcctcctctctccccaactcccatgtattcatctctctcccatctcctttgtcctctctccaagcgtgagtgaggaggggtggtgcacagcgactgccatctaaaatgagaccaccggttttaacagttgagggacccgttgtatctggttttccggttaaaggacgaaaatcggattcgttgataagttaagagacctcagataaacttattccttaattagtcacatagctccgctggcccataaaggaaaaggcccaaggctcattcaaagctcctacccaacccaagtcacctcgcctttcccctctcaaaaaagggaaaaaggtcgcctcgcctcacctccttccacggctccaccgccgctgccgcgacggcgacca

SEQ ID NO: 23991 - DNA, 868 bp, Oryza sativa
ccttgattgcttttgaactgttgatttgaacttgtatggtaggattagatcgtttttattggtctgctgctggaaaatgaaccatggtcgaggcccaccaggcgaagcatcgaaatacttacctagtagtcaccgatcaggttccgattttcctggttttttgaaatttttttagtctcttccattgcttgccgcgtgtcctgctgatttttttttacagttttccactgatttggtgaccggttgatttcctattggggtgacgtatccggtgtatgttactggtggccaactttcttcacatggtgcccacgtacgtgtcggtgattttttccattttattttacgttgtgttttacttagccggtaacggccggttatatctaacgtgccccttcctgattcgttatttcttacagtacacgcagtattatgttcttgtcgtttgttttagcttgtgagctaaggattgtttctctctccttatcttcttacagtccatgcatggcaagctacaatgttgcacacatctagctagctgcttctgcttgcctcgtgccgacatgcgcgtgctgcgtgctctcatgctgctcatgtgtgttgtcatgtgtctcttctttccaatgtttatgctcctccttgctccttaagtatgtggtattttttctctcactttattggctctttcttttgctatttaagtccgaccatctcgttgttttcccatacattcttcacatcaatatatattctttctttatttcttcagtgctacttgagttgtttcctgtgtgttgtcatacctttttccgctgccatgcatatttcttgtttggttggtgtcttatgttttgttgtgttcgatagg

SEQ ID NO: 23992 - DNA, 209 bp, Oryza sativa
ctcccacacgaaaaacagagtggtccattagcacatgattaattaagtattaagtaatttttttttcaaaaatagattaatttgaatttttaagcactttcatatagaaattttttgcaaaaaatgtaccgtttaacagtttgaaaagcgtacgcgcgaaaaacaagagagtgggctgaaatgaacacagcggcacggccatgcgtcca

SEQ ID NO: 23993 - DNA, 164 bp, Oryza sativa
ggttatttccgagcatttggtgcgcaacatccagccggatcttcagaattaccaaggggtcaatttgaactatcaatatcagccgccatcacctcaagttcaataccagcaggcagaatcggctcaacaccagtttgttccttagtacaaccaatttgagccca

SEQ ID NO: 23994 - DNA, 1501 bp, Oryza sativa
agtgttttgataaagttcaaagtccatccttgtatggatatgtttccttctccactttagtttgattttcctcctaccttctaggtttatcatctgcatacaaatatacaacaacacttgtggaaaatgtgagatttaacacctattactatgttggatgctttattatctggattttatgcagatattggcggtatagaatcggcatttaacaaccgccaacaccactgaaatcataaacatgagaaattgagtttgctctaaatctctcagtggcaatggattgaaagaactttgtattttcctcccctaatagcatctatctacgtgtgcacctttttttccaatattgatttctaaactctaagagcttgagaatctgaactttgacaatttctctgaaattccactcctgaacagtgagctgcccggtttcctctattagatcaaaaaaaatcaataactctgttagaatttgtgaggagggaagctaatttggagagacctttgctccaatgaataagtcttttcctaagcaacttgagcttataagatatacatttggcagtatcatcaaacccaggatctaaagcccaaatctgagccacaatgtcaaaaaacccctcaacttgcacccaaaaactttcaaatctaaaaattggagacatggggatcttggtgtcgattttgacaacgcaaggcacatgatcagaaatgtttcaagtgagaggaactacagttgtattaggaaaagacagagtccaagaggcagaacaaaaaacccaatcaagtctctctaggagtgggctctgttgcatgttgctccatgtgaaccttctacctttcaaagggatctctaataatcccaaaaagctgataatatcattaaagatgaaaatatcatttatatttgccctagacttatttctatcctccaccgacatgtaaaaattaaagtcccctagaaaaagagaaattttggttctgaccaatatgcacattcttcatccaggtaacaaaatcagatcttgcagggccagagcagggaccatactgttagagtttgtgtcaaatatatgtacgtagtcggttacagtttaggacttggagttgtactaggtattaggactagagtaagagtcggactctatcctaggctctctcataaatagaggggcatgcctgttgtaaccgcatggcaacatagcatagcgagaggaagcggctgccggcggcgacctgccgtgagtcattgtaactctgatacgctgtaatatgctggatccgggaggagctgtcacgcccagaaatgtcacgcccggaatttctatccaaaattccaaacgcttacatgtgtagaaaccctcgtccaggaatcagctgaggtacacaataacaaattgataatagagtacaattattactctaattaataagcgaataaaatgtcattacagaggtagatagttcctctcaatcaataaagttctaagcagtggaa

SEQ ID NO: 23995 - DNA, 1501 bp, Oryza sativa
  unsure (1)..(1501): unsure at all n locations
aatcataattatagcatctagcacaaccaacactaatagaaggcataggtgtcataggagtttcatttagagaggatgcgctattccgaagagtgtcaatttccacttcaagatttatatggttttttatccaaaaccacaagttcctcttgaagagtttcgttcacactcgtcaaactagccatggaatcattaagcaaagaaatctcatattgtagtaattcaatcctctcaccctccttagctagatcttcttctaaggcaaggtttttttttcttttctagaataagcaagtcttcttgcctctcaagaaatctctctttactatccaaagctttcattaattttgacaattgtttcatggccggtttgctaaaattcttaaacatctaatcaagttcattgtcactatcctcatcactagtgttatcatcatcaagagagggcttttggataggcattaccttgcgcccatggtccatgaagcacgagtggtggtaggagtcgttgtcgtcgtcactcaagatgttgaagaggcgctcctttgttgatgaggacttgatggcgacagtagccacgccaccatctccatctcccttctccatagccttgggagagccttcatctccggagtaccacacttccgccatgtgtgcctccgcaacatgagcacgatcaggcttcttcttgaccaccttgtgctttgcttcattggtcttggggcaatccgcgataaaatggccatactcgccacatttgaagcatgctcgcttggattgcctcttgcccttgtcatcttcctttcttcctttcccatatccactcttgcgaaggaagtgcttgaatctattgacgattagggccatctcctcatcttcactttcttcaccaccacttgaatcttcttcttgattggccttcaaacctatctcttggttcttgatcatggcggcattcttgaccatttgcttcaattcacgagcttcttcttcaagcatctcatttgacacgatccgtccaagtatatcacttggagaaagcctcttgtagtcctttctctcacggatcattgacacaagtatgggatttcttggaacaaagacacgaaggagtctcttaacaaaatgatttgtcatatcttcactcccaagtcctctaatcttgttgacaaggagcatcatcctatcatacatttcttgaggggtctccttgtcatccatgacgaaccgtccaactcttccctccaacaactcaatcttggactcacgcacggcgggtgaaccctcatgagccaattgcaaagtatcccaaatttccatggcttcctcaagtccatcnnnnnnnnnnnnnnnnnnnnnnnncaaggcagagagaatggcattggcggcttgtgcattgaggtgtattgctttctcttgctccgtggtaaactccatgtcttcatttggaacatcaacacatgtgcacacaactttccaaatgctagggtgcaaagagatt

SEQ ID NO: 23996 - DNA, 1501 bp, Oryza sativa
aaggatggcatagtatagtctcatttgcataaacagcatttaataaatattttagaatttaataaaacagtagagtatttaattaaatagtattaatccaacgctatacaacataccctattgcataggcccaaccattctaaacaaccaatcccggctgcacagttctatctccataacaggaatataccattccaaaccaggagctaacaggttattaaccgcatcatttaatatggtgagaagtgtgaaactaatcacgaaagacattgttagacccgcccataaccgcgggcacggctattcgaatagtttaaactctggccagagatgtatcactgtacccacaagacacaacctcaacatcatgtcaaccatgcgtcgcgatacttaacaagtacccgaatagagattgtgacaataccctctgcataacacaattcaaagcagtgcaccgttcccggatcatagtcacccccttgtaaacaaggcatggactccccagtgactcccgtgggcttatctccgccacttcacagtctggtgctctacaatgaaccatactatacagaaagtaaagccgttgctcacgctggcttgtggttggcacggtaaatgtttcacaaccgaaaatcgtgaaccggtccttaattgtcatgagcacgagaccatcaaaaccatgtgctcacaacccaccattatcaggttttaattggcaaattaattaattaaccaatcacgattaaccatcgtgagctatcattaagtcatcatgaaataaaagtgagtcataagtatcccatttatatgagctagtgtctctaagcatggctaagcatcctattcactttagctaaaactatataatgttctagctaatcaaattattacccaagtgacaaagaataggtaatcaagaacaaaagggctataacaaggcaataggttatttccacccaatgacattcaaaaataaaatgcaatagttgaatagaaacaatagctttaaacgggatcaacatgctcaaagggttgtttgggatctgtgtggcttgccttgctggccttggaactcttcaaagtcttctcctgcgaaatcggactctctgggaacgtcggaatctaaggagaaaagagcaaaatcaccaaaacagcacattaacaagcatgaacagtacatgtggatatttttaacatgtagatctcaattttagaaaaatctagagacttgaaccaactaaatccgagctaagatgaattagttatgaattttcaaagattaaatcggattaaatcatttatatagattttaattgaattatgacgcaataatgaattatttttgaaaaggaaaaagggattattgcgtcaacggctcgggttcacggtggaccaggtgcaccgcggcggtctacggaaatgaacggtcgggatctaccctatccaaaacgaacggccgagatcaaatcggttcatcgcggtctacggcggacggcgtcga

SEQ ID NO: 23997 - DNA, 1501 bp, Oryza sativa
gttcgttgggctccaccgtgcaagagatggtggagaaatgtaccgatgccagactgccagtggacacgtagtggcttattgctccctgatacgtgcagcgtatccaataatctgcatgacctggaggcccttggccttttggagcttgtggtgcgaccatgagaggctggaggattaatggtagtgtcagttacgcaccagttttcagtttgagctgattataggagattaggagttggtaggagtagttgctaattgcaacctgtgcaggcattgctaattctgcctttatacctgtgttgactgttagtgtttttaagagcgctcaagctcactttgcgatcggcagccttgccccacatatcaaatgcaccgtacttcattgtccataactagcataatgcacaggcagaacagctttctgggtcaggggtttgctttaagaaggtgttctttttatactttgtagtacatttcttctcgcggccgtagtcgagtacgcagtctgcgcatttcgtcgttctttcctcttctttccaccaacgtagtattgcaatttgcacagcaaagcgtggtgtaaatatttataatgaacgtgccacatcattgtatcagtttgattaacacccatttctaaaatcatatggcagtagtggcagggaaattgctacagacagtttcagagcactgaaaggatccctcgactttatcagatggttacgagcgacgccatcactccattgtctggtgcgctagccgaagctggagagcaatttgaaactttacaaaagggcaccactgctcgctgattacagcaaatgcattgaccaactagtagaaactgccacacacacatgtggcgaaacgcacgaagttacgaggcccagaagagccaaactgggttgagcaaatgagcccacgaggctagtctacacatcggacgtgcaggaatccacaaagaccacaacacggaactgctccagggttgtcgcgtggttatcatgcgtggtaacatttttagttttttaaaatcacgatacatctcgtgataattatgtggttttttagtaagcacgcgattactgtgtaaccgtcaaacggtagggtgaaacctcacccaaatgctatctctcggcacggacgcggaatccgcaccgaacgagccttccagcacctgcatcacatgctccccatggttggtcacaacttcctctgctggatgcatcatcatgcttcctgcgatcttggacaagtagcagctgcatgtgcgtggtattcctcttcccaggattccacatcacctcaattgtttttagcctttgaataatttataaagggtataaattacatctcttcatatcatcttaattgtttttaggttttggatgatttatcaaggatataaattatatctcttcctcccaaaagacacaccatacaactcaattatttataacttatgtataaccgataaatgtaaaaaaaataaacacgggaaaaa

SEQ ID NO: 23998 - DNA, 1501 bp, Oryza sativa
cgtaataccctactcctgtgttctggtggatctgtgtgtgaaggagttacagagcaaatggagagcaagagagttcaagctctagaacccctctttttccttctcttctggttcttttttcaccctccctcccctcccccacttttaggtgggcaaggtcctccttttatatctcaaggggataccacatgcacttcttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatttcttcattaatgggaggagatcttcaatggccgctgtctgaatgaccctccgatgggatgggtcatacttacctccactccgccggaagcagatgcaacgtgggagcacggttgtctgccgatgacgtgaccggcgttagtccagtcacagaccggtcattcttctccaccacgcgtcagtttagcatgccgcacatctgcccctcttcatacagtgacttccttgcaacggttgcgatgaagcctggcatgaatcgagtcgggactgacgtgctaactccaggagttaccacgccggctccagctcgggacgagtgtcaagaggctctcatcattccgacgggacggggcgaggcgtgtgacaggccgcctgctgccacgtaacccgcgatctgaccggtctgtgaccggtcacacattgcgaccggtcacggaccggatatgcgtgcgccgtgctgcattaaatgcggcatggcgcgcttgtccattccgcaataaatgtggtttggtgagcgccgctgtgcccacctaacccacacacgtggtgccaataccacagggggtcggggcgccccagccctcggggccgaaacaggagcagcccgacccctcggggagacagaggagggggtgggcacgtctccctcgggcccgacccccccgagggggtcaggccacgtgggtgaccgcggctgcccaagtctctagtcatgatactcccggtcccatgtcaccgacactagtatacagaaaactccatactgttctgcacctaagattgggcagctttgagtgctttagcggccacatgcttaagaagtcacgttgcaccgtgccaggtttaagtttttacgttttggaacataggggctgtttggtacagcttcaactcctaaatattacttcaggagttgagtctggagtggagctgtggagctgcataaacccagctccacaactctagtacattttgtgagagagcttcacccaactctactcccagttttagtggagctgaaactgtttagctgagctccagcttcaggagaggtggagctgaaactgtgccaagcagaaccatattattccattattttatccaacaaatcccaatttcccggtggaataaacggagcacgacaggaacgaagagagaca

SEQ ID NO: 23999 - DNA, 1501 bp, Oryza sativa
gatctaaaacattgaggatgctcttatgcaaaattcgatggcgtggatcggctgagctcgcggcaaatctaggacgtttaagatatctagttgacggagcgtggggctcctcaccgggagaccgcgcaggcccccctttgccggttcggccgggggcgctgagtgaggttcttcaccctcgatctgtggaacgttcgcgagagagcaaatgcacaagacatgggcgatgtatataggttcgggccgctgagaagcgtaataccctactcctgtgttctggtgaatctgtgtgtgaaggagttacagagcaaatggagagcaagagagttcaagctctagaacccctctttttccttctcttctggttcttttttcaccctccctcccctcccccccttttaggtgggcaatgtcctccttttatatctcaaggggataccacatgcacttcttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctatcatttcttcattaatgggaggagatcttcaatggccgctgtctgaatgaccctccgatgggatgggtcatacttacctccactccaccggaagcagatgcaacgtgggagcacggttgtctgccgatgacgtgaccggcgttagtccagtcacagaccggtcattcttctccaccacgcgtcagtttagcatgccgcacatctgcccctcttcatacagtgacttccttgcaacggttgcgatgaagcctggcatgaatcgagtcgggactgacgtgctaactccaggagttaccacgccggctccagctcgggacgagtgccaagaggctctcatcattccgacgggacggggcgaggcgtgtgacaggccgcctgctgccacgtaactcgcgatctgaccggtctgtgaccggtcacacattgcgaccggtcacggaccggatatgcgtgcgccgtgctgcattaaatgcggcgtggcgcgcttgtccattccgcaataaatgtggtttggtgagcgccgctgtgcccacctaacccacacacgtggtgccaataccacagggggtcggggcgccccagccctcggggccgaaacaggagcagcccgacccctcggggagacagaggagggggtgggcacgtctccctcgggcccgaccccccgagggggtcaggccacgtgggtgaccgcggctgcccaagtctctagtcatgatactcccggtcccatgtcaccgacagtagcccccggcgttatgccagggcgttcgcccccctcgagggaagcgctcgggcgtgacgccactctttagacctggtgacaggtggggccgctctctacaggcgggcaggaacccagcggtcgcaaatcgcgcgcatcggctagggaaaaacgaccgataacaa

SEQ ID NO: 24000 - DNA, 552 bp, Oryza sativa
  unsure (1)..(552): unsure at all n locations
aggggcttcttctcggcnngcttccgtggcgccgcacttcggaaccggagggagtccatgatgccaaacaattcggcccaccacttngtaagccgccggcccacgccggcgggcgcggatctggatggaacgccgcccggcgnccgcngcngccacggctnggagctctgcttccgcgtgcagtgcagggcacgtcgcgggcttctgctcagctcaagacgaggagactggtggagtttctgcttctttttgtcagactcacgtgtgctaatgacaatcggactagtgtgcatcgggagggacccactgggtagacgctcgatgataaaaagcttcttctatattctgccaggaatcggctccaatttcgtgaaattactgcaaaaatttctccattacaaattcggaagagattcagaagcccaatggacggcgctttgcagcaaactgtattactgtttttgaatgaacaaaagaactgcgttgtactcgtgctctattcaatggaattgatacattctagtgccggctcgttcattaaaaataataata

SEQ ID NO: 24001 - DNA, 1501 bp, Oryza sativa
tcctgaagtaatatttaggagttgaagctgtaccaaacagcccctatgttccaaaacgtaaaaacttaaacctggcacggtgcaacgtgacttcttaagcatgtggccgctaaagcactcaaagctgcccaatcttaggtgcagaacagtatggagttttctgtatactagtgtcggtgacatgggaccgggagtatcatgactagagacttgggcagccgcggtcacccacgtggcctgaccccctcgggggggtcgggcccgagggagacgtgcccaccccctcctctgtctccccgaggggtcgggctgctcctgtttcggccccgagggctggggcgccccgaccccctgtggtattggcaccacgtgtgtgggttaggtgggcacagcggcgctcaccaaaccacatttattgcggaatggacaagcgcgccatgccgcatttaatgcagcacggcgcacgcatatccggtccgtgaccggtcgcaatgtgtgaccggtcacagaccggtcagatcgcgggttacgtggcagcaggcggcctgtcacacgcctcgccccgtcccgtcggaatgatgagagcctcttgacactcgtcccgagctggagccggcgtggtaactcctggagttagcacgtcagtcccgactcgattcatgccaggcttcatcgcaaccgttgcaaggaagtcactgtatgaagaggggcagatgtgcggcatgctaaactgacgcgtggtggagaagaatgaccggtctgtgactggactaacgccggtcacgtcatcggcagacaaccgtgctcccacgttgcatctgcttccggcggagtggaggtaagtatgacccatcccatcggagggtcattcagacagcggccattgaagatctcctcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagaagtgcatgtggtatccccttgagatataaaaggaggaccttgcccacctaaaagtgggggaggggagggagggtgaaaaaagaaccagaagagaaggaaaaagaggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaagaggggcctgcgcggtctcccggtgaggagccccacgctccgtcatctggcgcgccaggtagggggcgcgtgtgtttttctaagccctcgtcctctttcgtgtgcgccaagtttctcccgctcagcccaa

SEQ ID NO: 24002 - DNA, 421 bp, Oryza sativa
gtattttggcatttcggtcgtcgtgcttcccatttgatgttgctagcatctcttcttttcgcggttgcattttgcagtagttcgtgccatccatcttgattgttttgttcagtagagccacttaggtgggttgccacatcccagtagtggtagtatagtagttgtcacaaacactatctattgctacaaccagcacaaatttcatatgcttgtctagctctatcagtttttctggatattggattttagatggttccgttgtctagttgcaccaatacatttgctatcctaactgactgcttgataataaaattgcagtgtttcgatatgcgtttaggaagttctcaaatttaagtctatttcacatgtttgcttgccttcagtttttatgctgtttgtattaatatgataatgtctctcc

SEQ ID NO: 24003 - DNA, 1501 bp, Oryza sativa
gcgcttcatcggcgaggggggtgtagaaccagtcgctcttccagtcgtcccacttcttgcggaggacgcagggaatgtagcggttcagcaccggcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccacgttgggggtgaggtgcgccatctggagatcgtaaagctccagaacatccatgaagaaagaagagaatggcgggaccagtcctgccattgcgaaagagaggaagaagacggaccgccccgggtagtgtggcgccgggcgtccctcacccagtgcgaccacctcccggccggcggcagattccggcatgaatcggcgcggcagcccggcctgcctctcgctcacgatgcgggaaggcggcagcacgctaccgtcgagcggtgcggagccccgtgccatgacgccggcggaggaggagcttgagaacgagtgagtgcggcaagggtagggcacaggaaacaaggagttagggcgcaaacggcgaaggcaaggggaataatggcgaaaggaaggaaacgaatctcttccttggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggatatatcgtgcgcgcgttaactacgctcgccgaccgaagcgccatcatcatatctccaggcgaaatgaaccggctcgtcccgattcgcgcactactcgagtaatgtaacggtcttgaagaggccactcattgttatcggtcgtttttccctagccgatgcgcgcgatttgcgaccgctgggttcctgcccgcctgtagagagcggccccacctgtcaccaggtctaaagagtggcgtcacgcccgagcgcttccctcgaggggggcgaacgccctggcataacgccgggggctactgtcggtgacatgggaccgggagtatcatgactagagacttgggcagccgcggtcacccacgtggcctgaccccctcggggggtcgggcccgagggagacgtgcccaccccctcctctgtctccccgaggggtcgggctgctcctgtttcggccccgagggctggggcgccccgaccccctgtggtattggcaccacgtgtgtgggttaggtgggcacagcggcgctcaccaaaccacatttattgcggaatggacaagcgcgccacgccgcatttaatgcagcacggcgcacgcatatccggtccgtgaccggtcgcaatgtgtgaccggtcacagaccggtcagatcgcgagttacgtggcagcaggcggcctgtcacacgcctcgccccgtcccgtcggaa

SEQ ID NO: 24004 - DNA, 339 bp, Oryza sativa
cgaaacactgcaattttattatcaagcagtcagttaggatagcaaatgtattggtgcaactagacaacggaaccatctaaaatccaatatccagaaaaactgatagagctagacaagcatatgaaatttgtgctggttgtagcaatagatagtgtttgtgacaactactatactaccactactgggatgtggcaacccacctaagtggctctactgaacaaaacaatcaagatggatggcacgaactactgcaaaatgcaaccgcgaaaagaagagatgctagcaacatcaaatgggaagcacgacgaccgaaatgccaaaatacattatcgtttaagc

SEQ ID NO: 24005 - DNA, 1501 bp, Oryza sativa
tactctggcaactcgaacctccattggaaaacaacactatccaatactgcgtaccaagcaatgaaaaacgtaacttagtcgagtgacactttgtagagaaaaaaatatcaagataatataaaaccatttttgttgcattttcattccgacaatttgttgtgaaatatccacagtggaccagctacctataagatgtttaacaattgctacatctattgattttcaccgagacgcctataaattgggtgcccgattttttttaaaaaaataaaaaatcaggcactattttactaagtagaccgaaaatgtttcactaagtagattaaaaatattttaatcttgtaaaagactgaaatacaaccaaatcacctcatgaaacattttgctacaacgtatgaaacaacggtttctaaaaaaataggcgttgttttaccctatataaaaacaatgtttcagcaaatagtgaaagaatgtttcaattttttaaaaaagtgaaatacagtcagatcgctagatgaaacaatttggttcaacgtatgcaacaaacgatttaaagccatttcaacacttaaaccctgtgtacatcaataaccatgtgtccatcaagatgaaattattaaaacattataaaaaatccactgcaacatttcatccatacatagtgaaacatcgcgagtacactagctgaaacattgtcggtggaaaaaaaatgaaatggatcccccctaataggatgtttctgttatatccgggcagatgttgcaacggagcgcgcgtggtggaagcaacacgcgcgcgcgggaggcgtccgagctataaaactaatatcgcgtaaaagcatttgaaatataaaataagagtacaatttttttacacacacatgtacttgtgaatgtaagtaattatcggttatcctttaaaattagataatctaagaaatgtcattgacaaatgtcaaaatacaagaaatgccatcgtatgaataattttgtcccaaaaatgccattgccgttagggttcctctatcccatgctgttaagtgatataggatgaacaatatatttaacgacacgagatgtgcggaactctaacgacgatgttatttttagaataaagtcgttcgtacgatggcaaactcacgcttgtcgatgatatttcttaaatttggacgcttgttaatgacatttcttaaattgtctcttaaaattaaaatgctctctacaaaattccacggaggcacagagcgagacgacaaccatgacattttagcgagttcagtccatcaaacaaaaaaaaaaagaaaagacaaacaccgtttactcctgaaaaagcccaaaaggccgaaacccacaagcccagtaggccactttccgatatttccgcgtcccccacgagttccattcccagttcccaactcccatcaaccatccttctcgactccactgaccaaacaccccagcggaccaaatcgccgcagcagggcgcgccatggagccggcgg

SEQ ID NO: 24006 - DNA, 247 bp, Oryza sativa
tcttaactgtatatactttgcttgggttgcaatccataatgcggccataatgacgcttttatagcgtcttaattaattatctgccctaactaaattttttttattacaactagctagcttcatgttccgaccaccacatataaccacgccgtggatgggaactgatcttatccggattgtgacgccgtcgttgccgtgccacgtcggccggtcgggccgttcttactcgcatcggttcatttttagg

SEQ ID NO: 24007 - DNA, 1501 bp, Oryza sativa
caaaatacaggcttcatggtgtgtactacggctgtgtttagatctaaagtttggatccaaacttcagtcattttccatcacatcaacctgtcatacacacataactttttagtcacatcatctctaatttaaccaaaatccaaactttacgctgaactaaacatagcctactatgatatatatgactcgctcgctcgacgttgtatgagtatggtgtgtgcacgtatacatcttcagtactgtatgtagtccagaaaagtcgatgccatatagcggttgatgcacggggagggagagggtagtggttacccccacgttttctgaagcgatctcgcagtatcagtttttggcactatatatatactccatccgtttcaaaatgtttgacaccgttgattttttagcacgtgtttgaccgttcgtcttatttaaaaaagaattgtgaaatatataaaactatatatgtacatgaaagtatatttaacacgaaaatatataaaactatatatgaaaataataaataattacttaaattttttgaataaaacgaatggtcaaacacgtactaaaaagtcaacggtgtcaaacattttgaaacggagggagtatatattacccacaaaaaccttacatcagtttttattttctggaactcaaaaccttggatcgattgatgcgccctgcccctgcaaatgccaccacatgattgaacatgagacgatgcctaatagggaatattaagtggcccattatcgtcctgatcacttgccgtgggtgcagagcttacctctgcagtattgctcgatctcgcggtctctttacaccgagatatgtattttaatctgctactactaatctagaggcaatcgatcgatcatcgccgtgtcatcagctaggtattgttgcgcgctactctctcttgggtcccgctgatcatgtgaattctctcccggatttgctaattcgttgcttgggtgagacgactgatgaaacacttttgtgggtcgcttttactgaattttatatggttgtgcatgctttcatcaggtgatgatcaatcatgtcagtgatacgtacaggacaatacattactatgggctagatttgttgaacaatacattactgtatgggctagattggtcaactgagatggaggttaatgttaattacttgttctactgcagttaattaatggatatgctcataataaaacggtattactggtacattcttcgtgaaatggaaagcaaacacggtagtaactttttctatgctttccttgttagtactagtttctgatttcacgagcgcggcagccaaatctttcagatggttttatatatgcttttcccctgcatctccattattagttttccgacagcatcaggcaggttcggcagcccgtgcatgcttgtggaagtcccatttctctcgcgacaattagcgctgcaacctctgaaacttcgtcaggcaggcaggcagctcccgttctcccatgcca

SEQ ID NO: 24008 - DNA, 1501 bp, Oryza sativa
ggggactcgccgagtggctgtgaggggttggtgaagcctcattggcgacggcgcgcggctcgcggaactcctcggtggcgacgctccactccgggatggcagtgacggctcgatctagcttgcaacatggtacgcatgatgttagtgaggtcccaagggtggtgcactggtgcgtgtgccaggaaacgatgtgaggctcgccgggacggctagaatcgaaggttgacgccagcggccggaattggggaagaatgcttgttctactcgctccggccggctacctagcttcgagtgcttgggctcttgggctcttttgagatatcgaagatgatggtgtagtggctcgtcttggagtccaccggagcgccagaacgtggccgtgcagcagctagggctcgtcggcggcgagagtgtgaattgcgattaagcgacgatttggaccttcgcaactggatccaaaatgcacggatggattaagtgtggtaagtggatcacgttcccgtgctcggtttgcggcgaagctcaccaatgcggaaatggcgacggcaaagatcttaccggcactgatgaagatgcttccgttcccggcgagcgaaggatggatttccttggctcttccacgtaacagactcggggtgagaggaggagactttcggtggagtggcgggttgaatggtggagatcgtcaaggtggttgacgtggagagaactcggccggcgtgtgcgacgtgtgggaggcatggcgcacgcgtcgtagatggtggggccgggtgaagggcttgtgaggctttccagtgggtcccacatcgccctgtggcccactggcagtgagaggttgagagagatggggaaaacaaagaattttgccctactccttaactgcagcactattgagcctttgactctacttgtcggtgccttgctgtggtttaaaagatggtggtagagggagttttggtctacagcctcgaccaggtttcacccctaaatggattatgattaatttatggtggattagcaaagagggttaagtgaaatctgtaatttccaggtttttgctgttttaagtgatttatttggggtacatgaaagagctcaagtcatatcatgctcattatgcacatgcaagcacacaccatgttttcattcttaccttagatctagaaatgaaaaggttttatattgctcacaaattttcagatatgcaatggttgtgtttacacccaaatttggcacctaggattaaaatagagaaattgccaaaatttgaacgatctaccggttttcctctgaaagggccggtctgaccaccgtgtgttggccggtcagaccaccgctagtgggccggtcagaccgccggcatgtggccggtctgatcggcagagtccgagtcagactccgttttcatcgaatctcgggtttccttgcatgtttcgtgtttccatctatttttagcctgagttggacgtggaggagggcctgtagagggcaagaccaaccc

SEQ ID NO: 24009 - DNA, 1501 bp, Oryza sativa
tttaggctttaggtacgatgatggagctacagaaccttaatggaggaggagatcaaaccttatccacgtcatccacctccttgcccttatccgatagccattagagctctatttcgcatgggcatgtgctggtgatcttatccacaccgtttccttacaccctaagctaagcccctaacaaaaatccccattcctctcagctttcttcccgaatacatttcgtcgaacaccttgtgtgcgtaatctcaccgctaccaaagaccatattgcgggactccccgttcggagctggtggttggagggagtggagggggtgtcgtgctgccgccgttgccattggggaagctgaggaccaccggacaccgggaaccatgcgtcgaacacttttggcgtcaccaacagctagccgcctttgcttcgtccgcaccgcaccacgcgtcgccgcccttcaccgtttctccatcccggggtaaaacctcgagcccatagcatcctctggtgccacggtgaatccgcaagccccctctcgtgccacggtgaatccgtaagccgatcaaccgagcaccccggccgacccaaccccatctcgctcaccctagcctagctacattagctagaggaaagctacactacaagcctagccattgcccatgttggcttgtggtaagtacgataagttcttcctgggcattccgcgaaccggtccttaattgccatgggcacgactagcaaaaccatgcacccacagcctaccatttagtgtattttaattaattaacaccattgcggtggcacccatccaaagttatgctaaaagccaatgtctatgcaataatgtgattccctcttgtgtgctagttgaactaagcatggctaagcaaatcctaatccaacatctagtcatattacaacccaagctaacaaagaaatgaggtacacaaataatatggctgagcatagtaggtaacatcccgtatagtaacattataaaacaatgcataatttaaaggaaacatagagaatttgcaacatggggtcaatatgttcaagtgacaagcatgacttgcctagctctgcggttggagggacctcagcgactatttcgaagtacaccagagcgtcgggagagccggaatctatgcgacatacaaggcaaacaatgcaaacaggctataagactactgaaatagagaacaaaaccatttttaatagattctttgcatttttcttgatttactgagacttcaatgggcttaaacggagcacggatgaattttctatgaattttagaagattcactgtgtttattactataacagaaaagtccttaattgaattattgcgcattaaatacctcggatgacgtcatcggagagagcggcgccaataggcgggccccacatggaggtggcacaggtgcgccagtccacggtggaccgagtccacgggaccgggggagggggcgcaccacgtggtgcacacatggcgccgacgtggcggc

SEQ ID NO: 24010 - DNA, 205 bp, Oryza sativa
tttattactttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaac

SEQ ID NO: 24011 - DNA, 1501 bp, Oryza sativa
agatctacatgttaaaaatatccacatgtactgttcatgcttgtttatgagctgttttggtgattttgttcttttctctttagattccgacgttccgggagagtccgattttgtaggagaagattttgaggaattccaaggctagcaaggcaagtcacaaaaatcccaaacaaccctttgagtatgttgatcccgtttaaagctattgtttctattcaactattgcacttattttcgaatgtcattgggtggaattaagctattgcttgttatggccctttttgttcttgattactttattctttgataccttgggttattataacttgactagttgagctttatatattggttcagctagatattagatatgattgcttagccatgcttagaaacattagcacactattgggataactaatgcttcactattatttaatgatggcttaatgatagctcacggtggttaatcgtgattgattaattaattaatttgccaactaaaacctgataatggtgggttgtgagcatatggttttgatggttgtgctcatgacaattaagaaccggttcacgattttcggttgtgaaacgtttaccgtgccaaccacaagccagcatgggcaacggctttactttctgtatagtatggttcatagtagagcaccagactgtgaagtgtcggagataagcccacgggggtcgctggggagtccataccttttttataagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctctggccagagtttaaactattcgaatagccgtgcccgcggttatgggcgggtctaacaatgtctttcgtgattagtctcacccctctcactatattaaatgatgatgttaataatttgattaactcctggtttggaatggttaattcctggtttggagattgaactgtacagccggggttggttgttcagaatggttgggcctatgcaacagggtatgttgtatagcgttggattaatattgtttaattattatttaactgttttattaaattctgaagtatttattaaatgttgtttatgcaaatgagactatactatgccatcctttgttatcctgtgcacttgcatatttgctgcgtggcttgctgagtatgtcatatactcaccttgcaatcattcatcagaggaggagttctacagcgatgccgatggagtggatgattaggcgtagccctggtcaagctgcctgtggaggggagtcgcctgcgctatttatttatttttccactgcttagaactttattgattgagaggaactatctacctctgtaatgacattttattcgcttattaattagagtaataattgtactctattatcaatttgttattgtgtac

SEQ ID NO: 24012 - DNA, 1501 bp, Oryza sativa
cgtggaatagaattagaataggaatcaggagtccggaagtcttcggaagagttcaggtatggctctagtagctttcctttcctcttttgtaagctttgtacttttattagaatactcttctaaatacatttctggtattgaaatactttccgagtatatgagtaccaactttacattatgttcttgttataatgaatgtacggctagcttatttgggagatgctttggtgcgggtataatgtttgtttatgcaattactctatgtcatgacgatgatattagagtagtatctggtagtttaggcgtggtgtctagattacgggatatcattatttggggttatatattgcggatgagaggtgggccgatgatggtgatagctcagtatgggtattcctccgtgcctatatataatcctaagttaatttccgagggagagtattcctccgtatttagccccggttggatggtcatgacgggctgtcgtaacgaactcggcagtcagggtggcttctcgaagtaccaggagggcatcggatagagggtattagctagtatatcagttaactagaatgtatgtatactatgtatattagaagtataggaatagattatccttctcttttctttccacctagcttatattatttattatgaggatgagtagtaatggttgtgtgtcactctacccttggattatcataacccctgcttagaatataattatcacaagtaatatataaattattagttgagttctctctacatgatcttcccacgggataaaataaatacgatacccttggaatactcttgggtgaaatgctacaatggtatatccgtgcgcttgcggatgaactttgtaaccataatataccagaagtatttctgcgccattgctgggaattatatttctagtaatgtcgttaagaaataccaacaattggcctcccatagcgccaccgctggtcaccaagggggccggttagaccggcatagtgcttgtggtcagaccggccactacctgccagtcagaccggtatacaagccgcgatcagaccggatctggtcagtcatcccagtgacagcaagaaatgagaaaattaactcaagtcaacatgcgcgtgacctaatgtggcaatatgaatcatctctttgtctagatcattacccttcttaatagtacggcaaagctaaaattaaactagcaaattttgatcgctcaactcctcgatcaatttaacattaaaacactagttttaccgtcttcctttccttttgctttgcgccatcaattttagtccacaataatcatctatgcgcacacataatgtgaacctaacttaaaatatatagctcaatagaacggttagtccacaaaaacaacaggggcctagatgcttcagctgccagaggcaaggaagaatagctgctcgcgacgcaatgcccctcacatacaacctacaagtcgagatattcgatgtgtggggtattgacttta

SEQ ID NO: 24013 - DNA, 1501 bp, Oryza sativa
gtcaacataaatataccagagtacgatgaagcacaaaacgtttctgtttacacctaaaattggcatgaatgttcaaattaaggaaaattgctaagatttgggaaaaatcgctggtttcctccatagggccagtctgaccggcgtgtattggccagtcagaccgttgattgagggtcggtctgaccggtggcatgtggtcgatcagaccggtagagtccgagaccgagtctgtttttgtcaggtctcggaattccttgctcgagagactatgcttttggtttcctttggtttctataccgagttgaacgtggaggagaatctgtaggagacaagaccaacccctatataagggacaaagccggttcaattggaggagaatccacatacaacccaatttagccaattgaatcgctttttgaatatttcaaatctagttttagtctagttcgtccatctttatcgatctgcgtcataaatcgtccaccttagctgcaagagggcgaaatccttttgtaggtttgtctcgtaaaccttccgcttatccacgaaacgggtagttatctattgttttaactaaattggctctgctagccggtttaatctattaaaacccatcttaatcaccataaaatgtttaggtgtttcaaccgtgattgtcttcatgtaaaaaaaaaagttgccaacaacttcttgttcaatcgacttgtttattactgattttaaggggtcctaatagtagagaatgacgaagcaaattttgcatttgccgttgtttctaactccggaacgtatgcgtgatgaagcgcaacgcgtttcttgtctaatcgactagtttatttctactacacagccgtagccctagaaacaacgggacgtaccatacatatgcttccttagcgaacccgcaaatcggccataaacacggtgtgccgtagctctgttgccactaccgctcgcccacacattgtcattatgtcaacccatcattacgaagcgcagaggtacactgatccacccagagacatactcatatccctacgtacatcggtacaggtatacgcgaccggccgcggcagggccacaccgacgccctttccggctttcatcccgacccgacctagctaatctatcagccgcccacgcccaggcttttatcaaaacagtccatggtgcacctaccgaccgacgttgtaaagaaacagcagagatccacagtgctgtcaaaaaacccaaccccacgttcccaccatctattcattcttaaatctcgaactctctgctgctgccgccaggcgccccagatccactcgctcgtctcgtctctccgctctcttccggacttccactagtcgcacactagcactcgccactcgccagtcgctacgactagtagctccacctctgtagcctaaagcccaccccccaacaccaccctctgtgaagtagcttgtcctcttcgccgaggccgaggtgacgcacatggcgctgcctcctcctctgc

SEQ ID NO: 24014 - DNA, 1501 bp, Oryza sativa
ctggctcgctcccaccgctggcgcagacagtccgctacttctccgtcgcggcgaactcaatgcaggggagcctcgacggcgcgttcggcaacggttcggctccgaccgacttggccttcctcgacctctcgatgaacaacttctcgggttcaatcccgcgggagttgttcgcgctcccgagcgcgtcgtcccttcttctgtcccgcaataacttcaccgggtccctcgccgtgccagcgttcgcatcggagcgtgccgcaacgccgccgtggtcggttgtggacgtcagccacaatggcatcacgggggaggtcccggaggagctagcggccgtggagagcctgtacgtgaacaacaaccggatgtacggcgaggtgccggaggcggtggcccgtagcgtgttcgccggccgcatgacgaccttctacgcgcagcacaacttcctgacgggcttcccggtgccgccgctgccgctgccggactccgcagcgctgtgcctctcttacaattgcatggagctaccgtccgcttctgccgccaacgggtgccccaccatcggcggcccaatggagtccaggcccgccgaccagtgccggagcagcaccgcagccaacgccggcagcagcggaggggacggctgagccgccaacattcctcaaggctgacaggtggggcccacctggttcagctcatcagctgggcacgggtgggggcgtgaggaagggacggccaggatagctaagcctggctcacacattttcgttttgtccgtttgtttcgggtgtggttttcatgtgattgggtttgaattcatcggcatccgggcttgtcgtcgggcgcgcaacggttacacggctacaaggttagcgcgttcttgtgcgtgtgtgcaattactcgctctggtagtttgtacgctgcgtctgtgttactctgttcattgtgagtagctggcagtgtccatttaaacaactctgttcatactctactaagtcagctaatgtaaagggaggcactattttagggggtgtttattttttaaagtacatgtcacattggatgtttggacgctaatttgaagtattaaatatagactaataaaaaaactaatttcataaatgcgagctaatctgcgagacgaattttttaagcctaattaatctataattatgaaaagtttactgtagcatcacattgtcaaatcatggcgtaattagactcaaaagattcgtctcgcgaattagtccaaggttatggaatgggttttgtaattagtgtatgtttaatactctaaattagtgtccaaacatccgatgtgatagggacttggggaataaatccatgtttcccaaacaggcccttagaaaaaaatatcaaatcatctcacttgttgatccatgtttggagtctcgacagagttcgcggtatcggcggttaagagttcacggtatcgacggttaccgtactctagtaactaggtggtaatgttggtatttcttacgat

SEQ ID NO: 24015 - DNA, 1501 bp, Oryza sativa
cccttagtgggttttggtgatcaataacaatagggttaagggactaatgagttttattgagcaatacttaggtgttttagtcccaagatgacattgtgtgatcaagagatgcttggagaccccccacaacatagattcgagcggaatcggaactcgaagtgtgcataggctagtttatttcttgtaattgggttttaggaaaaactgtactattaagaggggttctagatgtggttctgggatacaacaagtgctcttagtgagatccaagtgtcaaaatatttttaagagctatttttgagaatagccctacctaggacatatcaggttggctggaagttccggaccgttgaagggtgaaaatttcctaaatgttgtctggaacttcctggaaattccagacctgttttctagttcaaaaatgtgagtaacggctagataacgtcacctagccattatatatatccaaatcatccacaactcactctttggccatttcacttttgcttttccactccatagctgttgctagcctctcccaagagtttctttgcttcctccacccaatcttgagccattcttgagagagagtgagattttgagggtgaaggagaagatttggagaagatttgaaggctaggattggtgtgagcacttggggtatcttgtgggctgacatctcggtgcttactgctcttggagatcatctcttagacggttaggtgccgcccgcgagcttcctttgcaattgtggatgtcccgggaaagtttgtgaaggtattcctcactttcgcaaggaaatgaagtaagtgagtaaagaagcttgtgctgaagtcctagaggttttcctagtagagcaactcacacttgtgatgttttctagaaggatgttgagttggatcttggtggtcactcaaattatagaaaatgacctagaggtgttggggttgaaggctgtggatttcgttcaagatttttgtacaagtgaggcaaggggttaatcgagacccggctctttggagcacctcaacggagagtaggatcgcgagatccgaacttcgggaaaaaaatccaccttgtcccttcagtgatgtttctgtgcatgtgtctatgatattgctacctctctgtttgcctatgattcaactcgtgaaatttggctgagttcctgttagtgttatctgaatttctctgttgcccggaagttctagtccaagaacactagaacttccggtgttctaactaggaggttccgggcctgttaaattttaccgcagcgatttgtttttgagatttcaggcaagcctattcacccccttcccgccccccttctaggctacatctgtgcgcattcaattggtatcagagcttcatgctcctgattcaagcttcaccgcttggagtgatccaagatgtcgcacttagagggagataaagagttggatgaaaatggtgatggatcaactagcaagggaacgtctacacctaagggagcctctat

SEQ ID NO: 24016 - DNA, 1501 bp, Oryza sativa
gttgatagctagtttaaagttcataacaaagttgatagctgatagattgcacggggtgatcttaaagttaatcagtgaaaatcagtatggttttatcaatgtcagtaatccaaaagagagaaaaatatactaaaactggactttgagaaagcttttgacataatagagcattctgtcataatctcagttatgcaacatatggattttctagaaaaatggcttcactaggttcaaatggtgttctcaacagctaactctgcaatgctcctcaatggtgtcctaaggaaatcattcagctgtaaaagaggggtcaggcaaggtgaccctctttctcccttgctatttgtgctgggagctgggctgcttcaaagagtagtgaataaagcttttcagatggatctgttatccaagcctatcaatgaaaatggtggcactagtttcccaattatccaatatgctgatgatactctggttttgttgatggcatcccttttaggttttttgtttcaaagccatccttaattcttttgctcaatccactggttttaaagttaatttcaacaagtctagcatgtaccctctcaatctcactgctgagaaatctgacttgatggctggtttgctgggttgttctattggaactctccttttcacctacctggggctgcccatggggaaagaaggctcacagcaagttcaatgttcctcccctaaggtggtaggctgaccttaatcaattcagttctttcagcaatccctacctactatatgtgttccctacagtttcctattacagttgtcaatgccattgatacagcaaggaaaaattgtctttggagaggaaacaacccaatttctacaaggaaatctttggcatcctgggatctggtctgtaggccaaaggataagggaggtttcggtatagtgaatctcaaagtgcagaacatagcattgttgctaaaacacctggtgaaactttacaaaggtgtaaatctgccatgggtcaatttggtatggaattattacttctctgtaaaggtacctcatttggtttttaataagggttccttttggttaagagacatctaggccctctcagccttgttcagaggtattgcaaaatgttccatccagtctgagaaatcttatcttttttgggatgacttgtggaataaggaactgcatagctccaaatttcctgctctgcatgctctagctttatataaggaggaatcaattagctgaatgtgatctaggactttggaggattgtttcatgatgcctctttctacccaggtttatggggattttttgcaactttaggacttcttgaatcctctgaatttgaatgatgcacagggtgacaattggtgttttatttggaattcagagatatatacctccaagcggttctataagcttaacttcatgtctttgagcccttctaggccttttgtttggttatggaagaccaagtgtgttatgaaagtcaatgattttg

SEQ ID NO: 24017 - DNA, 1501 bp, Oryza sativa
agtatatggtggtcatcaattctaattttatccacgtcatctacttattaattaagagataacatatataatatattgcttttaatatacttactctgatatgctatactaatttttctctatttgttttcacttaatttattggtctcttctctcggattcctataagtttgtagttttgtgtagagattgtcctttcgtctcttcctctctttctctctctttctttctctattccatcttatcacatgatcctacatgacatcttatgcaaaagctaagagatccatagtaggttgagttcgggaggcaaacaaagaaagcgattagagcgatattaattatcagtctaaaaaagcttggaaaatggattaatatgatttttaaagcaatttttatatagaaaacttttgtaaaaaacatactttagcagtttgaaaagcgtgtgcgcaaaaaaagatgaaggtgggtaggaaaagaagggagaataacacagcataagcatgttttacccctcgactattaactcttgattaaggaacatggtaaaatttataccactaagttatcgaaaccatatataaatgacttttaagataatctccggttttttttaatatgaaacgtcattgatttttaagatatatttgaccattttcaaacctaagaggtggtttattttccctcaagagaacgcgccgttatttttttacgtcacctaaaaaacataattttttggaaaaaaatatatgaaaagacagatgaatatatgattttttttaaaaatacagattcaaactttacttacacaaatagaaacaaaaaacaataaatttgcttatgaatggtcaaattcattatttttatttgtacctatgtaagtcaaatttaaacttcatggtcattgatatatttataaaaaatagttttttagttgaattttaaagtaacaaaaaaaacaaagggacaaatagacttccctataacccaacgcatgctcaaccacagtaaatgttttagctaagacttagagttagttttcttgcaacatcgacacaccattgcctgtgtcttgtgatttttcctgcacgtttagaagggtggcatcgattgaacttctggacacttggagttcttccttcttcgtgatgcaccttttgctttacagcgctagcaatggccatggtcagggccctcagccctggccgggttcggttacatgcatcgtgatatgcttgttgacctgtgcatcttgcaccgtcatcccagcaatgcaaaacatgcaaatccccacttcgaaagcacaagattccttggctattccgaaccaacagaacacctactcccaaacaatcacgctgactcatgcaacctccatgcatcgaatatatattttcgctgcaaaggcattaagaatttaagttaagatcaccgtctccaccaattccgtctttcctctgcgtgcaaattccgtcttccctcgctcctgatctccatggaa

SEQ ID NO: 24018 - DNA, 184 bp, Oryza sativa
cgaattggcttattttttggggaagccgttgcacggtttcatttgaatgtaggacttgcggcttgtttattatatgcaggtgagatttttaagaacattttcgagaaaaaaaatgttgtagcagtattgcagcaggttataggacattgaccaatggactaagtgtggcagcatttctagcatt

SEQ ID NO: 24019 - DNA, 271 bp, Oryza sativa
agatcaaacactagtgttaggatcagtacatgccacatctccgcgtgttcctgcgagattggtcgatcgatcaaacatcgcgtaattacaagaagcgtgtagtgtacttgaacatgagaaaattcatcaggtgcaaagttagatcacttgctatgaacaaagagctactactagtattttgctgtgcttcaaatgtggtatctacatgttcgtttagactcaaaaaacaaatctgcttcacatggattcgtgttaattctcgtcttgtagt

SEQ ID NO: 24020 - DNA, 1501 bp, Oryza sativa
atataactactcatgaagattgttaaataaattaaggagagagataaaaaatgctagattgcccttaattgtcaccaccgttcctaatcccagcgagaagagggatgaaagacaaggtttgggaaaaatggacatttcacttcccttcagtgacaaaagattaggaagaatagcaagtctgtcatttaaagagtgacaaatagttaaactgcattgctaaccttctgttgacaaaaaatccatcctcaaatcttgtagattttgggctaagggatgttcttcacgattaatgctccgggtgtgtctcatccaactctggtgacttcctcttctcctctggttccgacaacaccaccaaactccaaatggaggacctacaaattaaggtcatgagttggggatgagggatggaagaaaagtgggaggtcaccgcctcgcagggcttagagggatgaccatggtccatgggagatggtgcccaacattgggcagaggaatgggtgggcggctagggcatcggtgctgccaaagcgcgtggacggtaggcggcggtgggcctgtgttgcaggtggcaggggtaaagcagagcgacgagttaggaagtggtgaccagtggtagcggattcgacagtgaggaaccacttgagacgagaaaaatggctgggtaggggacctcgtcgttgatgtcttgaggaggacaacggggtaggcctgcgcatcaaataagtgtcggttcaagcatgcggtgctgaaggaaaaggaaaaaaaaaagagaaagggattaggatatggatacatgtatgaatccccaagcaatccaactatctaaaattacaagattttgagtggtgtttctgctaaagatgtactccaataaatagccaatagttaaattttcccaacaggcccatcatcacgtgattcgcacgggttgcacgtcggttctggacttctgatgcatcgttcggggagtgccgggcacgcagaggcgttggtgcgttgcaaaacaaacatgtcaaaaccacggagataaccagataatcctcgcacatctcgcttcccatctcgtttccaccgcacctttttcctctcggcggaaaatcccagcctcgaatgtgccaacgagctcaccacaggcactgcacagctcgtgcgcaacgcccagaggaggccgtgggcttcctgtcccgcgtccgcgcccaccacatccgcaattccgcacccgaatctcgcggcgtcgcctcgtcagacctcagcccacagaaaacggaaaaaggaaaaaaaaacagccaagccgccgccgcgcggagcacagcggctcagcgtcagcgagcgagcggcggcgcgcccccctcgtcacgcacgccgcactcggctgctacggtcctcacgccgcttcggcttcgcgagcggacgccggcgcgcgcgcgcgttcggcgagacgcggcggcccttctccccctcttgcacaccccccagaccatgcgcgtctccgaccacg

SEQ ID NO: 24021 - DNA, 216 bp, Oryza sativa
ctattgagcgatttgagtagggtatccgaggaaacgttttgtgaaattttgtacgtaatcgatcgacaattcacataggaatatatgcatatcctctacaagtccacatcaaatcagtcatagtacatagtaagtctttaacacaaataggtactgcaactaccatagtaagagagttataagcaacattcacctcagatagagtttagatcctta

SEQ ID NO: 24022 - DNA, 259 bp, Oryza sativa
caggtttgtttttactccacttgtagggcccgtttagttccccaaaatttttttttccataagcaacacatcaaatctttagacacatacatgtagcattctatatagatagaaatacaacctaattgcgcagttatagaggaaatcacgagacgaatcttgcctaattagtccgtgattagccataagtgttacagtaacccacatgtgctaatgacggcttaattagtctcaaaagattcgtctctcggtttccagg

SEQ ID NO: 24023 - DNA, 1501 bp, Oryza sativa
tcgacgacgtccccttcgccgtcgaggagcgcgacgagggtgtgcatccgcatgctgaccatcttccccagcgtccgcatcgtcaggggcagcttgaagtagagcgttcgcagccacggccgcttggcgaacacctcctgcgccgccgtcctgcagcagtcgatcgccacccagaaccgtccgccgccgccgccgctgctcagtcgcacgttgtccgggaaccccggcaggtcggcgaacacctccacctgcccggctcttggcccttccagccagtaccgcattatcctagaacagcatatgcgtgcaatgttaatcaattctgaatcttgtttaacctttagtattttcagaacctgtgaaagcttgtgccatttcacctgcagtttgttgtttcggagaagaggaggaactgctggtcgtcagaaatctgcacgccattcgggaagaccagcccgctcagcacgacatgggcagctttggtttctgggtcatatctgagcagcctccctgtgccttcaccttctagcagaacgttcagatgatccctgcacaactgattctaatcagaaaatcttgaacgatagaaggaaatagagaatcgatacaactgaagagagtgatactgcagctgcacactttctgttgtatctcgtgctcgtgtcggtgaagaacacggagccgttgcggtggatgtcgaggtcgttcgcgaagttgaccgggctcccgccgacttctctcgcgagagaggtcgccaccccgccgttcggaccgacggacatgagcccgtagtacgcgtcggcgacgtagagctcgccggtctcgccgtgaaacctcagcccgagaggccggccgcaccgtcgctccatctcgtgctgcttcttcgtcgtcgactccaccccattggcacaaactttctccgacctttttttgcaatataagaacacgtaattgtacactgctacgagaggtgttttcgtggagggcgagagcaaaatgcaggcgaggtgttcgttaccagtcagggctcatgacggcgaacgtctcccacccggcgtcctcccccatccaccgcacgacgcggccgtcggcgaggccggcgtaggggccgcggccgtggcggtcgaactcgatggactccggcccgaacacctctccgacgaactccagcctgccgtgcctgagccggctgccgttgtcccgcggccaccgcgccatcacctcgcggtacggcgccagctcgtgcctcaccggccggtagtccaccccggcgagcgggccgaggtggaacgggtcggtgaggagcagggccagcgccagcgccgcgaagaaaaggtgcggatactgcaggatgccatcgcgccctctctgtggacgctgctgctgctgcttcttctcttccatggagatcaggagcgagggaagacggaatttgcacgcagaggaaagacggaattggtggagacggtgatcttaacttaaattcttaatgcctttgcag

SEQ ID NO: 24024 - DNA, 430 bp, Oryza sativa
gttccccatttgtcgccttcaatctcccctgcacacgtggcacacacgtaccagacgatgtacgactgaaaccaaattaaatggacaaagattatatctggtccaattattcagatacatcgatcctctcgtaacgtgcacacttatcacatacaaaacgatggctgaatctgaattgctggtaaaaagtactaccaagagatcgaataattagggctacttagctcttgatacatcgctttctctggccatggatatcgtatgtatggtctgcaagacttcgctgctgctgctgctgtatgatgaattgatgatgatggatgcatggatggtctcgactggagatgtgatcggaaacctaattctgggcgagcaaagtcttgtgccgtgatggagccatcagaggcggcgagacgatgagatccatttc

SEQ ID NO: 24025 - DNA, 1501 bp, Oryza sativa
aggcgtcggcattttttcataatgcgatttctgggtttgaaacggcccgttgtgtttttggtgccataccgaatactctgcagcctgatgaacagcaatgcaaggaacttggctggaggctccaggaatgacagtcatttcttcccacgctgttgtcaatgacaatagaatgccaactaacagcccagggaacttggcttggggaactaactacgtaacgcaattatcttttgctccaaaactacgaaggactgaacagacaagggtgattcttgttttctgctatggtggtacactggtattgcaattctccttcacaattgtggagtgtccatcagacatcagttactgtaatgcatcatatcttggaattgtaaatgtgcggcagttgaagtgattaccaatgctgtcttttcatgtagcctgtgtaatgtaaagcttactgttgcttcccgagtttggcacaattttaaagatatcttgtctggtgtttcacaaccatttttgttggcgtgctgctgctccttttccaattaaaaatgatcattgtatccttgtattcctgtcatcctgtgtgccacttgatagaaaataacttgccttctgggacttaggttttctatatgagagtagccgcaacagcggcaaagctgtgacgtgatgcgtcgtcttgcttgtggtagcaattgaccccccattcgacgcatcatggcatttttctgtcttcatccggtccgcaccaactacaccaaaaatatgccaaactgatttcaggagaaatccaacttacacaaagattcaatccaagcctagaatttcgcagctgccatgaccagattactattgctacacaaaatgtcaaattgttccatactcctgaatattactgaatattatgggacaattctgtgagaaaaaaagaaacaataaagcatgctagaacctccatactcatactcgtaaaagtaagttgtttaggacagtgacacggtctctaaaacacaattttgacttcttatttatataaaaaaatttattgagaagtgatatatgtatacttttatgaaagtatttttcaagacaaatctatacatataatttttacatttttcaaactcaacaacttgagagttattcatgatttatatttccaagggttgatttaaacattattgtaaacgacttacttactgtggggtagtacttaaaaacgttatgatgcagatactatatcgttttttcggccaaaataaatgggcacatcaggagaatcttgcaaaagacggaggaatctttataaaaccagcggaaagggataaccatacgccgcgagtagagacctggccctcctccccttttctctctctgttccgcgcggcgagataattcggttgcttctccccgcggccgcggcggcatctctcccggcggcggcggagctcacgtccttcgcggcgaactgcgctccaggcagcgggaccagaggggatgggggaccgcg

SEQ ID NO: 24026 - DNA, 549 bp, Oryza sativa
tgcgccatttgcttcggcatctcccagactgacactgtcccctccagcgccagaggctgcagcagaggctgcgccactgctgtgagcgtcctggtcaggcacagagctgctgtcctgtagcgtcgattccagtgccgcctccccatgcacgatgttgccatgcacgttcccatgcatggtattctccatttcctgctcatgtgggggaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaaca

SEQ ID NO: 24027 - DNA, 1501 bp, Oryza sativa
gtaaaaaacaaaaagatgacataataaagaagagataaaaggaagaaggaaagagatgagatggcaggtcgcaacctcgcagggattgattaggatcgaaacttgtgttaaacacgtcaacttcatgcatctgctggaggggagagaggccatcggaggcgggtgaaggcaaagcagtgctactagtacaaagagcgcccgcgtcgctggcagccgctctgcgacgcggccgacgctgtcttcttcctcgtcatcaatcatcttcccccctctctctctctctctctttctctgacttcttctttctcaattcccgccaccccggcacgcccgctctcctctgctcggcgcaagttcttcggctgcctcaaggtgcgtacaccacgcccgagtctctgctctgttttttacttgctatgcatctctgttcgtagcttatcgatgtcgagtcaccatgacacctgttccgtgctcgtgccgttagagttagcaatgggaatatgggatgcgaatggcaattccgttggtagagatcgagaaaggcgagatctttcttgccgcggcgcgcgcaggcagcgcccacagacaagagctagcagagcggcagagaaggccagcacccagatctgcaatgggtggtagccccaccgctcattcctttctccttaatttcgctcccctccttcgttttttttttccctttttctcgtccttctctcgcgtgtcccggtcggagggtgggggcgtgccggcgcggcgcggcgtgggtgctcgatggccgcgaccactccgtcatctctatctcgtctctcctcatcatggatccagccatggagaagaaccccacaaaagtcatacaggagagatagatagagtcgtctcttcgtgctggctcgagatctattattggctagcaggttggtttttcggtgggaagcagagtggttcaatacaagcggacaacgacgcgttcatcggcaaggttaggtggatggatagattaggaggcgggccgccatatctctcctgacgcctgcaatttgccgtcttcctcgttacctacccgatcaagagagatcatcattccctctccatctcccctctttttccgcacggggtttggagagatcagccgatcaggtcgccgatccttatcccaatgccgtctttcagtccgatttctactgtatacgcacgcgtatcgcgttcttgctacctgtactttcagaattctgccgcttctgcagcggctgcagcggcgcagatgccatgacatgggtgctgtcctgggacacatcacacatggcatctgcgtactagacagggcggatgggtcttggagttcaggggcatgtcccgactcccgcactgtggcctccgtgatcacgcgggcattaagcgggttctggattagatcagatcagatcgtctcatcgttcttatgctgcttgctgcatttttcgcagggtgaggaggagctgagttagcagggctgcgacca

SEQ ID NO: 24028 - DNA, 1501 bp, Oryza sativa
tgtgtgggcagcacgtcggtcattacgccggcgctcgatgctggtgcgggcgtccggccccccacgcagatcttcccgggtcgaaggagtcgacgtaggagtggcggccgaatggcgaacagcggctgccgctcgtcgtgcccttcgtcttgacgacgcggagccggtggtagcagcaccagaggccttggtggcggaggaccgcccaccagcatctaggcgctgccttgcagtcatgaccaatttggccacatcgtccagccaacgttgggctggagactccgggtcatgggcgacgggcgggtgacgtaggagcgcgcctgcagcttggagcgcgccctggggcgtgctgccgtcgcggtagacgaggagacgacgctccccatctcgccgcccttcttcacctcctgtggatgtcgaagtcgcggatccttcagccctctcgagcgccttttcccgcctaggactttggcgtggagggggcggtggagtacgagctcgacggcgtgggtttggctccccgtcgtcaccgctcatactcggggagaggtcgcgcgcctttgctggctcggccattgggctgaacaggaaaagcttggcgcacacgaaggagtgcgagagctcagaagatcactcgcagagtcccctacctggcgcgccagatgacggagcgtggggctcctcaccgggagaccgcgcaggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctggaaaagtcccccccaaaaaatcatcccttctaagtgggcaaggtcctccttttatatcttaaggggataccacatgcaccatttttccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgaccggtgtcagactggtcacaaatcggtcattcttgtccaccacgcgtcagctcagcaatctgcacgttggcccttcttcacacaacatcttgcctgtaatggttagggtgaagcctggcatatatctgaccaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacacgctcagccaa

SEQ ID NO: 24029 - DNA, 166 bp, Oryza sativa
atttttttgaagtttgatagaattcagagataaatataatgatatttttaacacaaaatgaatattctattaaaatatatttaatgatatatttaattaaattattttggtatcatatatgttgctattttttttataaatttgatcaaacaaaaaaacataaagg

SEQ ID NO: 24030 - DNA, 260 bp, Oryza sativa
tcatgccgtacttcgcacacggtgctttaaaaagttttaaatcgagtactcatgtctttcgagagagatgctaatcagtaacctttagaccatgattactgaatcccatccatgcaagaaggggtttgcagaccatgattagacccataccaacgtgattcgttttggataagtctccctaaacattagtgctaatcaccaattcaccgtcgtcgtgaatcgtgtgatcaccaaaagcacatgtgatttgattttggtca

SEQ ID NO: 24031 - DNA, 1336 bp, Oryza sativa
gacggtattcacaatgctcccgggagaccaactaccatggccacgaggagcaaacgacctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcggccgcgcgcgcggccacgtacacggcgcagcgtggcgcggcagaggcgcacctcttcccgcgatgccgtggatattccccggcaccgaccctataacttggaaggcgtattcctttaaaaaaaaaaaaaattggaaggcgtggcgggcgacgctaccacaggtgtggaaaaaatctcttctacctaccggcacgcgcgaaacgagcagtttctatcagcacgtgatgcatcaaactcgttctatggcggcaagcatacacacagcgataaattccagatgtacacgcgcgtataatatactagcgcttgttaatatattttattataacgtcgtttgattttaaacatacatgaatgcaaaatctacaatagcaaatacatatttttgtaaataagatgaatgataaatatatttctaaaagtcaatgactccagacatattaaaaactgaaatgagtaccactgccatcgtacattcgtagtacaagataagagtggtatgaagtaaaaaaataattgtggtcaaaatattgtactatgcaatttgaatactgcatcaccgtagttttacaagaaatgtatcactggcacttcttggagtgggtcgacaacgacagtatagaaaatacagtgtctcgacgggcatcgtgtcgttttattcgcgggcgccgacttcatacacaaaggagaaaactaaagaggggatcccaaataatattcccaaaccctaaagccctcctccccttcccgtggcgattcgccggtccgtcccccaagtctagggtttatgttcgctttctccccacgcattcctcccacccgcggcgctccctgatctggtcaagcccaccagaatccgct

SEQ ID NO: 24032 - DNA, 575 bp, Oryza sativa
atttaccataacgaaaacaggcatataacataccgaggaaatgactatggtaaaaacaagttatcccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaagagcacaatgggccacgctgttaaaagtactgggctgaggtactgttcaggcctaaacccattcgtacctccgatacccttaacaagaaatcccgagatccaagcgacacttcatcttccccgccggaactctcgccattttccccactccctgctacagtacagagctgcgccggcaaactacggttcaccattccactcgaatccaccttcgaaaagttcatcaaaatccttcccgtgatccaccgcctcaatccttcacctctccctagccatccctcgaatcagatcagcgcattcgaaaaaaaaatcaa

SEQ ID NO: 24033 - DNA, 1501 bp, Oryza sativa
gttacaacttacaatttacaagcatgtcagtaaggtttataagcatctttagccacgtctgcagctagcatctgatcttaagtcctaactaggctgttaagatcctggattgtgattagatagttgtgacgagtgatgcatgataatttcggacaggcaaaatcacgtagcaatgtgctgctgaaataagtttgtggtgatcaatctgtgacactttagaagcactgcacacttttaatgctggctagtactattcagtaagacctgaactgtaggtgttccatttttttttcctatgggttggtattgtaaggtactgcctccgtttcaggttataagactttctagcattgcccacatttatatagatgttaatgaatctaggcacacatatgtgactagattcattaacatatatacgaatgtgggcaatgctagaaagttttataatatgaaacggaggaagtagttgtttcaaaatttcatagatagatgtgatgtgcagtttgtgtggaagaaatactactgatctttcactgtgcgtgttccattgttttgtcttcccacttgtgtggggtttaattttataaattagagctgagaactaacctttgccaatccctttgtaagcttgtatggattgtgaacgaaccaaatgaaacttcagtcgcattcctattgtaaccactaatcgcctcttgttgtttctaacagattatctgaaaaggaggtgacaaggcaatgtggctgcacaggtggtatgcttaacccttgtttttgaggcattctggatgtgctgatttttcataagttttgtattgtacacagcagtaacagtggaagtattgatgcaatgtagagactttaggttatgcatggttgcatgccaattaatttgcatgatggtgtatgcagacagagacatgatggttgatgtatgcagaatctattcaagtactaatgtggatttttcattgatgccttcataaatcatactacctccgtttcaaaatataaggaattttggacggatgagacatttcctaaaactataaatctggacataaatcataatgttatttggttttcctggctggatgttgtttgcataacctagccgtggcacatgctttgagctgtgccttagacagaatgatctgttgaccgtaaagcataataccaatacagcaggagaagaatgattgttttcttaagcttgagatagttatgccatagaacaattttctgttttcttaaagctttataatttttctgtgcatttggtttgatggagtgtgaatgtgtgatagcacgaaagccctatttcacccaaacgcccgagcaaagatagcacgcgggttcggaacttgaatgacaaacatggatgctgaaattgccctctgaactctgaaccagaaaaacaaaaacttggacaattctttgaaatcagacaaggatttgagtcttgtgaaggcaacagtgattctttatgttgggccaa

SEQ ID NO: 24034 - DNA, 1501 bp, Oryza sativa
aataaatgtctattgagtaagtggttatataagttaattaatgaggatggtgtttggcaagatttattgaagaggaagtatcttcataataaatctataacccaagtggataggaaacaaggtgattcttatttttggtcagggcttatgaaggtaaaaaacatcttcttaagtatgggctcttggattgtgaatgatggttaacagataagattctgggatgataaatggctaggtaatatagccttcaaagataagtatccatctttatatgctattgtcagaaggaagagtgcctctattgctagtgttatgggttctgttccgctaaatgtttcttttaggagagctttagttgggcagaatctaacactttggtataatttgtgtgcttccattgctcatatccagttggatgattctactgattgttttagatggaattatcatcaaaatggccatttttcggtaaagtcaatgtacttagcctcaattagcaatggttacattgatagaaataagttcatttggaagcttaagatgccgcttaagatcaagatctttatgtggtatttgctcaagggagtcgtcttaagaaaggataatcttgcacgacggaattggaatgggggtttaacatgttgtttttgcatgaaaaatgagacgatccaacacttgtttatggattgtcattatgcaaagtttatttggagagctgttcaattttcttttggattacatcttcctagaagcatgcctcatatgtttaatggttggcttcagggtgtggacaaggacaagagaaagttgatacttgttggtgcctctgctttatgttgggccctgtggttatgtagaaatgatagggtttttgacaaatcaccatctgtttcctatatgcaggtaattttcagggcaacatattggcttcggctgtgggctcaactataaaagtgtgaggaagatggagttttcctaaatgttgcatgtcgtactcttgagtcaacggttatacaactttttgccaaccatggatggagattttctaataggctggaataatgttttccttgtcatgttaggtctttcttttaattttggttggtttgatagttttatcttgaattaagactttataagtgtgttactttttataataattggttgtagctcttcggagtaaaggccgggatgtttcattccattatctaaaaacccaatgcaacgcatgggcattttgctagtctcgaaaaaaatagaagtggttataagagcatcatcaacattatctctatattttgtacccaaattattttctatgagaaccctaaacaagatttaagatataaaaatgttgataccttcaagagattggttaaaattgaggataatttgcctttgtatgaacttggtagatggcgactgcaagtcgatataactggattttaggcacatcgacaacggcctcggcgttggtggcaagttgtctgtcgattacctc

SEQ ID NO: 24035 - DNA, 1501 bp, Oryza sativa
gtcatggtttctctctacccaaaaaaagttgcatcaatggtgcttagtgaagagataggttaaaaatatatgatcataatatcacagaattcacaaatatggcaccttttgtatttttggcatcgtctgcaagagcaagggcaagtgcatggtccatttcttcattgttatgtctaggtggttcttccttctagaaacataacaaagaaaggttcagaaactcttttccccatgatagtgctacatcattaccataatctaactgataaaggaaggggaatttggatagtggcactccatgaaccaaagaaaagaacagaaaaatgtcaggttgcggaggaattgagaaacattacctttggtctaactggttcttcccagagcgtggtctcttctcctgccgtcacccgagggcgccgtcggttggcctcgccgtccttcgtccccttcaggaaagcgcagagccacttcatgaagccggatctcctctctgcgttgcagaaatgttagaaccggacaggttcagggcttcaggcactatgcaaagaaggatctcagacatggctagaactgaaatgtggagagcaacatcccacctaacacttcctgcccgctgaaagcaggcaaagaaaaattgatgtatttaaacactttggttgtcttatatgctcggttggatgctaattgtaagtggattaggtgatgggttatcaacaacataatttcgctagccctttgctttgatcagatagtcacagttgcacagttaaaaaaaaatcagtcatcatgtcatgtacagctaaactaaatttttaagtttttgtttgtatgaggctgttaattggactgtcatagaaaaagaaaggcagatgcgtgtacctgcattgaacaagatcaagaaacacagggacaaaacgccacacgaaattgcttgcgttgctaacatggcccctctctacaccgtgctaatcacagcgttatcttcttttcctttttcaattctacctccgattgacggggcacgcaggcgcagtcagggtcagtcaaatcttggtggccctcaaatttatcctggattataagaatcagtttgagtctcccatttatgctatgtttggataataggaaataaaggatgggattgggattagaaaatgaatcaatggctaggatgaaataaggtggaggaaatgaatggctaggattcaaagttaccccttcataagtgggaaattatttccctttcctattatctaaacggtgccttaatttccctcctctgaatagcacagtggtatgatttatgcatgacagttagaaatgttcatctgatgtgattgcacggcgatcgatgttaggatcaaacagctaaaggtcgattcgaagctagaccaataatatggacctgtaccatcaccatttgcgccacgctcacgccatgaatgtttagatggggctaaaattttctagtccatgtcacattgaatgtttagatgctaat

SEQ ID NO: 24036 - DNA, 1501 bp, Oryza sativa
cctacacatcatttgattcctcatctcatctaatctctggtatgcaattatgattatcggactatttttgttaagtatagatactattcttaataacatattatatggaaataatattaaaaaataaacatatttttaattgttatttagagaaaagtgcacggtgactattttgtgtagacttgacccagagtgtaggatttgattaacctattattggttgcaagaataagattgaaagagtattctagattatatgcatgttgttacatgaataatccaattattttagataaagcaagtattggtaagattgccatcatcgaggttaagtcattatatgaagatgttctaattttctaattatgttagttacaacgatccatacaaatatattgatatggttatgcatgaaaagtgtatattgtaattggattttttttttacccgttgcaacgcacgggcatttttgctagtataagattaaaaaaataagaaaagcttcctgttaatcttttcgtccgtcattaaagagtgggccacacaatattttgtcgctaatccacaatccgaaagcgtggccacgatctcttacgcccgcaaataaaggagaaaaaaaaaagagaaagccttgtttgttgagcagcccatctaaagcagtccgtattggattagtgacgagtcagcccatccaaagcaacagcaggccggcccagagagcagccgcagcccacagagcggaggagcagcagcagcccagcacagtactgcgcaacactgtagcaacggaacaggaataaagtttggactcacgccaaccaggaatcggataaaaaaaagcaattttataaatgtaaacatgtagtcaccaacaaaatgaattatttaccgataaaataaattattttttaaaatataaaaaataatcacatgtgtctttcttttttaaaaagaaaacaaataatcaccaacaaaatgaatcgtgttaacatctggattttttccctcatcaattgctcattcgtcataggacacctaatcacatcacttttttttccttcatggtataatttcttttattatttagagtgaaagttattctgcgatataccacatttttttctttccttctgattatttgagtgagcgattatgcaattggagtgcagtgaggttgatctgatagctagcaaaaaaatatttcttggattatggctactctttacagtatgaaaaaaattgtttatcaatatcgagtgccaaaaaataacaaagtactgcaattgactcataataatacatgacaaaaaaagtaaatattttttgtggtttcaaacttcagtatccatgtcagtggatttagagcagcaaataattatatcatgttagcgtcttatttgcactggaaagattcgattcgactataaagacctcaattaacctggtggttttatgcttccacacactaattattattttcttcttgattctatcaattttt

SEQ ID NO: 24037 - DNA, 1501 bp, Oryza sativa
ggtcattcttgactatggcgcgtcagcttagcacgccgcacgtctgcctcactgtattaaatgcgacagggggcagttggggcgttgcgctcattaaaggaggctcagcctgggccccctcctcgctcgctccccccgccaaatggcggctgggcgagggcctcggggcaaagcggtgcaagggcccgaggggcatgacgtggcaccccgaggcctcgaccccccggccgctcctgcggttcgcggactgcgggggcaggactaggctgtagggacacatagcaggatagaaaggtagattccccacacttcgcatacccccggacccatatatctgacaatgtagttttagccaactgaaaaactatgaccctgttcttttcttcgactaaagttgaataaaattatataaatttccatgcccctgaaatgcagcggaaacccttctttcttctacatatccacatgcattttcccttgtcagtgagaataacacctcaaatcagagctgggcaccttcaaagtgcgagaactctggttggctgctattgcaaaaaaaagagatctggatggccgataagctgcaaattagacaatggctcaacaatcacttctgtcaattctactattggaacttgaaaagtatgcaacaccgctgtaaagactgtaatgtcgtgcggcaaatgtgggaatgaactttacaaggagtaagacatgacatcgcaaacacgcatggcaaagatgatacattggtgaattggtggattaggcgaacatcacaaggagaaaagcataaaacgtagatcatgaaattaattcatatgctagtgatttgagggatatgatgtgagcggaacaaaagagtaccacgcctattgagcaagaccatcgacgaaatcagggtgtatagcatgtgtgtctataaagatgtcacaagaatatccattagataaaaactgctcgacgtgtatttttctctctttgttcctgtgttgttgggtccatccttctttcaacaacgctaatttctgaacggataaatgcatttttcgttgttttctacggtaaaaccacaggcgggtataggatttgtgcaaagaaaagatcagaggtggatcatgacataataaggaggtgctagtatacctgcatattacgtggtggccgttggcgcttccgccaaattggagaccgaggaccccacaccgcgccaccacctcaaaaagagaatttcttttcgagaagtaaaacgaaataataaaataaagaaaaggaaaggaaaatacacgtagtacaaacgagccagcggcgagggcgaggcgagtttatctagccagcggcggcccaccgcccaatctctctctctctctcctcctcggccgcgtaaaacacctcccaccgcctcctccaccccctcctcctccccccgcagagccgaaaccctaactccgccgatctctccaggtgcccaaggggagggaggggatggcggcggcaccgg

SEQ ID NO: 24038 - DNA, 217 bp, Oryza sativa
aaaaacggaggtagtatattttttcttaaaaaagtagtgcactttcatatggttctaactggaattctgggtcatgcttaatatgttgatctttaaagctttttttaaatatctcctgcaattgtaaatgtttgtaacctaaaactgtactgtatgcttcagaatgcttgttcctgtttgttttgattctaattattccactttcagtgaacttaat

SEQ ID NO: 24039 - DNA, 1501 bp, Oryza sativa
tatcttagtaattagtatcatataaaaatgttttggggtctgtggattttgtgcagaattctttcttctgtaatcaaatgatatgcagccctcctacatactcgggaaaaaaagagtgttttctaaaacattttgattcaaaactttggttccttgaaacaaactgtaaaacctaagactttgtgttataaatgcccccaaacctggatttttgtgacatgtactcaaatttaatgctattgataacaacaacaaccacagccatagctatatcagaaaggcccatgtgctctagtagtaacacattttttttttttgaacaactcgcacaagacggtgcgaagttctattgatagagcaggaaaaaattacaagattacaaccctggagggtcgtaaccaggaaaaggaaaaaaatataccaccacccacataccgacagcgccaacacacaacccgggagaaggctagcaccagaccggccgccgctaagcgtgaccgactgccgctataccgacaaaggaacacagaaaagatcgccctctaagggatgccaaaacgacgtcttcaagaagagaagcgacggaaaaaaaccgccgccaccgtccgtcggggctcaaaggagccgagactaggctttcgcccggcaaccacccttgaggggtgaggcagcacgacaacgccctcaggagggggaatgaaccatcattgtcggcctggccaaggccggactaggttttcacccgccgctcaccacctgcgaatccttggctgacgcaccgatgctccaccacctctctagctctgccgacatgcgggacccctgcatcggcgtcctccgccggccagtcttcgtgcgccgaagaccgcgccacacccaccgacagctcctcctctccgccgctcgcgcctctcgcgccgagccggcccgatgtagccatctgccacgccctcagctagccgtccgaggccaccatgcctccggcgaccatggtcaccgccaccgctgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacacagcagccccccggaggtgcgcca

SEQ ID NO: 24040 - DNA, 475 bp, Oryza sativa
ccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaa

SEQ ID NO: 24041 - DNA, 1501 bp, Oryza sativa
atagcaactgaaggccttgcttgctcaacatatgaccatccattactcatcttatgattcgtagcagatggaggattagattgctcaacagctgacactccattgtccaattcatcatcctcggattcactctcaataagccatccatagcatgggcgccttgttgaggcagtatgtctagctgcagtgatagggagtggcactgaagttgtagaatcgggcatctcatcggccactgctgctacaactttggctggctcagatgcagcagctggcacttcagcttgtgaggtttgcacgccattctctggaagcggctccattgcagtagttcctccttcatgctgcttaaacaagggaagcccaatggaaaattatgacttgtttggcaaccaactgaactaaacatgttatgataggaaataacttacaatatcatgagattagagagtagaaacaacatgagaggtctaaaaggaaagaatacatcaaggaggtttgaaggctaacgtgcactgatctatgtcctattaactaaaaatgttggatacactaacaatcctattaaccaaaaatgttagataaacaaacaatccggttaactaaaaatgttagatacaccaataattttgataactaaaaatgtaaggtacaccaggttataggaagaaaagcacaacaatatgaactggaattctatagaagtagcacttgatattattggcaatgaagctgacggtcaaaaaggtaaaaaaaaaaaaaggggggaatggtgtcagctttgccgtcaactctcacaaacaatcacccacaaaattgagacaataatgggcacagatgttttagcgttgtgtgaaatgtttcagcattttctgattcttgatctcttatgtggagattatgggtgccatatacccacacggctgggttaaccgactggatatatgggagagattatgtttatggaatatgtaacacatcatgacttgggtattatgtttccttgtatataaaggaacggtctaaagtcctggttcagtaatattgtacagtagattaagtaaaccgatgccatatttggctatgtaacctccccccaccctccccaaacctatataaggtgggcagggagcccctcaagggcataaccactattagatcgtcagaataatacacactcgacggatacaatccccaaacaggagtagggtattacttatcatcgagagagcatgaaactttctaaatccttgtctccgcatccatccacttttaggtctcatgcactaccccttttattattgccgattttcagattcgatagttggcgcgccaggtaggggtcgcgtcgagagttttccgtcaacgagtgtgatcggggtagctagcagatcttgcattccaagggctatcaacacctaccaaggacaaattcttttgccacgagttcaacagcctagctcatttgatgcaaacagtatcagctcatgaaagttgattg

SEQ ID NO: 24042 - DNA, 1501 bp, Oryza sativa
cagtttcgaaggaacccaaagcatcatgaaatttgcgacttatgaaaattagttgcatccaacatatagcaaaaatacatatcaaacacattttttccttggttgcaactattaaagatggctatttcctttctgataatagttcatagactgatagacatatctaccaatccgtctctgttagttaggcaacataggctgcgttctttccacaagtttcccaacccctttccctcgttttccgcatgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctatatagtagtgtttgcactccttttttaataaaattttaacatttaatctgaaaagaaaaggtcaagaggtactaagctaagaataaaagcagtttatgagattagtaccaacaaaatcccagtggaaagcaactgggaactttaattttgggattgggtcagcaggaatctctgtgattatgatctagtaatacaagcaactactactcattatgagcaatcttgagctaagtactagttctgtatgaccagtagaattggcatctcaaatactgtcacgccccgaactagtcccgaccgaaactagcccgtgacgctccaaattaacctgttaatcgataccagtcccaggaaatagtgctggtatcacaagaagacagaatatcacagcaacagaggtctctttattatagagtaggagtacagtcatattgggctacggacagattccgagctcacaactgcattacaaaaggggaacggaagccaagacttggaccaaacatcacaggcgagacttgggaactaggccgaaaccctaaaactcatcgtagccggcttgctcctggaagaactcctcgtcagcgggatccgcttcatcttcttcagcaattggggggattatttatatagagcaagggtgagtacgggagtactcagcaagccatgggaaataagtgtttaatgcaggcttcaaagaaaggctgttgtttttgcaattgattttatttaaactcttttctgaaacaactaagtgagtgcttctcaaacgacacgaatgagacagtgcgtctcgtccggtcggagtatgtgcaatgtatcagtcttttgaatcgatcaaggttggcacccggccaacaactttcaaatggccacccgggcctggctgatcccatcagccgcagattttccaaacatcagtcccaaaccacatccgcaaatttcacaaagcagtagtcaaacaaaactacgctaggaatcacctcacatccgcccatgaccgtgggcacggctgttcgaacagtttaataacctctgtagaggaggtacactttacccaca

SEQ ID NO: 24043 - DNA, 1278 bp, Oryza sativa
gccccccccccccccgggtagccaagtgtggtgaaacggggggcaaacctaatcagagtaggggctttcctctcccccctcccccacccttttagagtttgatgtgttactactaaaagaacccccccccccccccgcgacgtcggcgtgacgaggcgtcggcgacggcgcggcgtcggcagcagaggcggcggcgacggcgacgactcgcacggcatccggcggcggccaccacgacggcgagatgcgcgcgggcggcggtgctcgcgccgccgggggcgagcgacggctgcagcaccgccggccctggtggtagcggtccgagcgacggcggcgacggcggagcgaggcttgcggaaggcggcgaccggcagcgcggctggtgatgggcaacggcggcggtgccaatggcaaccgcggctgcggcctgaggcaccagcggcaacgccgtcggtgtggaggcagaggcctcggagctcgtcacagcggcggcgtcagtggctgctgtggcacggtgggaggaggcgcggtggtgcgtttggcagcagtggctgcggttgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttctgatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctg

SEQ ID NO: 24044 - DNA, 1501 bp, Oryza sativa
aaaagaagggagttccttcctcaattccctatctccatcctaccaaaattctcatgtctcccaaccaaacaaaactcttaatagcctcatccctctaaactcccaatccctcctaaaaactccctccaaccaaacaggccgttaggttcattcagtactagggcttgagcagcttacagatcggcgggtggatcaggatgacctgccgatagtatgcagacagatggccctagcggcgtggacgacaacggccacgacggcgtggatggaggtgccggtctggacagagacgaatggaacggagaaagcccgataccggcagggtggcggcatctgatgcgagctaggagaggggactgagcgacggcagcagggcacggcgaggagaggagggaggaggaagaaattggcgcgagcaaagaaatctacgtgtgatcgctgcgattgggaacgcccagggctgccccaaatctgactcggttttgggactggattgggcgtgggggatttttgggagcaagtttgggcagctgttggagctttcctttgaactaaaatcctaaaatttaatttttgggacctgtttaggcatctgttggagatgctctaagtatagtgctaattcgaatttagggggaatatttattttcaaggaacattccatctcacttacatccaaatcaaacaccctaaaaaataggtttatcccgacccaaccgattccaatcatttaaccaaacccatgcttatgcgatgaagcgagaatttgaggttgctggtatggttaaaaacctagagttctttattatatatgtttacttttgaaactacgaatatttagagcacagacaattttagtgtaaacagttccctaccctagaaaagagggtaaagctgtaaaagtgatgttgtttcagcaattctaattggagtttctaattgagaaattttttaaaaattgccatcataaaaataagcgagtagtaaagtatcataatatgtgaagtctaaacagatgtatcaatgacacataagataatatttttcaacatgtgtttttaactcgtgattttgcaatgttatagttttgtcggctgaagtttttcctaatttcagtgaccggtagtatataagttttcggtagcaaaaaagttataggaagcgagatggagagaattcttttcgaaattgtattcgcgaaatagcaatgaccacaacacgcgacgtgtcctgagtccgggactcggtgaatctcctgtcctgtgtgctgttgcgtttggtaaagaagggaaggacgacccagaagttcctgccgggggtagcggcgcggcggccgtcgggcggcggcgagaagaaagaggaggaatcttgggccgctgtaatctttccttcgaacccgaaccctccttctcctccctgcaccatctccgcatggaatcggggcccaaatcggaagcaaaacaagacgaggagggatcgagtgcgatgggcggcggcggcg

SEQ ID NO: 24045 - DNA, 1501 bp, Oryza sativa
cgtgcgggctttgctcgaagcccatccccttgagcgtggaatccaacttggcattccacgtcctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggtgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatctccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgca

SEQ ID NO: 24046 - DNA, 169 bp, Oryza sativa
atttttcacgctattattgcagcaaactgaaacatgccgctaatgttgcagcaaactgatagttttctcattaaagttgcagttttgtcattttgaactatagagggactggaaatggacttctttcccttcccgcaacttgatcgcttgggcccatgacttctaaagg

SEQ ID NO: 24047 - DNA, 241 bp, Oryza sativa
aatgtgacatattctaaaacaatgaatctggacagatgtatatccaattcgtagtatgtgtcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttagg

SEQ ID NO: 24048 - DNA, 359 bp, Oryza sativa
tatctagccatggttgacctgcataatcttcaatcaatcaaagcaagttaatccaaaggcaaaatccagcacttgatcataacagcttctctgagtgattttctgcagtaaagatgatatctttttttttgttttctgaatgttcctgctctgcttcttttttttctttctgaatgttgacctgtaaaatctgcaatcaagcaagctagttaatccaagaataaaatccagcagtgatcataacagcttttttctgaatgatttttgtactactaaaagatgatctcttttttctttttcttttttgtctgaatgttcctgctctgcttccctgcctttttccctgctccctcttcaga

SEQ ID NO: 24049 - DNA, 265 bp, Oryza sativa
cgccaaccaccacccgcggtcctctcgggtggggcccacttgtcagcttcagcgagctatccttcaacccgtggaaatgggccacagatgctggggcactttctgcggcccagaaggaacgagcccatgaacgattggagattacggcccggcccgtggagcgccttcttcttcccagcctggaataagtctatttatctccctcgtgtcttatctttgatcgaaacgcatccctccaccgcaaaaccgggtgacagccaacatt

SEQ ID NO: 24050 - DNA, 1501 bp, Oryza sativa
tcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagat

SEQ ID NO: 24051 - DNA, 1501 bp, Oryza sativa
tcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagcggtggcggtgaccatggtcgccggaggcatggtggcctcggacggctagctgagggcgtggcagatggctacatcgggccggctcggcgcgagaggcgcgagcggcggagaggaggagctgtcggtgggtgtggcgcggtcttcggcgcacgaagactggccggcggaggacgccgatgcaggggtcccgcatgtcggcagagctagagaggtggtggagcatcggtgcgtcagccaaggattcgcaggtggtgagcggcgggtgaaaacctagtccggccttggccaggccgacaatgatggttcattccccctc

SEQ ID NO: 24052 - DNA, 1501 bp, Oryza sativa
ttttttaatttcacaaagttgcaatggcatggatccaattaacccaaaaacaaatagcggttttttaaaaagtacaaatagcgctcggtgacactaatttgaatgcgggagtactgattgcaagaaccaccgtaataaagtgactaaaagtaaatatagttattctactttatatcatgtcctacttgcattaaacctagcaatatgttttgtagtttaattggatacgccatatgcggcttcatcttttctcttatgcttatgcttatcagctaaaatttgaattttcaaccttaaatttgaagctagttttagagttttttattgaagtttatttttcagcatttacttttaggtcgctaagaacacgtatataaatgctttattcacaaattacttattgtttgtaaatgtgtcgtttggcttattccaagaataagccaaccaatgggggtgcgatttggatggagatagcatttcataactcgataattactctgacaaatagaacagctaaagcaaaatcaatcaaccattctttttattattattattttcctatgttgaggttcacacatagaatttttcatttgtaaaaggacacaccatttaacagttcggaaagcgtgcgcacataaaacaaagatttgaagttgggaaagggaagaaccaaacacacccttaggccccgtttagttccaaaaatatcaaatcgaatatttggacacatgtatggagcattaaatgtagattaaaagaaaaactaattacacagttaggggggaaatcgtgagatgaatcttttgagtctaattagtccatgattagccataagtgctacagtaacccacatgtgctaatggtggattaattagactcaaaagattcgtctcgcgatttccaagcgagttatgaaattagttttttcattcatgtccgaaaacccctttcgacatccggtcaaacgtccgacgtgacacccaaaaaatttcattccgcgaactaaacatgccctaatatttgtaacatagatgaacaatacaattgtaagacacataaggattgtaactcttatattttcattaaaatctctgttgggggtgtccattttatagaaattttacaggggagtataggattgaattatttgtttaaaaaaaactcgttagaattatcattataattaaaatgctctaattttctataggaccaaaagaggtctaggctgtgtgtttagttctacactaaaattagaagtttggttaaaactgaaagtttaaagaaaaaaaattaaaagtttatatttgtaaaaatttttgatgtaatgaaaaaattggaagtttgaagaaaaagttggaaagtaaaccaaaccctgaagggaaacttttatttactgcaaaccgaaagaaaaaccaatggctccaagaagcgccatgtgtgaaggcgtgaagaggaaggcggagttcgtgcgcgcaaccgattcatcaaccagatttgagaa

SEQ ID NO: 24053 - DNA, 367 bp, Oryza sativa
  unsure (1)..(367): unsure at all n locations
aggccgccccngtttgacatcgattgannatcctagctcggtaccccggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatca

SEQ ID NO: 24054 - DNA, 1501 bp, Oryza sativa
acttattcctacagcggtggcggtgaccatggtcgccggaggcatggtggcctcggacggctagctgagggcgtggcagatggctacatcgggccggctcggcgcgagaggcgcgagcggcggagaggaggagctgtcggtgggtgtggcgcggtcttcggcgcacgaagactggccggcggaggacgccgatgcaggggtcccgcatgtcggcagagctagagaggtggtggagcatcggtgcgtcagccaaggattcgcaggtggtgagcggcgggtgaaaacctagtccggccttggccaggccgacaatgatggttcattccccctcctgagggcgttgtcgtgctgcctcacccctcaagggtggttgccgggcgaaagcctagtctcggctcctttgagccccgacggacggtggcggcggtttttttccgtcgcttctcttcttgaagacgtcgttttggcatcccttagagggcgatcttttctgtgttcctttgtcggtatagcggcagtcggtcacgcttagcggcggccggtctggtgctagccttctcccgggttgtgtgttggcgctgtcggtatgtgggtggtggtatatttttttccttttcctggttacgaccctccagggttgtaatcttgtaattttttcctgctctatcaatagaacttcgcaccgtcttgtgcgagttgttcaaaaaaaaaaaatgtgttactactagagcacatgggcctttctgatatagctatggctgtggttgttgttgttatcaatagcattaaatttgagtacatgtcacaaaaatccaggtttgggggcatttataacacaaagtcttaggttttacagtttgtttcaaggaaccaaagttttgaatcaaaatgttttagaaaacactctttttttcccgagtatgtaggagggctgcatatcatttgattacagaagaaagaattctgcacaaaatccacagaccccaaaacatttttatatgatactaattactaagatataatgaaaatattgcaccttttagtacataattacattggtagacccgcaatcaacattctcatcacatattttctccttcctcgttttcatactccctcctttccaaaatgtaagatgttttatttttgtcctaagtcaaaacttctttgattataagttcataagtttattttagaacttgtgagcatattatctatagcaacttccttttgtgttctaattctgtaagactgctctgaatacctggtctacatcaggatatagactgtgcatgtttaacattatttcttctcattatttatagttcaaaacatagtccgggagtaaatttatatagcagtgtggtgattgctgcacatgcgctgtctgaaccaagtgctacttgcattcacagctgttaactatcccgtgtctagagtttatctgtatttgccaatttcaccaagaacaatggcaagagagcttaccttacatctgagg

SEQ ID NO: 24055 - DNA, 1501 bp, Oryza sativa
tgatttatgtatcaaaagattacggtagcatctaagggtgagtttgagagataggggattgagaagattgggaagatacgcaaaacgagatgagccattagcgcatgattaattgagtataaactattttaaatttcaaaaatggattaatatgattttttaaagcaactttcctatagaaaatttttgcaaaaaacgcatcatttagtagtttgggaagcgtgcgcgcggaaaacaaggtgttttctcaccctatctcacacaaacgaacacagcctaaatatactttcctcagagctattgcagttactttcgtaaatgtaaattcaaagctctagagatagctcagctgcacaggctgtctcaaacaactgtgaatatttatccatgaacaaagcataattgcaggttacctgcatcttgtacctcctcccttgaggtcaatggaatccccttgttctttgccattcctttcacctacgaggagacacaccagggtttccttgagaatccagagaaattcccaatgcgcaattgaacaggacaagacgtaccaacgcccgaaacatgcaccggccatcacccgtgaccctctggaccccgtagtgctccaccttgttcagcgcccccgaccacccgcccctcctgcaatcccccggacgaatcacacacaaccctaccgcgacacaaagatcagcagaggaggagaaagggaaaccagccgtacgtacagggaggtagcaaccctagaaaagcagctgaggccgggccaaactggagcaggagcgggcgaggccgcggccgcggccgcggagtcctcgaggagctcgaacctcgcctcgccgtcacggagccgcgcgagaagggtggctgcaacatccagcacaaaatcaaagccatgcgcgcgaactaggataagccataccatcgagtagagaaaggcgagcgaccgacgcgccgaccattgcacggccgcaccgcttgcgccatcggagcgcaatctgcagccaccaccagcagatgagcagagaagcggagaggaagaattctgcaagagtgggcggtgtttgccgtcttgtgcagatatgcggccgaggagaggaaacggacgggggcccagttatcaacggggactttgttgttgggccttcggccgcatacgcgacgttccgggcctgcaaacgaacacccgagtacgcgcgccgccgcgagatgcaccgcgcgcgcggtcaaattccgtcctcctggcatctcacgcgcacgtccacctctcgctaagccaatcgacccacccaccaacctctacacctccctgcagatatttatcctcagaagtcacaaaaatatctcgtccatatccacccgcggcgcggaccacgcagccatcacgccaatatagcccgagcacccgcaccacagtcccctcgtcgtccttggactgcttgaagcttacacgagcgctagctaacgaaggcacagcgcgcttcgcgcgaaagatcgg

SEQ ID NO: 24056 - DNA, 776 bp, Oryza sativa
gatgttgagcctgccaacggaagtcaaatggttcaaaaaagggcttcaagtgatttaaaagttaccctagaattattttccatcacaatgtttttatccccttcaaaagtaaagtgttccttttaacatgagaaagttttaaggaatttccatcaccctcttgagaccaaccttcaaaaattttaagttaaaataatagtttccaaaggatttggttttggaataaggattaaaaattggaccatataattgcctatatttagatgttatatcaggggcctggtttttattttgtccgggccaccaaacctcaggaacggccttgccttctattaaggaattcgtttcattttttgttccactaaaaatgtttcatcgagtggacttatatggtttcactatgtatggatcaaatgttgcagtgacctgaaccattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagg

SEQ ID NO: 24057 - DNA, 437 bp, Oryza sativa
agcaattccgataaaattttacctataaattacttcctccgtttcacagtataacatttttttaccattgtccatattcatttagatgttaataaatctagaatatgtatgtgtttatatttattaacatctatatttatttagataatgttagaaagttttacattgtgaacggatggtgtattttttattcctaaaaaactaaaatccgggtaaccaacgaggatatctgtagttctgtactgtacccgactcaaccactgtgcgctccgtccagtccccggctccgtggaccgtgcactagtacaaagcctaggatttccgccagccacgtctccaacatcctctcctctgttcgttccccgccgcgaacggaatccgaatccccaatggccgaccgcgcgccgcctccgcctccgccgcccgccgggatcgac

SEQ ID NO: 24058 - DNA, 1501 bp, Oryza sativa
tcgatggtgagacgctgaattgtgggcccatcacagcaggcgagtagcattggcacggcagtggcctgtggccagctctagcttagcttagcaaacggacaaggtatcaatgcatcatttactccaatgacacctgtgttacacctacggctcgttttagcaactcttgcttttaagcgtgatttgggtcaggaacgtacgatctgctggtgggcatcaccattcgtccactggatcataacttggcaagcatagcgtgacgttttttttaatatgttgcaaccaatttaaaaatgtaacctttttccccaatactttagcaaagagaataatagatataataggaatgtaggattcaacaaaagaattaccccattcaagccttgttcaattaatcccttcctcaagagaattgaaggggatttggaaataatttatttcatatgtattgtagtgtgaaattattttctctcaatccttttctcttaggattaaacgaaccaagcttcaaaggggaaaaaacattcgctgttgctgttcaacaaaacatatggcaagatataggagtagatgcatcgcacagctcatccaacaagaacatgattccggtcaaccaggcttgcaacgacacaagaataggatttgaagcatgtcctctcatcgtctttgcccctggcaaccaccgagtccgacgaacacgccattattacgatgcccggcaccaaccggaaatacggtcaacagcttgacggcgtgacgccaaccgaatcacaggcgaactgcgaacagcattagcctaaatgccgaatggcatcactaggatggggaacaaccttagcctagatgccaaatgacctcactagcctatcacctggtgtcctgctttatccgtcctaaaatataacaacctactcctttgtcttaaaatatatatagtaacttaggagaataatgtactaaccctctccggtccagattaattgtactaggttgtgtctaattatttgctaggttgctattatattcttagacagaggaagtaattagctcatgcgacattattaggtttagtgtcattttagtcatggaagtttttcagataagatggaaccaatggatttcatacggtagaacgggaaaatatacggtggaaaccacatatgtagtaccattggtaaaaaatagacatattagatttgtccaagtcatcgcgagtaaaaattttacttgcagatttactcataatgacgtggacaaatctcagacatttattttttgatccaacggtagttttcagttttctactatatatatgtggttttcctaggtagaacagttagctatatactccctccattccaaattgatctacatattttataggtacaccaagaccaagaaaagctaataactctctcatactatatttactctagcaacaaactcgatgtatacaccatccctaatatttcttagccaatagcaaatcaagatattgcat

SEQ ID NO: 24059 - DNA, 162 bp, Oryza sativa
  unsure (1)..(162): unsure at all n locations
cctgggactggcgctcaaaaagtggagaatgcgganctggccggttgcgacgcctgcgaggccggcggcttcttgaaagttgccccngcngnccgccccgtccgcttccgtggagccatggttgtgttgaggactagggttttcttctttccggtcgctagc

SEQ ID NO: 24060 - DNA, 255 bp, Oryza sativa
tcacttgtaaaagtgatgcaattcctttctagacactgaactggaggcatttgtttgagttttcacgtttgtgaattaggtcaacttgcaattcactaacaaatgttgtgctagtgagtgcaaaaaatggaattcttagtgtcgcctagggggtttgtagtttaaaatgtgttgcaggaaataaacatatcgtgtcatgctatttttgatactggaggtagtaattagtagctgatgttgcctatgctgtccaga

SEQ ID NO: 24061 - DNA, 1501 bp, Oryza sativa
cggatcgatgctgccattgaccacctatcagagtatggctttccgaggcccataatccgtcagaccatcaatgaactcctcgcggacacggtaatctgtcttgatgtttttctaggttatcttcgtgtccttagaaggttgctaattgaacttaatttcagctgtatgggaggaatgggtgggtcttcctagaggaaggctcctaccgcattgtggtcgacagactactcgaaaaacaggcaaatcagcaagagcagcaggaggaagatgcaaaggttttcttttctttcttcctgcgctcatagtttctcagttccatttttatctgcttcggtgtttgttgtgcggagcaagtgtttaagttgcagtagtgagtgacgcaactagtaatgtagcaagaaatttttcattaggtagtctcacttcaaaagttcatatagtaacatcacataccaaaattttcggacaccgtaaatcccatatatagatatgagtacaaatttatatatataaaaaagatacaaatgtagcaaagtgcaaaacaaatagaagtcacaaatcaaactttgttatgctctccgtttagggttattttgtcaatattgttgagcatgttttgcaatacaagtgaacatctcaagaagatagactctttatatctgttcatcaatgaaaatgaatcatgaacgtaatataaattgcacgaagatagtatagtaacattttactaccattaattcgggtttgcacatatggacttatattttcagcagtattaaaatgttaaaatgccagatgcatacgctaatttggagtgattagagtgatcaaataattggccaggaaaaaaaaaccagaaagctattaaaccccagtaccccacctagttttccatggacagacaagtcaattgtacttcctccatttcatattataagactttatatcattgcccatattcatatatatgttaatgactttagacatatatatgtatctagattcattaacatctatatgaatacgaacaatggtagaaagtcttataatataaaacggagggagtagctcacaatcgtgaagcgagagagacgcgaccggcttccaccgacaaatcagctagatgagccctataggaagccaggaaaaggggcgaacggtggccgaggggttggcggccaacgacaaacgccgtgatggcctgatggttgacgggcgggaagggagacatagccgggttctcaaatggcctcccgggacctccacggctcgaggagaggtggactagtggagagagatgttgacgcaccgaagtgagtgtaggatcgagatgtcgactagagggggggggggggggtgaataggcgatttaaagaataaataacacctaatcaaatctaacctaagttgctaggcttggtgagggtgaactctaactaagcaactaagttatgttttgcaaacctagggtgatagtggctcaattatatctctaggaaag

SEQ ID NO: 24062 - DNA, 328 bp, Oryza sativa
ggggggtgggggacggggcatggggcccgcgtgccaggctctcagtggatgatggcgtgatgacagatactttcatcgcgtagtggtgcggcccacgacgtcggccagccttctccggctgcctcgtcggactatccccttgtaccttctcctccattggcatttgttgcttggaattagagcagcacattatgccctgcatagcgcattgcagtacaccgtagttttccttccgtctcataaacaataaatcaactagatgtgatgcattctagtataataaatctagatagatgtgtatccaaatattatgtcggtattttatagg

SEQ ID NO: 24063 - DNA, 626 bp, Oryza sativa
cttatcttaaaattcgaaactttcaacttaaatttgaaaatgttcatgttaataatagagctaattactggaaaaaagaaaaaaaaaagtatgagatcatagcgctacgtactcatgttaatcacgttagatatggcgttaatcacacactaattgtatgagttggcacctgcacgtgctttactaatgagcctgcgaacgtccgaaacgcgcgctgagttgacccgttggcgcgtacgcacacaacagcaaatccgtattatttcttgcaccaggatcctgataaaagatgtaggtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataa

SEQ ID NO: 24064 - DNA, 1501 bp, Oryza sativa
ggcttcatgatccccattataattttgaaaaataccatgtaatttctaaaaatatttgaactctcattagttcagccctacgcgtgtagattttctggctccgccactgggtggtggataccttagttaatctaatctagcaagataatttagtcgatacctgcataaaccctaaaacgaatctcagccgatatgagcaaattaagatgctaaactagatttaactaagatatatgataactagcggttgtagaagatagattagaacgtctaaaacgacgccctaatctgccaatgcaaaccgctgagacaagtcatacctcttgtcagaagatctaagctgataccctaaatcgaagtaagaattcgtcgaaaaagtagaaatgtaaaaggtggcgatgcaccgaagttgtattgatcgagagatagtttacaataaccctgggtgtacatatttatacctataggtagatactagtccttcttggacaagaaagaatcttttctaaagataaaaggaaaacataaagtccttatcggacactaaacacactttcctaaagataaaaggacactaacaaactattcctaattaatagttaaactgccataccgcatcctccttgaactcggtcacttctggataagctttcttcagtagattaatttccttaaccgaatctactaagaatccgactattggcgacttgataattcctataagccgattcaaatactctgaagccgatactgactctaggccgatgatgactttggggcttaccaaatttcactgttaacacatgccccccaattttggagtatgagaactcatgcttcaaaattatcttctttctgattttgatgactccaaaattgatcgtcttctgtatatcacaatcaactttcatgagctgatactgtttgcatcaaatgagctaggctgttgaactcgtggcaaaagaatttgtccttggtaggtgttgatagcccttggaatgcaagatctgctagctaccccgatcacactcgttgacggaaaactctcgacgcgacccctacctggcgcgccaactatcgaatctgaaaatcggcaataataaaaggggtagtgcatgagacctaaaagtggatggatgcggagacaaggatttagaaagtttcatgctctctcgatgataagtaataccctactcctgtttggggattgtatccgtcgagtgtgtattattctgacgatctaatagtggttatgcccttgaggggctccctgcccaccttatataggtttggggagggtggggggaggttacatagccaaatatggcatcggtttacttaatctactgtacaatattactgaaccaggactttagaccgttcctttatatacaaggaaacataatacccaagtcatgatgtgttacatattccataaacataatctctcccatatatccagtcggttaacccagccgtgtgggtatatggcacccataat

SEQ ID NO: 24065 - DNA, 877 bp, Oryza sativa
  unsure (1)..(877): unsure at all n locations
gatggtgnnnnnnnttggttttgatcattcgttctcggtaccctttctatggtctcacacgtcattaactcaaaaatgtgtggcacactctttatttgctagctaaagtgtggcttacattttattggccataacttagctaaagtgtggcacaaaagtatgacaaatgattgttgtatagcatgcaaacaacccctttatttcgcaatatagattgcttaattttttgggtctgttaatgttggctcttcttctagagacgcatggggaccaatgtatatattgacacatttttctagaggtgcatgatgtgttgtgtgttcgattttttctagaagccattggtttctctggagaaatgtgggtggaaggcatgcgggtggtggaggatggcataaaaggaggatgattttacttttacagtagtagatatatagatatctcgatttttctaatattgatattttgtaagatgtgttgggatgcatacaatcattttaatgaaccatagtatatgttgacctgttttttccaagacgcaagatgtgttttttttttgagaaacttggggtgataggggtgtgccgcagtggggagaaggaattgctagatcttaaagatattttccagctgtactccaatatttttctgctaatatttttattcctatattttgtttcaatggaccatggtatatatttacacgtttttttttaaaaaaggtgcatgatgtgttgcgtgtttgggatttttttggaagccgtcattttttccggagaaacttgggtggtttcgcgatctttgtttccttgtgccgcgcgcgcggcgtgcccaggtggtccgcgttctttgaacctgatcaaggaggagttcgtga

SEQ ID NO: 24066 - DNA, 1501 bp, Oryza sativa
atggcatagtagggttgcatttgcaaaagcagcatttagcaaacatttgagaattcgataaaacagttaagtaattaaacaatattaatccaacgctatacaacataccctgttgtataggcccaaccattctgaacaaccaccccggctgcacagttctatctccacaccaggaatattccattccaaaccaggagctaatcaaattattaccaatttaagcatcatttactatggtgagaagtgtgaaactaatcacgaaagacattgttagacccgcccataccgcgggcacggctattcgaatagttttactctgatcagaggtgtaccactgtacccacaagacacaaccccacatcatgtcaccatgtgcctcaataccaccacagtatctcggaaaggagttgtgacaatacccctcgcataacacaatccactgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaactgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacagtagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattccatcggattaaaacacttatatcggttaaaattgaattatgacgcaataatgaattatttttgaaaaggaaaagagggtttattgcgtcagcgggctagggtttggtggaccgggcgcacggcggcggttcacacgaacggacggccgagatcgaaccaatccaaaacggacggccgagatcgatcgggtccacggcggctcacggcggacgaccccga

SEQ ID NO: 24067 - DNA, 1501 bp, Oryza sativa
attctttaaacttcattttattatttagagtgaattattatttaatgagtgatgttgctccatatcctgtttctgatagtctttacttctcttctggtaataatatttgctgttctctgactttgttaccaaatacgctatgcaaattttattgcttgcaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagattacttgagtttctttagcttgtttgttagagctaaccgagaagaggatcgcaatcgtgaaaacttcgcaagtgttcagaacaaaagtagaagtagaaaatttggagttcctgtccatttttagcataactgtgtctatggtgcgccccatctgtcaatgtggttctcaggcaactgttctgatacacaagtgctaatgagcaatctgacccgacaaaaaggaaatgaaatttaatttgattatttcaaactcattttggtgaaactaagcctccttctttactaagatgcaaattcttcctaacacattttttaaactgctaaatggtatgtttcatatgaattttttacataaaaatattttaaaatatcaaataaatcaatttcaagtttaaaataatcaaaacttaattaaacataagctaatgggccgttttcattttgctttcctattttatttcatctttattagaaaaaaaacaccatctaatagactaatactgcctcgagggtttttctttaacaatatctaagtttttttaatgaagagatgcttcttctaaaatccaaacacatagtagtgtgtgtatcttactggtctggcgcgaccgactaagctgacactcgcgagagtgtggccggtccggtcgggtgggggtggataaggagatagagaagcggccgctccgcagctgcagcggcaaagcctccccgtcgtccagcccacgcagcgcaccgcagcgagcgaagccgccgcaatggccgcctcctccgtggcctcgactctcctcctctcgctctcctcttcctcctcgcccttcctct

SEQ ID NO: 24068 - DNA, 1501 bp, Oryza sativa
tcgcgtcctgcctggccttttccgtgacgagacgacgcagaacagaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttca

SEQ ID NO: 24069 - DNA, 489 bp, Oryza sativa
  unsure (1)..(489): unsure at all n locations
cgggaagattttggccggtggaatcatttatttgaacccttaatagggatgggcttcctccccccaaaaaaagatggggttatttattttaacagacctccataaaaaatgatgttagatcggaaaacaaaccagattggtgggggggttttcaggaaaacaatttgggggcccctggtatatagccccgaggcctggcacagttttgcctactcgttagagagacggggnnnngnnnngggtcaggtagaactccaacaaaaaaaaaacctttaataaacccttttggnnnnnacgccctttaaagaaccccttgtaagtaccaccccccagtgggaaaggggacggccccaaaagagcctggcacgtctgtttaaagacggaccaagcattggggcgcctcaaaaagaacattttttggaatagtttttataggggtccactgcgaaaataagtttttcaaaaggaccaatatgtgaaaaatccagg

SEQ ID NO: 24070 - DNA, 1501 bp, Oryza sativa
tatctgaagttctgaacaattacaggcacattctcttcagacattttccttcaaaaactctcttcaaacaagaaaatccgtttcaaaaaacagtaaccacggaagaaacaagtgtccaatctagccacgacagttgagtcatttgacaaaggataaaacgacccgttcaaactttcaagcttgtccaaattcattatcagaaattatatttcttttcctgaaactatggaacaaagcattgcaaggtggctagctatcaacttcatctgcctatctcttgtagggtttgactgtgcaagcattccctaactaatttaaccgtcaatagcttgctgcatcggcagagtcgcagttcccgatactactagcgctgttcctctgcatccaccggccattgccggtttggtttggtcagtcttttgaccggccggccgcgaatctcttcagtcttcagtttcactgttcttctggccagggctgcagaggtaaccgtacagtttaggtgtgtttttttaaaccgtaattaggagtgttaattaatgttataggacggttactgacagtacacgcgaggagattaacttaagatataaaggacttgaccgttggcagttttggcatttgatcctgtgagcggcagagaccggatatactagctgatggttttctagcgggttgaagcagattaactagattattatagtatattatcaacatgattataaatataacaaattaaatagtttgatagctcagaacaaggaatctatgcaatgcagtaagtttttttagaaaatttatttttagaggcacagaataaataattcgcgacaatcaaccggtgaaatatcttaaaaagaattcagcttgtgttctctatgaactgcttgtgtgtgtttcttgtacaatggagttgactgaaaattacttggaaaatcttgacagacttgtactaactgggcggccacttggtcagagctgaagttggatatcacaaacacattttgcattccacaatgtgacaatggtttactgctgtactcgatctcaaaatttaagatcaagttagagtcatagtccagaatgttccttgtgaaatttggtgacatgttttagttcagctaattattgttttgctcggagatgtgaatgaaataaattaaataatcagtggcatgactcgcatgacactgtactaaaaccataatgcaagaggattttcacatgacaaagcctgcaagttgtacggtttgtgagaaactccccagagtataacctgtgatttagtcatgttcattctgatccaagtagagcttgctagcaagaacaatgtttttctttaatacatccatgctaatcttaatcgtagattctttctacctagtggactagtatgtgccacaagtgtcatgttacaacctgcaacctctagaaaccaaaagagatgctagatggcattgcagattttatggttttcttactgtctagtttatgttcatga

SEQ ID NO: 24071 - DNA, 238 bp, Oryza sativa
aataccatctcgttttactttaaaaaaacttaatcttcatcttcatatttattttcagaaaaaaagaacaccagcaaagagtcttgggtatggcgatgaacacatcctgactagtttgatttgatctccctcgagatttagttaactgttctttagtagtgtagtggagtacttcttttcaggaggctattacagtattgaaaacattttcttgtcatgcctctagttttcgcggtaa

SEQ ID NO: 24072 - DNA, 245 bp, Oryza sativa
aactttcaacttttctgtcacatcgttccaattttgaaatgaactaaacatagccataagcatttctaggacaccgatttcaaagcacgagaatccaaccattttcagccaatcggatgcttaggaggggaattcaaacaattcaaaattcaaaatttgaattttaatcaatgaggtaactcaaaggaaatattttccattattcctcatctttattaaacaacctataaatgcttatatttagg

SEQ ID NO: 24073 - DNA, 1501 bp, Oryza sativa
  unsure (1)..(1501): unsure at all n locations
agtaggactgtctcctttcatgtggagagtaggatctacgcctctcatagggggagtatgatcttcgcctgttgtatggagaatatgatcgccttctaccataaggagaataagaccgttctcgctcaggtgagtagcgtgaactgtagcggtctctttcaacaggcgagtagcttggggaatacctccgtgctggtgtcactgtataataaaaaatattcagcaatcagttgtattatatcaggaaaggctagcaatgcttcctattttccagagaaatgagaccaaaccatccagacacagcagcagttaaatcaaacttaccacatgatgattttgtgcctagataccttccgggcgttggtgttcgaccacgtcttctcttggcctgtggaaaggattcaaataagccttttcgccatattagcattaaagagtgatgcaacaaattgggaatctgaacgacatgattaatatggagactatataatgtagggcatacaaccctttggttgaggtagcatgtttggctgttaggttgtaaatcttttgaatttgacgtagagcagcaacggacatctaccctgctgctgtcaacaaaagcttcaaacggaagagcactcaaatattcagctcagcaagctaaatgagcatataaatttcactccaagtagaagtgaagaaattcagtaaatatattgtgattataccttctctacagttatcacacgaccttccaacactgagcggtctagatatttgatgcaaagatcagcctccttaacagtagccatggtaacaaatccaaatccccgggattcccttgtccatggatcaagtactatgctagcatcaataacctgtaatacggtgagcttaaaaagttgtacactattttggtatccctttgcagatactctataaaggttacctctccctcagcagaaaagtgtttctccagatctcgatctgtcacacgagcagataagccagtaacatacaggttgttcccagggttttcaacatcacttgagtccacacttctaaagacatcaaaaggatatcacatactcatcagaattacagtaggcaaaaatgttcaccctcgaatatagagtgaaggcagaaacatactaagcgctaagataaataccatacctagaacgactcctataccttgaacggctgctccgtctgggcgatgtagaatatgagtcggactcatatctatcagtaggagccaatcaataatcacaagacagggcttcaaaaaatgtggaaaaaaattaagtttggtaatgcgtaccttgatcctctggagtacgacatctgcaagatagacatatgattgcatcaatatccactagagaaacaaatatatacaaaaacatgagatgccacttgaaaatgtaattataacaaacagtgggttcatagccttttgaagttgtaactgattaatttatgacaccttggtgacaatannnnnnnnnnnnnnnnn

SEQ ID NO: 24074 - DNA, 1501 bp, Oryza sativa
cgaggattttatgcacaaattagttcggaaattactagtgaatttccgggcgtgacagctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagccccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccggcagcatcaaccgtcatggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgtggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagttgcatcagctcaagatcgcccagggagaggtctgtcgccccaagcgccgccgtgtctgccgcagccagaagatcaccgcccgcaagagtacatccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggccagtcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttcagatggtgacgaccaggagaagtgctgctaccggtgaaggcagccaacccgaaggcagca

SEQ ID NO: 24075 - DNA, 510 bp, Oryza sativa
  unsure (1)..(510): unsure at all n locations
atttataaagcacgtgagggtatttacagattttccaccagaggtgcaataaattccgatttgaggatttccaaacccgtgtgaggtaccttgtaagaggggttcgagacattaagagaataattggcttttccacagggaataatgcccttccgaagttttttgtgagaggaatgccctgagagaaggtttacaaactccgcggcccttagagaaaaacaacaccggatataattggtggaagaataaatcaatattacccgggtggaaaaaggttttgaatccatggtgataatatgtaaagggttaacaccttgtcctcgggccggtatttttgttaaaaagtggtaaaaacaagctctacccggggcttaaaatgttcaagtacaaagtattaaggagatagacanaatttgaaaataagaacctatccctacaaccttattcattggataagttattacgggtgtgaccagttgcgccataatggaaggcatgcgcaatgcccaa

SEQ ID NO: 24076 - DNA, 1501 bp, Oryza sativa
cacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcaggg

SEQ ID NO: 24077 - DNA, 339 bp, Oryza sativa
  unsure (1)..(339): unsure at all n locations
atgagacnntnnnnattganatccgatctcggtaccctattatatgaaacttaataaactgcgtcaaagctgtggtcttcttttctgttgttgcacatcgcaagtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaagg

SEQ ID NO: 24078 - DNA, 1501 bp, Oryza sativa
catctgggcacttcgtttcttcctcgatccacttgactgacctccataagttgaccacatcagcatcttctagtttcaacaactagtttcagaactactcaagttgaacgagagaggagagtagacaatgaaacaatttgcaaagaattctagataaggaagaaaggagaaattttcacaaatcatgttttcggaaaattagtccttaaggtttgaccatttggcttatcctacagtcgagatggctctgataccaacttgtcacgcccggaaattcactagcaattcccgaacttatttgtgcataaaatcctcgtccaggaatcagccgaggtacacaaactgacaatttaatatacaaatccatcatattaactaaaccgataaatacttacttaagaggcacttagtcctcaccaagaagaaaactgcagcggaaaaataaaatctagcgaagctccggcttcactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaatgatggcataatataggctcatttgcaaaagcagcatttagcaaagagttaagagtagtaaaacagtagagtaattaatcagaaattttaatcaacactgaacagcacacccatgctgcacaggcccaaccatcctgaacaaccatacccggctgtacagatctaactccaaaccaggagctaaacaaattattaccagttatagcatcaataattattgtgagaggtgtgagactaatcacgaaaaatattgctcaacccgcccataaccgcgggcacggctattcgaatagttttactgtggccagaggtgtaccactgtacccacaagacacagcctcaacatcatgtctaccatgcgtcgcgatactggaaagtacccgaatagaggctgtgacaataccctccgcacaacacaactcaccacagtgcaccattcctggatcataatcacccccttataaaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattaatcatattttaattaccaattaattatcataacacgattaaccatcgtgagctaccattaaatataaccataaataataatgtagtacatatgattcatcccattagtgagctaatgtttctaagcatggctaagcaattatatctaacatctagttgaactaatatatataaagctcaactagtcaaattataatatccc

SEQ ID NO: 24079 - DNA, 271 bp, Oryza sativa
cccaatatgtggtaacccaaccttttttgggtgggaatcccccaaaaatagggggggagcgggtggtttcaacaacccgcaaaaaagccctcaatttccctggcacaaataaaagaggttaaggccaattttgggggaaaaaggtgaaataattccacacaatttttttaaggctgaattgcccaattaggccggggataccagcccttaaaagctaaactttaaaaaagagaggaaattggctgggaatttggaggttgccccctgaaca

SEQ ID NO: 24080 - DNA, 1243 bp, Oryza sativa
agtggcttgatacgctgcctctggctactatcatgtgcctcctgaaaacaatccttcctctcttacgattgtccatcctgttcttcttgtcttccagtcgaattgctttatcaaccagctcctgaaaatcctcatagtcatgagagatcaacataactgtcagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaaggcttcagtgaactccgcccaagtgattggttgtccttctgctctgttcatccggaaatgatcccaccattccgatgcaggtccttgcaactgatgtgaagtgaaaacaactttctcctgatccgtgcactggagcagttccaacttcttctcaatagtgtgcagccaatcacctgcttctactgggttggtagtgctagagaaggtaggcggcttcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagaaaagataggaggagaggggttacactaaagacaagaccttaaccagtttaacactgatctgatgtgtgtagaccattatattgttcaagttgattaagcaagcaacctagtataggtacacgctcatcactggactactccaatgacgggaatgcaaccatacctacacacaaagcaatcaacagcgttctaccctactaactattcttcaaagacactttggcggcataggttctaaggtaggatccaaacttcattccatcttgacatctgggcacttcgtttcttcctcgatccacttgactgacctccataagttgaccacatcagcatcttctagtttcaacaactagtttcagaactactcaagttgaacgagagaggagagtagacaatgaaacaatttgcaaagaattctagataaggaagaaaggagaaattttcacaaatcatgttttcggaaaattagtcctt

SEQ ID NO: 24081 - DNA, 1501 bp, Oryza sativa
ttgggttaaggcaggttcgtgtgggttcacggccttgattaataaaattgtatagttctagaatcgtgtttataaaatggctttgagcaactaaatgtctttaaatgctgtttactgcaaccctaaccctctatattataatccctttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcctgtttgtctttgtgtgctgggccttcgctgcccgtgtgtcgcgtcccaaatcgactctaaaattcatcctcaaaattgtgcaaaagaataattaaaaatttattgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttgaaaaggttttataaaaagaaaaatcctaaaagaagttcttttcccccccccctttccttcttgggccggctcggcccaattccctccccctctctctctcctctccccgcggcccatcggcctcccccgcgcgcgcgcgccgctgacaggcgggcccgcccgccactctcgctgacgggtgggacccacctgtcatctccctcctcgcgccgcgcccgccgcccgtgccctagcgccgccgccgccgccgaatccgccgcatcccgccgtccccgcgcgcattaaagagggggaaatcactccccgtgattccctctcccgtttcccccgctttcccctctctctctccctcggattcgtccaaaatcgcgcccgcaatcctcgccggcgtcatcaatggcggccgagatctccgcgcccgtttcctccctctccggccgcgctctccccctcccgacgctatataatcgtcccccgagctccgctcttccgtttccgccgctcgccgctcgctctcgccgtcggattcgtgctcgcgccgtgcacctctctctccgccgtcgccgtcgacctccggttcgccgccgacgtcgctccgggcttcctcccgactcggcgtcacctccatcggcttcgccgcgttgtcgccgaccccgtccgccccttcgcttcgcccgccgaccgccggagctccgtcgtcctcgccgtcccgaaccgcgccgccgccttcctccgcttcggccgccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcggg

SEQ ID NO: 24082 - DNA, 1501 bp, Oryza sativa
attaaccgtgccaaccacaagccagcgtgggcaacggctttaccttttgtatagcatggttcattgcagagcaccagactgagaagtggcggagataagcccacgggggtcgctggggagtccatgccttgttttataagggggtgattatgatccaggaatggtgcactgtggtgagttgtgttgtgcggagggtattgtcacagcctctattcgggtactttccagtatcgcgacgcatggtagacatgatgttgaggctgtgtcttgtgggtacagtggtacacctctggccacagtaaaactattcgaatagccgtgcccgcggttatgggcgggttgagcaatatttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgcttttgcaaatgagcctatattatgccatcatttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtgaagccggagcttcgctagattttatttttccgctgcagttttcttcttggtgaggactaagtgcctcttaagtaagtatttatcggtttagttaatatgatggatttgtatattaaattgtcagtttgtgtacctcggctgattcctggacgaggattttatgcacaaataagttcgggaattgctagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgctgatgtggtcaacttatggaggtcagtcaagtggatcgaggaagaaacgaagtgcccagatgtcaagatggaatgaagtttggatcctaccttagaacctatgccgccaaagtgtctttgaagaatagttagtagggtagaacgctgttgattgctttgtgtgtaggtatggttgcattcccgtcattggagtagtccagtgatgagcgtgtacctatactaggttgcttgcttaatcaacttgaacaatataatggtctacacacatcagatcagtgttaaactggttaaggtcttgtctttagtgtaacccctctcctcctatcttttctaatctgcaacaga

SEQ ID NO: 24083 - DNA, 390 bp, Oryza sativa
attaaatgtcaaactgcttctttccggcttatgtattttcttagtttgcatggggaacaatctgttctgatttttttatgcttgcatattctgtaaattggcattcaagcagccaacaagcatctgaaggtatctgatatacagagctcagttgtgtggtctatcaatactgatgttctctatcgaatttgttttgatccttggaaagataatatgcctagcacattgtcttcctgagtttgtgtacacattgtgaacttatatatagctacaaacttaccgcatgtataattaaaatcagcagcaatgtccattaatccatacatgaatatatctctctggcttggatgtacaaagatcatgtcctctctctctctctttgtctatagg

SEQ ID NO: 24084 - DNA, 1501 bp, Oryza sativa
ccattgaattttggactgctatcacgtgattattgtttattttgttatgatttattttatcattacgtgtacttaaaagcatggcttatattgttattatttttaaaaacatatattcaaaagtaaaaacaaactattataacttcttggcttgaaaccctataattatttcttctcttaataacatttttaactggagacctctcctacagtggaattggtaaaaataaataaataaatgactacatatatatggtatagtatctctcgagtcacacttgacagtgagctattcacccagtttttagaacttttttttttttcaaattaactgtagttttatcgtgtggcccatgggccaccaagcccgtgttgtatcgggcctgaagcccatgagtccgtgacggcttcttcgccaccttcctcccttccatcgttgtggataatgcggggagcaaacgccgcgcagcagggagatacactgcgagtgaccggaggcagcgtctcctcctcctcctcctgcggctgcgtctacgagcgcgtccatggcgtccctctccccttccctccacctcccttggtaactccccctcctcctcctcctcctcctcatcctgcctcctccaccccgtcgatgctgcttcagttttttttttttgcgctgccaagaaccggcattagttgctttcttgttgctccgccaagaaatgggggatttggagatggtgcccatcatccttaattcaatgatttggatgcaattggctttaggagtatgccaataggccgtatttaattcctaggagagtttcgattgagtgcagtaagttgagtctccccgcgcctgcaatttgcagtgatacacgagtcacagacaggtcaggggcttggtcattttgtagctgaaggattgcagttttggatgtgtttggttgagggttcggaaaattttccaatcagttagtgcaatgcggcagcactttggatataatacccctttttttttcttgctttgatcactagttgagaacctggaaaagtatgcaaataccctttcaatatctgaaaccttataacttaacatcagtggtgtggtaatgattaaccatgaaattttacttgctagcattattcttcaaaaacatcatggccatgttaacgggccaataccgagggtctagatttgtttcagaaaatcagctccgaagtgctattaactgaaagatttaacttgccaaaaaactttttaaattaattagttcattatggcattatgctatcactcataaactgaacaccaaacaaagagctatgttgatacaagttcaggcaggagaaattgtaggtttctcatttggtctttgaatcctatctttctagctagtaactacttcatggatttgaattataatgttttactaatctgtcaaactaaaataatgcattggtttttgttgtaaagggcaattatttatttgcaatttaatatgaaagttttgat

SEQ ID NO: 24085 - DNA, 182 bp, Oryza sativa
atacttattaattatttttgttaaaactacttgctaattaattggagcagaaacagattctctgtgatgaaatagatcttcatagctcagatatgatgaactgaagacagtactcgtttgtcagacagtgatttagttggaactgcacttgtactcgttttctgttccattttagtttcagg

SEQ ID NO: 24086 - DNA, 1501 bp, Oryza sativa
tccaggtgcagaaccgcgccaaggctcgccgctggttcaagaaccaaagcggaggcggaggcggaggcggtgggccccgcaagcacttcttcccccggcccaaggccgccgccccacgcaacaccacctccttcatcatccgtgccaagcgcgccggtggcatcgcctccctcgtctccccctcccctgttacccccgccgttctccccaccccacgcctctccccctcccgcgagggcctctccgacatggctcaggcgcagtggggcgtcgatggctatggctccatgaagggcctcatccgcctccgcacctcccctcaccccgccaacccctccgatgacgacgatgatgccaactccagcggcagtgacgtcgaggagcatgtcgaggtggagcgccgcctcgaccacgatctcagcaggtttgagatggtctaccctgccaggggtgacggtgtcttcttcgaggaggaggatgactatgagtatgaccaggaagcccatgtggctcgcctcgaggaggagaacctcaccttgaaggagaggctctttttgatggagcaggagcttggcgacatgaggcgccgcctggaggcactcgagtcgcgttttgcagggactgatggtatgcctattgagaattcagatgcagttgcagttgaccatgacaaggagatggctcatcccatacttgttcagagggatgatcttaggactgagattgctgctgatgcagcagggtcagacaaggctagtgcacaagacaatgcagaggaggttgctgatgcagcagtgtcagagaagatcgtgcaagacaatgcagatgttgtagttgcagggtcagagaggactggcgaagagatcggggttgatgcttcggagatggattgatgggagatggacactggaatgcaatagcggttatcagtactgtacatacataattgtcgatgacagattgaggccgcgtgatgtggacttgttttgggaggcttacaattgtatgttgtcgcataacaagtggatcatcgtatttacaatgtaatatgtttctaccattctgtgctatctttggtgtttctttgcgtatttgttatgatgataccacacagcacaacttgtagtagttcttaccttctgctgctgctgctgaaagaggtagaagcgactagatgaatttgttactacatcaactattaatgtcattataatggtatcagatggtgtcatgaacctgttacttaattatagatagcactcatgaagctattccttatttgcagatagcatagcactctcatcctggtcacttgtagttatggattctggtcggggttaaactatcttttttgtcaatgggggtggtcagttatgcttgttgggatgatggtttttttgatggtatcatgtgagcactcagcactgtatctgtatgttgttttgtcgtggtgaaattgttgttagtatgttgctgctggctccatggatagagagatcat

SEQ ID NO: 24087 - DNA, 1501 bp, Oryza sativa
cgccgcgatggcatgcttcgtggcgatgctggtgactggggagcgccccaactcgatcacggtgctgagccttgtggaggcctgcggcagctgcgcggagatgtgggcgtcgagacgcgcccacggcgtggccgtcaggagcggattggggtttgagctggcagtgggcaacgcgctggtccacatgtacgggaagtgcggcgagctgggcgcgtcggcgagggtgttcgacacgatgcccgtcaaggacgtgctcacctggaactccatgatcggggcgctggggatgaacgggcgcgcacgggacgcccttgcgctcctgcacaggatggaagcggaaggtgatgaggtgaggccaaacggcgtcacgatgctggccgctctgtgggcatgcgctcatggagggctggttgaggaggggattgggtgcttggaaagcatggcgcggcagtcgctgcagcctcgggtggagcacgtgtcgtgcgtggtggacatgctggcgcgcgcgggggacctggacggcgcggcggagattgtgaggaggagcagtggcggtggcagcccggcggcgtggagcgcgctgcttagcgcgtgcaggaggcgcggggatggcggcggcggcgaggtggggcgaagcgcggcggcccgcgtgctggagctggagccgggcaagtcggcggggtatctcatgtccatgggtatgggtttaggcaaggggtgggcggcagggatgcggtgggcgatgagggagaagggagtgaaggtggagagcggccacagcgtggtgcagcacgccggcggaagcgagcggttcgtatggtgggacggagcgcacccacggcgagcggaggtgtacgccatgctgcacctcctgcaccgccacatgaagcaccaccatacagatgcagacatacagtacatatgccaatgccaagttgacaacaattaacccaattaaaaaaaaaggcttgccttttgttggtccctcccggctctatgcgctgcctcatccatttctgatttctcctttctcccctcgagtctgatcctcccactaccaacgtccaccggcaccgcaacttgctgtcctctcctgccggctggtccagctccatctctcttcttgctctgcctcccccttcaatttaattgattcctccatccagatttcgagatcgagatgaaggcagtgatgatgcaccaccatcacgcggcacgccctgcgcgctgtccaaggcctatctcttcctcctcctcctcagccctgttgggtagcagaccaaccagagtctcctccccatcaaacctgccaaagttgctcataaaccggcgacacatcacccctcttgccaccaatgctccccatgctgttgctgaagatgatggcgccatctcttttgctaatgcaacgccaacggagcctcccatgtaatttccagtttcctacttttatttacttgcctacccacatgcttgcgccctttgcatttgctgtctacat

SEQ ID NO: 24088 - DNA, 622 bp, Oryza sativa
tgggctatgtactatctgctgccgcggtcgacttaagatcccttttaccccggtaggcctggttcagttaatccctacgagatagggattggaggggatttattccacacctattgtgatgtggaaggattgtctctcaatcccctctaatcctctttaatccccacaccaccgtagaataagggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaa

SEQ ID NO: 24089 - DNA, 1501 bp, Oryza sativa
agctgggtattctcccaattcagattatatgttgctaaacattcttatctactggaatttcttttcaaccctcaaggtttattcaattatgtttgatgcataccggttaagtgtatagcttacttttctaagatccagaacaaagcaagatcatcaccaatattgattacacgaacacgaggtcagagaacagcaaacattaaaggaaaaagctgcatattgcaatgtagagttcacatccttgaaggagctactgggagtatagggccgcggttatctatcccgatgtcaaaacatgttgagatgcaaacatgcaacttatttaaggcactggtaatatgacaatcaaaatacacatggcccatgtgaattctatgctcatggtgctctccactgcaagaagcaatggctcatatatgatgctttgtgacaaacgctgacagatcttaagtagctgacttctgaaataccaggaaaaatatatagaacacaaacaaaaagatacaccaggaaaatatatggaacacaaacagtaagatacaccaggaaaatgtatggaacacaaacaataaaatagtacagtacattatgaacagtgaaccagaggaaaatgaaagcaaaattgtcttacctgaaaaggccatgcatctggtttgcccttttggtctccacagtcttggaaactctcagcttaccagattcttctttcaccacttttacttcacctggatagtttagtgataattctcctaatggacccttagccttaataaactgctcctctaacgtgagggtcacatttgatggcacttcgatcggcttctttcctattctagattctttgcactccactgttgttctgacaaaaccaactctgccagcagggataacacgaagacgaatcccttgtgtctttccagcaaagccagtccttgaattgctgatttaattccgacaaataaacactcaatcaaaactttcatattaaattgcaaataaataattgccctttacaacaaaaaccaatgcattattttagtttgacagattagtaaaacattataattcaaatccatgaagtagttactagctagaaagataggattcaaagaccaaatgagaaacctacaatttctcctgcctgaacttgtatcaacatagctctttgtttggtgttcagtttatgagtgatagcataatgccataatgaactaattaatttaaaaagttttttggcaagttaaatctttcagttaatagcacttcggagctgattttctgaaacaaatctagaccctcggtattggcccgttaacatggccatgatgtttttgaagaataatgctagcaagtaaaatttcatggttaatcattaccacaccactgatgttaagttataaggtttcagatattgaaagggtatttgcatacttttccaggttctcaactagtgatcaaagcaagaaaaaaaaaggggtattatatccaaagtgctgccgca

SEQ ID NO: 24090 - DNA, 1501 bp, Oryza sativa
gtgatggcctctagtgacggtgtgtgtggaggagcagctgttactaggtgtggcagtggttgctcctcttcccggaggttgctgctgggagtggctacagcactaccgacaccactcgcgtggcaacagcgggaggtcatgtgtggccaatgcaggtgacaacagggaggctgacgaatgctggaggttgactctaacgatgataggaagaccagcaacacgggaggttgacacgggcaacggcgaggatgcatgcatgactagcggcgagaggctagtgatggcatgtgtgtcatgttagcatgtggaggcatgcggaggatggtcgacgggaggtgtcggtggcgcttatgatgggtgactggtggtggtgcaatggagcggtagcagtagatcgacaggggacaggaggtgggtgaaagcctagcccagtcttgtcgggtcagcaacgacacggtttaggcgtcgtattcactcttgggggagttgtcgagatgtccatcttctttcctagtgaaaaccttatcttagatctccttgaaactatcgacggggggatacccgccgaccgtattctaagggtattgaggtatgttgatacgacatcaagctcacaggaaacaaagattatactggtttaggccccctcgtaaggtaatagccttaatccattttatatgggattatgaaaaaaaaccatagagtacaatagagaacaatagaatcctgagattactgacgagatccctatcgagaacaactagatgagatctatcggcgagttggcttcaagtcctctggattgctcctactatggtgggtgtattgcactaagatgtgatgatctgtaccctcggggggcctacatttataccacagatcaccttaatatccaagtagaactcggagacaacagacctcacacagtatgaaaaaatccttatgttctccgaataggactctgaccccttcaatttgtagagattatttcctgagaagcccaccgacttccttaacccaaaagtaaccttttcgtatacttgaaggtataccgtatccgtatatctctcgactccaagtatagaaggtatgccttattcataaccctgacagagaccacgagggacaatagtgtcgctcttctctatggagacgtcatctaggaggcccccttttgccaaaactggtcctagacagtctatgcgaagccgctggatggcagccgatcggtgggtctatccgagggagagggatctttcttctctcttgccctctccttctatatccttttcgtccggacaacatctagaaggctaggggctcgtctattagggtttgattttgaacggtttggctgtagctccttttttgtctagcaacggctggtctggtgctaactcttttcttgattttatgtagatgttgtcgatgtgtggtggtggttgtcagggttacgggtaaggtatactctctacccttcgatatacgtcacatatcgata

SEQ ID NO: 24091 - DNA, 1501 bp, Oryza sativa
ttctcaagtggccaccatcccgttccgtttgttgttttctagtaccaatgtaccacacgctgcaggctgcatcaacgggctgaaaaaaaaagtgcatcttttagcccttggtttctgtaaaatatcacctaatttttggtttctttgtgtatacaatgtaaaaggaatacacacatcacacatgtactttgatagtactcccctgtctcataatctaaaagattttagagggatgtgacattttctagtactatttccttcaacatcacatatattatgggacagagggagtattatcttttctcactgtcaacaactcagtttagcggcaagctcacatgttaagtaggagtacttaagttgagaggggtcttgaggtaatcagacatggcagaggaagcagggcgtttcacaccttgccaaatctgaaggtctctttgcaaatgtacatcttgtactccgtataaattgagagagagagagagagcgctcttgattcatgtcatcatgtggggttctctctgagatggtgaggcatgacctgctggctttccactggaaattggttcttcctccctcatatggcaggcagagcatgatctgccttacatgagcctcctgtctgtgtcatcaccacctcctccacaagcagctgctgaaagtgagagagttcttggatcactcagagctagcatccctaccattactctgcaaggtactctcatcttggatcacttgattttcagttcatcttttgggtctcgtggttgattcattcgatattgttttcactttcctcttcagtcttcttccttctttcgttggtgcagtcatttcagagtaaattcagatgcgacgcatgtagctgtctagtagtgttatggttggttctttgttcagttgccatgagatgattcagatagaaacccgtcacactctgaacattacagcttatagctgcggtttgtcgcatcaaaactaggcattccggttggtgtttttcgcttgatttgtactactatttggaattttagcaggtgacacaagaaagcacccagctaatcactcacttggctttagcctctaaatggctcccactgcgtgattaaaaactgttaaaacttcagattactgacaaatgcaacggcaaatcatcaaccgaatccaatgcagcagcagtcctgctctgaattttattttttccgcttcttgatttcttcgttttgctcggacactgtgaccgtcaccactgacgaacagtagcttgtgctggcagcaaagtgccctcgtcctgccgaagctttagtcaacatttccttggatcttacgattgagacatgccagctactactcccaattcttgtttttcatttctattatttcatctgcatttctggtaatgacgatgcgtttcttgcttcagattttgctcggttcagacactgacgaggtgtagtaaggctagttagtagctaagcttgcacgaagcttagctgcgaca

SEQ ID NO: 24092 - DNA, 251 bp, Oryza sativa
gggctcgatgtaaattacaatttataaagaaagaagtatgtgaaatgaagccgatttaaaagtgtggataccatgtacaatcaaagatacacacctgggcagaaacagctaaagcatctgcaagcaaagataccgcaagccatacttgtaagcatatctgatgagctgccatagctgttgggccttgtcgagcagccattgatgtccctatggtcatcgttaataaaatcgagagggttcttcctaacagc

SEQ ID NO: 24093 - DNA, 1501 bp, Oryza sativa
agacaaaaaaggagctacagccaaaccgttcaaaatcaaaccctaatagacgagcccctagccttctagatgttgtccggacgaaaaggatatagaaggagagggcaagagagaagaaagatccctctccctcggatagacccaccgatcggctgccatccagcggcttcgcatagactgtctaggaccagttttggcaaaagggggcctcctagatgacgtctccatagagaagagcgacactattgtccctcgtggtctctgtcagggttatgaataaggcataccttctatacttggagtcgagagatatacggatacggtataccttcaagtatacgaaaaggttacttttgggttaaggaagtcggtgggcttctcaggaaataatctctacaaattgaaggggtcagagtcctattcggagaacataaggattttttcatactgtgtgaggtctgttgtctccgagttctacttggatattaaggtgatctgtggtataaatgtaggccccccgagggtacagatcatcacatcttagtgcaatacacccaccatagtaggagcaatccagaggacttgaagccaactcgccgatagatctcatctagttgttctcgatagggatctcgtcagtaatctcaggattctattgttctctattgtactctatggttttttttcataatcccatataaaatggattaaggctattaccttacgagggggcctaaaccagtataatctttgtttcctgtgagcttgatgtcgtatcaacatacctcaatacccttagaatacggtcggcgggtatccccccgtcgatagtttcaaggagatctaagataaggttttcactaggaaagaagatggacatctcgacaactcccccaagagtgaatacgacgcctaaaccgtgtcgttgctgacccgacaagactgggctaggctttcacccacctcctgtcccctgtcgatctactgctaccgctccattgcaccaccaccagtcacccatcataagcgccaccgacacctcccgtcgaccatcctccgcatgcctccacatgctaacatgacacacatgccatcactagcctctcgccgctagtcatgcatgcatcctcgccgttgcccgtgtcaacctcccgtgttgctggtcttcctatcatcgttagagtcaacctccagcattcgtcagcctccctgttgtcacctgcattggccacacatgacctcccgctgttgccacgcgagtggtgtcggtagtgctgtagccactcccagcagcaacctccgggaagaggagcaaccactgccacacctagtaacagctgctcctccacacacaccgtcactagaggccatcaccatgtgcttctccctcaccaccgtcatttgtcatcaccgagagctacctcgtcgggggaagctagagggagctatgctggaggccgctggatttggcagctcccgctgccacctccgagtccacttc

SEQ ID NO: 24094 - DNA, 1501 bp, Oryza sativa
ttgtttcgctgtaggttgatgcccgccttctccaataggcgagccattctaggctcagccttcatggtcgtgcacgcttcttctgtatcagaataaggcttagggaattcgattatagaatcacactcttgtacctgtgggaccttgtagagaatggtccgggatgtagaagaagatggatctggaattgcccatacctctaacggggtagaaactaaagtgtagagggctgggggctgcatgcactgagcacccgcttttaccttctctatctctgcaactctcttcttgaccactccttgttgtgcaagcgcggcttccttgcttggactccgtcttgcctgtaaggtgatggtagttggcacatcgctgttgcttttgggcggtttcttgcttcctcgagaggttgcccccaaggtgatcggtgttgaggtagagcgtcttgctttgagcaatattggtgtagtagatggggcagacgtgctggtttcagcgggaaatggaagcttggtgctgaggttggttgctgaagaagaatttccccgcctactattcttgcgattccttgatgaagattcgctaatgattggggagcatggcataatgaggcgtctcaccttaggggttgtctcggtgccgggttcaataatgatgtcggctgccggtgctgttcgcccaagttgttgcttgttttcttcaacagggaagtaatacttggcgtcggcatggtatgattcttgaatagtgtatggtgagaagttgccaatgatgcactgttgcactccattgccgtcaaggaattttaggcattgatggagagtagacggcacgacacggtacttgtgaatccacggtcgtcccaagagagcagagtatgatgtgttggcttcaataacaaagaaccgcaccttgaagctgaatgtagacatttggatcttgatagtaatggcacctaatgttggcttgccctggttgtcaaagccacagatcaccacgtctgttggctccaagtcttttgttgtgaaacctgctcgagttagacttcgaacgggtagaatgttcacagcagatcctgggtcaatgagaatccgtcgaagatgagcagaaccaatgtttccttcaatgtagaggggacgattgtgatcgcccccttcgatgatgttatctttgtcgaaacatgaattcggcaataataaaagggggtagcgcacgagacctaaaagtggatggatgcagagacaaaggatttagacaggttcaggccctctcgatgagaggtaataccctactcctgtttggggatttgaatccgccgagtgtgtattgatctaacgatcaggttgtctcatgcccctagaggggctccctgccctccttatataggttgggggcagggttacaagatagaaaccttaaccaatacggtatcggtttcctaaatctactttacaatcttatcaaaccaggactttaggccgttccataatatacagggaaacgt

SEQ ID NO: 24095 - DNA, 1501 bp, Oryza sativa
taaatgtaagctctttggcgcctgatctcaaccatctcgtttgccatttaatctaggcgctaattaaactgtcttgcagaggattcatcttaggaacgaagctaaaacggcaaccttagagaggctagtccctcatctcgggaccctcgaagccaccaggagtctgctgcacgagacaaaagagcttgccagaaaaaatgagcatgatatgaggaatcgaattgctgagctctaggaatccaattttgaactaagtggctcatcaaaaggtttgcgcaaactctgcccaactgatttgtgctgttatctctgttatcctgattaaccgaagttaatgtagtgcaagctgccaagatatctcaactagagaagcagatccaaactctggaaaatgacaaggcagagctggcaagacagagagacctggctttaaaggaagttgaaggtatcaacaatcaatacctcaaaaagccattatcctccatatgctgacttattaatgtgaatctgttgatgcaaaccgcaagatcaaatctcaagctcaatttgatgtcctagttggcaagatcaaaaaacttgaaggagcccgggatgaggttgctaacgctgctgccccaattgttcaagcgatgttcttcaataacaacggcccgagtgcacttgatgcttttgaaattttcgacaagctgagagttgcttcggatacatatttcaagaacatcaaagaagctggaagtatgggagcaagtatggcgttggcgatgaccaaatccctttatccgagagttgacgttgatgccattgatggctttgcggacgggacgagcgaagaagctgctcttgacctcatcagtgatgcgcagaaagcggctgacaaaattgctgctgatgtagttgagagatttcaggacactgatcttcgaccgactggtcctgataattctgatgatgaaaagactaatactgattaatgtaccgataattttgatgattaatgatgatggaggcacaatttgtacaatactgatgaatttatgctgtgcttgatatcttaacttagctcctgatttcttaaaagtttttgtcaaaccttgttgagcctaaacctgcaaaagttgttaaaaaactttcagtcctcattaactaagccaagaaatcaaacagggcaatgatacatcaagtaagtaaattgaattgataaaaatcacactccattattattatagtagccccctgactgaaaacttcgaggaaaaacttgaagttagcagtcaaagaggaaagatacaaacgaaatgcctaagcgtaaaatcgacgaaggtgttcaatattccaagaattgttgatgatagtaccatcttcgcgcttgagtcgataagaacccggccgagtgacttcagcaattatgaacggtccttcccataagggagataatttatgccgatcctgtgttgtttgaattttcctcagaaccaggtcaccgactaaaaaggctcgtgat

SEQ ID NO: 24096 - DNA, 1501 bp, Oryza sativa
ccctttcgcattatcatctaccgccctttctttcctcccgtcccttcacacatgaagatcgtcgtatgtatgttcaacttcggttgccggtgcaatagaattggcgggagtatattatggcaggatcagtcacctgggcaaaccaaccctcctccaagaagaattgtgctttagagtactacgatctggataatcctcctaaatttagatctatgctgctccatgcgggggaagtcgatgaacgagtagaatcatcccctagcgtaaacatgagaggaaccgaaccctatagttgtactgaattccggttgtccgctttccatttcgaccactcgctcctatgtatgaagaatggctcttccttgtcttcaccttttaaaatcgacagccttcgggctgatccacacaaggatactcacacattcaaacatcttgtagaatagattcctgttcgtcgtatatcgacacttcagaacatcttgtagaatccccttagcttctttctatatgataatttatagacactatagcaatatggatatctgcaatggaaggaaagcatttaactacctcacatctggtaagtgtagcaagtccaaatccctcatctcatacgtttccctccacctcctccgcaggcctcataagcctcgtggccagtaggcaatctctgagttgaaatcgatcccagacatccatctctttcaaaaagttctaaaggccgacaactacagggtgcgtgcgctgggactgatcgggacgacctcgtcgaacaaatatgagtagactagatctagtgtggtggtaccaaatacgaagttctccttctcattgaagacaaagagaatggaatgagtagtatagaaaaggggaaaatgaatcagcattcccaaaacaaaagtaagatagggttggcaattccactacttcaaaaggtttgtgccttcctcggtaagagaattctcaaaagctatccaaacaagaaaaagaaatacggcaccgacatttccaatggtagtcaagttcactggaataggttctttgagctatgatccaccactgtcgaatatatttttacaagtgtataaagtctagaagagggcaggggaacatactctcacgttctccgagtgggtactacactgagtaaaaagggtactggtcgacacgggtagcccatttcttgcataaagaagttctcgaacgagacgataaaatcttgtcccagcttcgaacttctctcataagctttaccggttaaaccttataatccttttggagttgacgtaactccttatacgcaaaagatcgagaggggcccaaaccaaaccgagaacgtaaacagaattcgactcactctcgtatggctcgtcctcgagccctgggcgagtcggccgggtctttccctcttgttctgtctgaatctggcgctttaggggcagaatgtgtgattgattccagcgagaatacataatctctttttccgctgcatagcccgaac

SEQ ID NO: 24097 - DNA, 1501 bp, Oryza sativa
ttgacaacatggtagccttcctcctcgaatccgtgtccggcgagatcagagatagcactgtcgaaacaagatttcggcaataataaaagggggtggctatcaagctaggaaagtggatgggtttggagacaaggaattttatacaagttcaggccttcttattcaagaagtaataccctactcctgtccggggatgattccgccgagtgtgttattgattgtatgattgggagaaaagaaatcgtgccccaagaggcacacggaccctccttatataggggaagggatccgtaatacaaagtacaatccatatcctaacggaatatggaattacagataaaatacaatcgtaaccgactaggatcccgggtattttcttaacatacaagtttagaatctaacccgagtcctcataaagatattctatctatatttggtaccatatatccagctggaatataaccgccatgtagatatggggtaaccataatctccacagtagcccccgtgaccttcgcagttgaccaaaatagtctgctcgaaacaaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcggagcacgcatggtacttagtaagatacccagccgactgcctctcaacttgaatataccaaggacaaaaaaatacaagaagggccgagtgataaacactcaaaaggtccaaaaatagatatatttggtaggaatccgagtaagaaactcttaaaatgatcccccaaatatgataaagatcatggtaattaagaagtttattagcctaggctataacccttaccataatcaaaataagcatataacatgctaggagaatgactactaataaaccagtcatctcaaattaacccaacagctcttgtagcctaaaaaagcttacaaaaatggtataacacctttctgtcgggcaccttttcatgtgcatcataataattccaaagaattattgaatcgtgttaaaaaggattttaacagcatcgggccgtgtcattgtgagcacatattgccaaagcaaaaagcgcctaagtccctagggatcacaacgggccacgctgaaaacataattgggctgaagtactgtacaggcctaggcccattagtactcccgataccctaaaaataccgaagtccaaacgtcgcttcgtcttccccgccgagactctcgccattccacactccgtgctacagtatagaaccatgccgacgaagctagggttcatcaatctgctccaaaccatcctcaaaaacttcacgaaatttctccccgtgtccaccgctccgattccccattcctctccagccatatctcggaccaaattaaaccatccagttcacattca

SEQ ID NO: 24098 - DNA, 1501 bp, Oryza sativa
ccctcctacgctatgaaggtacttttcttcaccggattcgagtgattgtgatagctgtggttgggcatccgagtgcttcaaatggcatgttgtttcttagtgcttccctgcgatttagggactccgcaatattattatatcctgtcattctttccctattgaaggtggattaacaacctttatttggttgtattctcattcatcttaaccaatcataacaccaattaggtgtggtagttggccactacttatgaaatatctcaaacccacgagtgatttatcataacaaaactgtgaggcaaacttagtaagggggtcgtgttattaagtatatttcttagctacaagcctggcctttcacttttcttagttcccccttttccaacctttcttttcctgcatgcctaaaagaaagagttagctttgggacaagacaagcaagggcgaaagcttcacaggccgtcccaactgctttacctgctgtccctactattcattcttcgccaagagagctatcacttgggtcggggcccctatttgacaagggaactgaacccatttcattgaccttcgaactgctcttgccctcccctttcacttccatagtggtcttctttggccggcccactcatttcacactcaagctctctgagaagattcaagatgtttcgaattctccttcatgttcgtgctttaagtcagttcgtacttttcagtatataagagaatgactgaactcgcgttgaaagctactaaacaacggctgacagagactcataagagggggagcggtagcaaaaatgagatctttcgtctagacagaagagagatcatttccttcctttctataagaaatgactgatgttgctaagtcaccttccgctgctcttgcgtcatcccttttccaattctttttgaaaccacttgatgatgaacgagaagtagctcgaccgtaaaggaaaggaaaggaaccctggtgaacggattgagcgagcgccagcgaggaaatctcaaagagatattttttattttatatagttattctctaatatttcaccatagaaaagtttctatttcactgccaatctgttgacaaagctcaaccaaataaaatatttttgatcctggaagaaatagtagaaattagaagaaaaaacttgatgcttgaaagaacagactcatagggtcactagccaactttcataaagaaaaggcctcactgtatggtttatgtggatgcatgatgctttctcagcgatgacctgtaaaggaattactcaggtccctctcttttgtataaccctcttctagcgatcatgtatcccgacgtaggtacaaacgtgttcgcgaacaaattcgtggagaagggtccaatagccctcgaatggaccggctacactgaaagagggaagcgaatagcctgaagattctttcctttgttgtctcactatcagagcttgcggcacttgaataagccgccgccccccagctgcgtctttac

SEQ ID NO: 24099 - DNA, 277 bp, Oryza sativa
aactggccaggaaacatatgatatgattagtattgttcctagaaactgcatcactgaaaatgtgctctcacttaatgttgacgctgtctccaaatctagcacactttgatcaatcgaagcctacatgaacaatgcaaaaatcatgtattagcaactcaggtaaagcgacatacacattacactttcctgtgtaatgcagtatatgtttacttattttacatagaatttctttaggatttattttacatagtttacacttctgagacaggagaatgga

SEQ ID NO: 24100 - DNA, 1501 bp, Oryza sativa
ttttggatatttttttactaacagattgaaaattttttaagttagatttgaaaactttcgatttaagtttcaaattttaaagtcaaattttgaaaactttcaactcagatttgaaaactttcaactcgagattcgaaaacttttaacttgagaatcgatattcgaaatctttctaagtccagatttgaaaaatttgaaaactttcgactcgagattcgaaaaatttcaaaactttcaacttacgatttgaaaatttttaactcaagatttgaaagctttcaactccaaatttaaaatgtttaagttaagatttaaaagctttcaacacaaaacatttgaaaaatacgtgttgttggaagattaagaaaaaatcatggaaaaatatttaaaaagtaatcgaaaaaagaaaaggagaaaaatcacagaaaaaagaaagcgaaaaaagaaagagaagaaacggcgatagcaaactgcgaaaaaaaaagaagaaacgcgcgcgtgctgggccatgtgggccggaagtgtgcaccggcaatgcgagcgctcaagttagcattctcgacagtaatgacactctacttttcgaggttggaacgacgagtcaacgaaatcctaatcgcaaagagccgtcctttccttcgaatcctaaccccaaagaaggtgatattagctaggatgacatgtggatcctacatgtaactcatatagtcaaccacgatcaacttgtcacgtcaacagaagccaactcccaaaccgccaaaaaagtttttggagatggcggtgagagaggcgattcaataagaagcaaacaatgagaaaagcaagatatgtttatttcgtccgaaaactgagcacggtcctgatatcttattaatacatgactaaataagtattaactattataaactcatcgatgaattagtttttgttacgagagtagagaaggataagattgtctctgtctatatcacagacgggaacgcaccactctcagtggattagttcctcgagggaaagcctggtagtagttaccattcgtcaattcaatcaaagcaagggaaactgtcattgcggattagaatcaaaagggatctctctcttaaaccaaggcatactctactggctttccctttgccaggatttcttttacgagcgctagagggacgagctagataccttttctatatgacgagagctagagaatagaaatatcatactttttgtgttggatcatccgaatttggaagtggatgcatacatgtacctccagtggcattttccttgacaatttccctcttcctcctcaaagcagttatataattaccactaccatattctatagaatacgatttgtttttctcgccgatcttcagagggcgtatgcgtgtgaacgcttggttcaagctcttcacatagacatgatcttggaagactcgttttagaccgaagcgattctttgaaccgagttctttctctttcttgcgaatgctgatgcgtttca

SEQ ID NO: 24101 - DNA, 1501 bp, Oryza sativa
cgtcttgttgtaggaaccagagcacttgttaggttggcgcgtcatacccatgggcatcggcttctggcagtaatattgtgcaccactttaattcagccacggcacatgcctcacacaaccatgttcccatttcgttgatcaactcaatgatctccttacactctcagcgcgcacacacaccacgccgaccaccatcttggagtcacctctccaaacgcatcatcacggcattgcacacacctcatctccagctttgtggtcatgtccgagcaccgtaaattaattattgttgtgctgatcagctccgtatgtgtggctcgtggccgtagtacacactgatatggttatgatcccggtcgagttcttataacatcaaacttcaagcctcattcaccaaagtcttcgtccgttgcagccagacgcggctgctacctaccatgctacggtcatcgttcggccgtcaattggtctaagggtgcttgctgatttgctagtcgatcgtgctactgagccaccccatagatctacctatatcttcagagtccatgttgactcgcgtcgtgtaaaggtggaaatcaaaccggctttgtctttttttatctccctttcttcagaataataatttattatgagctactatatttctctctatcatttgatactttttctagcgagcaaaagtacagaagcagtgcgaaaataacttcggttaagaacaaatatttttagttttaatacaccgtgcgaagcacgggcattttgatagtaagaattaaaagattagtatttttacttccgtcaccctttgattttcgtccgtagcagcatcatctgcacgatgcgactgccaaggactccgcttccttagttgctttccctcctatcgcgcgtgcgcacgcttgacgcgcctctgtgcgactggatttgaatacgagtgcaaatacaatatggaacaaacaacacgcgcttcctaagcaggccgggttgctgacactaagtttttgattgttggggttaggggaagggtgctgccggcgaggatttgatccgatgggcttaaaggagagttgacatcggccgatggggaggaggtgtgggcataagacggtgatggggacgccgctcggcgcggtgctgtgtaagatagccggtgtggtggtgctggtgcatggattgagcgatgtcctgccaatcgaggacaggagttgccacttgtcaggcgagagatgggggagcttgccctagcaggagaacgaaaatagagagagagaaaaaagaggcgagaggaagaagacgatgtggaagtcgtttgatcaacatccaacggctgagatcgtcgaccgataataatgaaaagagaaaagaatcctccgcagcgtcgcagctgaagaccggattcgctgcgtcgggctcattcggtgccgtgacccgtgatagtcgacgtgttgtgctggtatggatacacactcacaaattgtcacaatttcggactcgacatgcc

SEQ ID NO: 24102 - DNA, 1501 bp, Oryza sativa
aaaaagagccccggcccgggtcagcatagaatggggggagggatccttcacaaaaggcgaaatggatatgaaaaaaagattgattgaactttccgacggactcatgggatgagtaaaagattgaatgggattcgtttgggcaacggaatcaagtgctggtccccttttctctcttattgaattaactaattcatttacttttgacttttgttggatttttggatatttttttggtgttgatttggcattattcaacaagaataaaagaaaaatttcgataaattcctttttttaattatgagaaccaatcctactacttctcatcccatcagacgaagacgaacttgcatttgttgaataaagaaaagaagagttcgatgtaggaggagcgagcctcccccagagctttcggcagccatactttcttcacaaaactttatgataaagatggactctctttcaccgcaacttgcccgccctaacagatggaattgattcacgatcagcctccttcggacccggtagctacagcccataagcaaaacaagatttggtctcgtacgcttgctaagcaagtttcctctctttttaatttttaactgatagccctctcgttacttgaaaggaaatggaatgcatcttcggtgcctaagcttgagtgagcgcatcgcaactgtgccgatttctttcttttgttgccgtacttggtaggctccttgtccccttgatttttcaaggaactcatttttttactggctccctttcctccctatgctcccccggcgcaggcccaccacgcttcgcgcctgcggcgttttcgccagacggcacggcgtcggctttcataaagcaaccgaattaaatcctcctttattttgaattctgtttcaaaataagaaagaatcatttcttgttccataactctgtgtacactccgtgttgataatttgagacctaatggacacatcatacataagaacccgttgtcgagattccatcaatatcttgcttggcagcttcataaacttcgtcgtcctcagatcagaaggagttttgtcaaatgaaatgctggacaatctacatgagtgaaaggatgtagcattagactctttcgagcagaaggagaagacggacctttatgtatgactctggtaccggcatgataccaaattatgggctttgtgtaaatggcttcatgctggtatggggtattaccctattttactcaaaatactgtgacttgtagctcagtccaaaagcctgctgcttatggtactgctagtctgttatgtacaagtatcttaccgacgaaaaatgagagataacatgctttagtctggttcctataggccgtggtcaatgaaaacttataatcggggacagataaactggaaaaacagcaatagctatcgatactatattaaaccaaaagcaaatgaactcaaggggcacaaatgagagtgagacattgtattgtgtctatgttgcgattggacaaaaa

SEQ ID NO: 24103 - DNA, 1501 bp, Oryza sativa
agtggaggagaatcgacatcaacatagacgataaatcaatcggacggtgtcgagaattaaacttatgcatgaatgggcaaagaactcagaattgacacgatgaattgggccaaaattcacaagtctacgaagtgaagcaacggaggaggccacctgccgattttgggctaggttgggctggccttggatgtggggttggcagtgacgctccagatcttctcttgatgacggttgcggggcacttcagacattttgcagcggttacaaccgtcatacctgcctataaaaagacttcgccttctcacttcactcacacacctcaagcaatatctctctcatttctctcaagttcagtttactagtatctagctggtggaataggaatagagtaggaatcaggagtccggaagcctttgtaaaatcaaaggtgtttttgattattattctatgatgaacaattgggcattggagattattggttttgatatttggaatttattcacgaagtggttttggagatgattggatttcatagatgaatctgcaggattttatcattttgtgcggaccggtcagaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagtggttttggagatgattggatttcatagatgaatctgcaggattttatcattttgtgcggaccggtcagaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagttggagatagcttggtcttggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagtttccatatggcatacgatagagttattgtgtgcgtgtgggatgcggagtcgaatttggaaggagtccaaatttggtacgtttggttatgtaaagtttctttcttgtactagagggtttcctaaggtgtttaggactcctagtatgagtttggttcgtggctttaggctacctacctcacgtataaatagagagggagcgtgaggattcccggcatcgcttttgagagcaatatagttaagttttgagttagggtttcgagtttagtcgaaatttttgtaaggagt

SEQ ID NO: 24104 - DNA, 1180 bp, Oryza sativa
aaagaaaagatatatattgatcgaactgttaaatatggttgttttaattctacttgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaggcattcttagccgactgctttttagccataataaaaggaatccgagtggttaacactctaaaaggttcacgaatgaacacacttgacaggcatccgaatagaaaactctaaagattacccaccaaatattataaaattatggtatgaaatagtctaatagctaagctttactattacccatatgaaacagcctatacataccaggaaatgatatggtaaaaccagtattccaagttacccagacagttttggggccttaaaagcttacaaaccagattacaccttctgtcggccacttttatttgattggcattatccaaaagaatttttgacgggtaaaaagagtttattaacttgggcacattattggcccttaattgcaaaacaaaaaatgctaaatccctaggagacaa

SEQ ID NO: 24105 - DNA, 1501 bp, Oryza sativa
ataacccagcacacgtagtcataaaatttgatgacatgtaaaaacgtgctaatgtaataaataataatgttatataggaaaagaaaacctaatgaatatttgcacgtttcctattatctacgtagtagtagtttttttttcaggacctatcttaacaatataaattggtcattagtaatgacaaaagatcttcccaaagtaagtgataagtaaattaggatgtgtcatatccggtacgaggttagtttattttgggacggagggagtatataagtagtcatgaatagattaaccttaatacatagtgccctaggatttgctcaaaatttgttttttcctttaaaataaagttaaatttggacttgagatttcgtggtaatgtagttcacgcttatacttatctttataaattttttatataaatttggagaacttttagatttgattttcactggtttttcatataaattttcatgagtcaccatcgttgtcctacaactacaagcacaaatactaaccaataaattggcaattcctaacattaacctttagtgcacctacattttcctccctacttcataagaatcattaatggtacatcaatgtactttttgattgctaacattgattagatttttgttgcgttcctttcatttgtgtcgttgtcatggtcttggctcgttacacatttacattttcatacctctgtgattgacattggatcatagaacgtagtcacaacatgagtgagacagaaataaagtaatcaatgcacaaaatcttgtagaaacctaggtgttcaagaacacccgcaatcctataaagaagtttggatatggaaaaaaaattaatggtgaaaggatgctataattttgagataaaaaaaaagagccatcccacaagtctctttataactaaatcctcttatattatcctttattttaaaaactagatcttcttaaaccaacttcggtgcgagtatagatcgaataatggttttagaggattgagtggagcataaaaccgacatctatattaggccatgtttgaatccaaactttcctaattgcgattcggcgaagtcgcgttataatacccatcaacattaattgtgaaggttatctgaatgatacagtgctagtatccctcgtgacaagtgacacctgttttttattaaattacatctattttaatccatataatagaatcgccgagatcacagtcgattcacactatagcagcgcagcgtaagcctgctaaaacccacatcaaccaaaccaaaccatcacctaccaaccagtgtagtaaactcgtcggctactcgctactactacttgctcgagcaggcgtacgatacgattacaacgcagcacgcacacgaggcgagcaaaaggctccaaagcgaagccagctgccaaagcggaagcagcagcgcagcgccccatcacacacaacacaacggcatcctactccctccccccctctctctcttcgctcttcg

SEQ ID NO: 24106 - DNA, 1501 bp, Oryza sativa
aaccctccaccatttacttttcccacctacctccactacttatccaatcacaacccttcaccatttatttttatctactttcttaataatcacgtccaactctaaaacttcttatattctagaacggagggagtaacatgaattaattcatcacatattccgtagcaaagcgtgtggtatcaactagttttagctaccaatctaaccttactattttgagtttgcttaagactgaccatattccataaaggcaagataacatcgttaactaaaggtaaattgccatttttgctcttagtcatatcaccctgttatatgaaagatttgtttatttggaaacttttgacatatttataacaaatttggcataactttgaaagacttaagacaagtttggcatatttagcttcatttttgtcaaatttgacttcaattgatgcttgcctggccaagccagcaggggttttgcttgtttggtttgccatttccgcccgacaggaaaaggtgttgttgggtttcagattattattgctcacaagtgttaattggcaagcttatacggttgtgctgttgagggctatgtcagggttatgaataccacatacctaatagtagtcgactacatctcggcagggcccaccacataccatgtcctatacgaaaacaacctgcggatatggagagagttccggataaagaaagacaaccagagttctacatggaaacgaccaggactactcggattgtatccatattggtttccctagttctacttggacaaggggacacctataggtataaatacaagaccccctaaaaagagaggggagacaagacaatcgacagacgatcaacacgatcgagacccaccacaatcaacaaccaacacaatacacgagacaacatacaagccaacgtatgccaagacacgccgccggatatcaacttcagggataggcatggctattcccctacggtgtctccggataccgtcaggagagacgaaagcgcttgtggagattatggttaccccatatctacatggcggttatattccagctggatatacggtaccaaatatagatagaatatctttatgaggactcgggttaggttctaaacttgtatgtcaagaaaatacccgggatcctagtcggttacgattgtattttatctgtaattccatattccgttaggatatggattgtactttgtattacggatcccttcccctatataaggagggtccgtgtacctcttggggcacgatttcttttctcccaatcatacaatcaataacacactcggcggaatcatccccggacaggagtagggtattacttcttgaataagaaggcctgaacctgtataaaattccttgtctccaaacccatccacttttctagcttgatagccaccccttttattattgccgaaatcttgtttcgacagttagcgcgccaggtaggggcagcgtcaagttctcgccgactaagtgcga

SEQ ID NO: 24107 - DNA, 963 bp, Oryza sativa
cgatccccccccccccccgcgccccacctccctctctcggctcggtttgtttgtttgtttgtttgtttgttgcttttccctgtcatgtggcgtgtgcgtatcggtggagggggggaggtgaggctgctgctctgattcgttgtttgatctcgtgtgggagtggatctgagctgaggatgaggatccgatcgattcgatgagcgtttgcgctatcggaatagaatagaggcttctccatcgttgcaatgtaatggatcgaagttcatcagacaattatagtatcgtgttcctaaaaaaaattgaggaataatctattcattggtctacgaaacaaagtacataggctgtaattacgagtgagtgtttttttttcataaagagcaaaatttattgttgctgggacttttatctggaattgttagcactcagcagaagcaactgcatacccttacaattgaactaaggtagcactgattccgttagaaaccaccaatttggtttgaggagaacggagctcattttatgcttggttaatgcgcttacgggaactggggatagtgcttgcactgggtttgcagaccattgtttcatcaaactaacccagtgctatttgcagaaaccaaatggataataatggatcatcgtttggcatatttagtaccagagcacttccgatgcatttcttcgtattaatgcgatatacagtttgcttgcttttacactttctgggtttgtttctaatctcataaaaaaatatgcatgatattagttggagtgctatgggatcagcagcttttagtttcagaatttttctacctgctacccttagtcaaggctagctcaacacaatttatgatatgtggtgcggtgctgatttcatgagcatcatgcccattcttcatttgccatgttggatggtagatacaaattttagttttgtttacgtgttctttctttttcagc

SEQ ID NO: 24108 - DNA, 1501 bp, Oryza sativa
gctttttgctttggcaatatgtgctcacaatgacacggcccgatgctgttaaaatcctttttaacacgattcaataattctttggaattattatgatgcacatgaaaaggtgcccgacagaaaggtgttataccatttttgtaagcttttttaggctacaagagctgttgggttaatttgagatgactggtttattagtagtcattctcctagcatgttatatgcttattttgattatggtaagggttatagcctaggctaataaacttcttaattaccatgatctttatcatatttgggggatcattttaagagtttcttactcggattcctaccaaatatatctatttttggaccttttgagtgtttatcactcggcccttcttgtatttttttgtccttggtatattcaagttgagaggcagtcggctgggtatcttactaagtaccatgcgtgctccgctataaaaccactcggttcttgactatatgtttagtttttcaactaatcacatagtcgggggctacacctaattaggtgcatctactcgatgcaccatgttttattttcgcccttcacagtcttttagcactcggcaagccggagcaagttgaattgaagcactcggattatttgtttcgagcagactattttggtcaactgcgaaggtcacgggggctactgtggagattatggttaccccatatctacatggcggttatattccagctggatatatggtaccaaatatagatagaatatctttatgaggactcgggttagattctaaacttgtatgttaagaaaatacccgggatcctagtcggttacgattgtattttatctgtaattccatattccgttaggatatggattgtactttgtattacggatcccttcccctatataaggagggtccgtgtgcctcttggggcacgatttcttttctcccaatcatacaatcaataacacactcggcggaatcatccccggacaggagtagggtattacttcttgaataagaaggcctgaacttgtataaaattccttgtctccaaacccatccactttcctagcttgatagccacccccttttattattgccgaaatcttgtttcgacagtgctatctctgatctcgccggacacggattcgaggaggaaggctaccatgttgtcaactacgagtcagacctttagactgtcatgtcgataacagttagataggctaccccacatattgtactggtgtgattatggtgaataaaaagaacctccggctccggccaataggatatagggttattacctaacaactcaggggcccaaacctgtataaaaatccctgtctccgtttcttttacctcagtctcgcgtatatcctagcactgacgatcctcatactatgcaaataccagaattacgacatcaaacgtcgacagtggcgcgccaggtaggggactttggtgcttcagggtttcgacgagatgggtttaagaga

SEQ ID NO: 24109 - DNA, 1501 bp, Oryza sativa
aggtgggccccatcctaatactaatgttgtaacacatctattccctcaacaaggcactatccattatattggatatgcttagatgcccatgccatatggagaacacgatcgttcccatagagggtcacatgggtagctcctatgagctatcgctcagactagtccctactacaacggccttccaatgcaatgctaaacagtaaacaacttagtaagccaaggttgccccataaccgacagatgtggttgcacggtaagcttagttggtgacacatagttcggtccttaattgactcgggcgaacactccccctatcagcgtagaactatcaccatatgcacaccacttgccgcccaagtttgaaatcatcattttcagtttccaattttcacataataacagaggcaaccgctctgtacaacattttaaaataacccatttgaaagagttaatatcatgtcatttataaccatagcaaattttctaagcatggctaagcaatagctatagtagtagctcgaatatacccatattggtgcttggataggaccacaacccatcctaggtccatcaacaatagggtgatcaataatcaaggtggataatgcaacaattaggagttgttctaccaaagtcccacatttttgcaaacaccgcatgcaattttaaacataataaagcatttgcgaaaatatatgattcaacatgatcgaaggaggaattgatctaatagtacttgcttgctcaagagttactcgaatatttcttgatcctgcacactcccatcaacggcaacaatcgatctgtcctctatttaaatttaaacctatattcaaatgaaaatccaataaaactccaagataaaatatcatgcacggtgcatgaacatgttcagtgtatagatgatggtttaatataaatttaggagaaagattcgcctaaatccgatgttgaatgtgcaagttatcacgtttctaagatattaaaatacggtacgtactattcgaatttaaattagtgaatttttttacaacagtgattctaagtttgagtgtgcagtattaaaaagagagttggaaactaacaaaatctggttcacctcaatcggagctaaaatgaattttctatgattttccaaattttcagcattttatagtgcataaataattaacagaaaatcttttctcagatttaataatttgtttataaaagaaactaaagggcactgcttgaagtacgttttcctatagggaagagaagacgcatttctgttctgtatatctctactctacttttatttaaaaaattcgtagtggtgatggtgaagcacatattttcccgacatgcgatccaacataatgtacatcgacacgcttcagagcggcacactactcctccgcatccctctgcaccacccacgcgcgattcctacggattgctcgcaatccgcaatcagcgggaaaaaaaaacacgctagcgccgccccacatcgccgcgccgc

SEQ ID NO: 24110 - DNA, 1501 bp, Oryza sativa
aacctgtagataggggtggacagaataagaccgagaccgagaaagtcggttagtagttcggtcttagctattgaaagaccgaaatttattcgggcaattcagtcattagcctcggttgaccgaagctcaataggccaagtaaaccaaaccctagaggcactcagccacagaggaaccgcactctccctgtctcccacaggccacaacgccgcgtcgccgcctcgcccatccatcgcgctcgagctcacgcagcgtggacccgcggtcacgtcgcctccgcctccatcacaccggcgctgcctccaccctccacctccatcgcgccgctgcgccacctccgccctccagccagcctgcctccacctcgccgccgcctccaacgacatcgagcccacctccgccttgatgccgccatcgcaccaccttcatctccagccagcgcgcctccgcctcggcgcctccatcccgccggccgcctccgtctccatatggcaggtctcggtgtcagcaggaatagggacaacaggagatggcaggattgcatctggtggagatcgacgggatccaatcatgaagcttgatttgccttttcattttttttctctctgaatctttttaatttgctagtcgcgtgtgcaaattctgagatgcttcatctatctattgatctattgagttgcttttttatttgtcgaccaaatatttgatgtttgttttttgtgattttttttgttttgaccacagatcatacatataatcaataaataacatcaacactttatatcaatatatactagcatatatctattagtccacatggccggcaggggtgaatccaaaggtgggtaccggaagggggtcaagccctccttccccgttggatccccatgcaggaggggagaggaagacaagtagggggttagctagaggagcaagaagaaaatgagctccctcaaagtaatcttggatcctttcctgatgaaaagaatacaatattaccattcatccactaatcatcaccttagacatgcaaaattatattgattagttttacttaggtctacatatatagtgaacggggacgaaggatcacttgtgtcccaccagacctgagatggggacttgttctgttgttcccccatttgatttttcatgaagaatcaacttaaccatccctatacgaatggaaaattttcccttgcgaaaacgtggaatagggctccattgacatctctatctttgctagtgaggcccaagtgcacatcaaaagaaggcactagttttttgacatgaatagcaagggtgcgtttggaagttaggttcacatcttctactctctctcgtttttccgcgcatctgtttttaaactgttaaacggtgtatttgttaaaaatatatatatatgaaagttgttgtaaaaataatatcaatctatttttcaaggattttgtaagttaatattcaattaatcatgtactattgagccaccccgttttccgtg

SEQ ID NO: 24111 - DNA, 1501 bp, Oryza sativa
caatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttcgtgaataaattccaaatatcaaaaccaataatctccaatgcccaattgttcatcatagaataataatcaaaaacacctttgattttacaaaggcttccggactcctgattcctactctattcctattccaccagctagatactagtaaactgaacttgagagaaatgagagagatattgcttgaggtgtgtgagtgaagtgagaaggcgaagtctttttataggcaggtatgacggttgtaaccgctgcaaaatgtctgaagtgccccgcaaccgtcatcaagagaagatctggagcgtcactgccaaccccacatccaaggccagcccaacctagcccaaaatcggcaggtggcctcctccgttgcttcacttcgtagacttgtgaattttggcccaattcatcgtgtcaattctgagttctttgcccattcatgcataagtttaattctcgacaccgtccgattgatttatcgtctatgttgatgtcgattctcctccactttagtgtcattctctgcaaaaggttggtatacataatactagtgtaatattattattctaacatatttatgcattgcaagtatcactagttctcctctattttggtaatattgacggtcaaaactgattgataacaaccatcagcaacatatttcaccaatactagtggatacgattagtaataatccctaccactaagttggataccatattttattccattatatgcaagcattgacggtcagatatcatgatttaagaaccgtcaacacccgcgtcaaacacttggcgagcgtgcagacggactttgtcttcatcgagaagaagacgcattacatttgggccctcctataagactcacaacttacatgtcatcccttttaacataaagactccacctagtagagagttatactcttttttattagcattagtgtaatttcttgccttgccctatccctctcgcccaggcgcccaccctttgacct

SEQ ID NO: 24112 - DNA, 1501 bp, Oryza sativa
tgatgttaatgaatctagcatcaatataaatatgagaaatgttagaatgacttatattgtgaaacggagggagtagtataggagatcatagctgaggttaattacccgtttcagttacgacgtagtaactgcggcgtactgatcatcagcgttaattcgctgatcgatgcatccatccgaggtactacaaaaaaaattgtcccggcaagaatgccatgaatgagttctgggtccatcttgtttttttggtcttggacccgcgtgtagctctggcaatgggactacatgccaactatacggatgcaaatgcgagctgaataataatgcccttccttgtacggtttggtaaggcaatttagtacggtttggtcgcgtcgtgttcggtgtttatcacacggcaaaaataatttagtacagttatattgtttgtaaaaataatatctctattattataaaaacacggtttgttctctcctttttcctgtcaaattatggacacaagtacacacaaccacccattctcaataaaactagaaaaaaaaatcaagtgggttggttaaaaaaattcagaaaaaaacaattaattgttttttttaaaaaaattgaatcatgtcctatttttaggctttttaggcccttgcaatgtatcccaaataggactgtgcatcctcaaaaccgtacttttgccacggttttgtttggcgttacagttagctatgataatttactagaattaatttagatattttatagcttcattgtttcttcagcttatctgccgtaaccaaaatttaaatatttaaagtccattttggtttttttattacggtttatttttttcattaacttttaagtcattaacaacacatatataaaattttgactcacaaattagtttttatcattaataaatgttagtgcctacaatcatcttgaagcgaaacgatggggctataatatgttttgcaaactgtttttctttattttaatttgcaagctagtattattatctttcgaagatatgaacaaacagtagagagagatgacaatattttttaaactttttttaaaataaattctctcaaaacttgcatccagatggcaaccttttgccatggtaaaaggatgctgccatgccgttaaaaaccatgggcgtggcaccaatttgaccaaaagatctttttaaattaagtttcagaagttttatttttaaaagtttaaattaaaaggttttttttttttgaaaagtactagcaatagccctgtagcatggaggacccctctgccgctacaacataggagcgacaaattgccagttcaactgaactaaattaccctttgaactcaaaatagaaattgcttcaaaggtcttgatataccactgagaataatgggcatcttcatggttatttcaattcttttaacaaagccatgccagggactgtactatcaaacaaacaaagtgattttatagactgattatgaggggtaaattatacat

SEQ ID NO: 24113 - DNA, 1501 bp, Oryza sativa
ttgacttactactactgttccctaatccctctcctgttctccccaattactgttccttctctgtcttaatggatagatagatggattggttactccttttctttcgcctgcctgctaccgtctgcattctcacaggctggttggatgcatgccatgatagaacaggagagataatttcaatttactaacaaataacatgcaccgcataatttggagaagtttcttgtgttaattttgcatcaatcacatggtatgcgttctccacataaacttgtaatggtttgcacaaaaataattcgcactagccctcaactccaagtcgactacctgagaatatgtcggagaagcagagatagttatgatgtcctgagcattttatacattatgagatccagaataagacacaagtagtcaagcactgcataggtcacatgatgaggcaatttaatttaattaccctgagatctgaactataggcagatgaactaaacaaatcaggcttacaaaacattgagattatcttgcagaacatttgggaatggtaacaggacatggaggttgatcctataccaagacaccatgtatatatacatatataaatgatacaccaccaactgcaattctatcagtcggtttcatctgaattacactgtgcaatgaatagatatatcatatgtatgactcatcatgctcacattttttctccattagtgggccgcttgttaataatatataagttgatgaaatattgttaactctcactgatccatggcatcaatgatctgtctaatactgcacgagcgactgttgtctgttgctagggcagctggtagtcaatggattgttcactctccacaaaacatgttgagttgagggcttttatgatatcttgcctttgttgatctgttcctacacaaaacaacttgaaggtcctatatgtaagaaaattagcaaggattgcttgacaattgttgatagccttatagctcagggcagaaagttctggcagaaccttatattcaagaaaattagcaaggatctcttgacaatctttgatagacttatcgctcagagcagaaagttctagcacctctacttctacatccattgctgtagagtagtttccttttcatccctgcagagtgtgcacagagattctcaaaagtcaaaatactgttctgtacttctgtgacctgtttttttgagtgtcaagctgccatgcaggagttcattagaagcagaaccatcatgctagttggactagactctgtttgtagttgtatcgatggaaatatatgcatgaacaccctttcgtccacatgtctttggttctcaattaatccattgtctattatcatgtttggcaccaacgaaaataagctatactaatatcttcttgctaatttagctataatattattctgacaacaatccatattttaaagctatggctataatattctgacaacaatccatattttaaagctatggctatgtgttt

SEQ ID NO: 24114 - DNA, 210 bp, Oryza sativa
aggtgctttgatgattcttaatcttgcatgtcctgcggccgactctagaggtattcactatagttggaggttgtgttgctggaatgctgatggcaacaacgcccgtgcaggctccccattcatctatttgctgctatcactttgatttcagctggtttgtgccctaaactagcattttctttggccttctgttacattctgttttccagg

SEQ ID NO: 24115 - DNA, 1501 bp, Oryza sativa
aattcatctactattctgaaacattgtaggagctggcaagtagtgccggcgaggatgtcgtttttgctatgaatgcattcataaagcgccttttggctgtctcagatcctgcacagatgaaggtgagtgtttatttacttctttctgtgttcatgttaattgattttgttcagaaccatgcatacctccattttgttgaattgtgccactcattcaggtttgcttccattccatttagtattttctgataggaaatcgcagcattttataaattgttccccaagtttggaatgttactgcaccttaaagttagtcactttgttttgttttgttttgagtgcagacaacagtttcagaaacaagtgctaatcagctagccaacttgatgttttggttgatgattgttggctacagcatgcgcaatattgaagtgcggtttgacatggaaagagtattgggtgctgccccaaagataggggaattaccacctggagaaaacatatagcagggaggaaaggggcgtaagagtggggaagtgatgattagttaaaatctagggttactggccggccaagataactgtatttgcgtggtcatattattttgagtggaatggattacagcatttgtgcaaagacaccaatccacattttgggaactaagatgagatgctaggcatagccatttctgatatatttctcggggaggtatagacgacgagatacatagaaacaatagaacgggacctgatgctgtagttttgcaacctgactattgttggtaaaatacaatcaaggcaactcatattaccatattgtactcccatgttgtatgtctagttcaccaatcaagttgagtctgatgtgagtttgtttagaatcttgactaattttgctacatgacacataagtttgtgtaatttgatagcgtacatcgtaaaaacgtgttatggctgttggacaccttaaaaaatgtgttccttgcacaggaaaaaaaattcttttgaatagatattgatacaaatacctcgaaacgggttgggatacatattcgttattactatagataagatcttttgaataggtattgatacaaatatctcgagataggttgggatacatatttgttaatactatagatagagtatgattttttttcatccaaatagataaatctctaaatataggcacttcttttttcttcacttttgcatttcttaattttgtattctgctattctgacaaatattttttcattcttgcttatcttatcttactttcctagttgttctaagtaatacacgcggtacaaagttcgtgctagggaatttctttgagtcatcatgtttttcttcatacaaaaaatgaatatgtgatttttcaacgaaatgaagctttttttttgcttagcctatctgaaccttttgtataattggaattaattaaaatataataggtattttgtttcgtctagaaacatagcgtaaaaatattcctcgact

SEQ ID NO: 24116 - DNA, 1501 bp, Oryza sativa
gttcttaaatcatgatatctgaccgtcaatgcttgcatataatggaataaaatatggtatccaacttagtggtagggattattactaatcgtatccactagtattggtgaaatatgttgctgatggttgttatcaatcagttttgaccgtcaatattaccaaaatagaggagaactagtgatacttgcaatgcataaatatgttagaataataatattacactagtattatgtataccaaccttttgcagagaatgacactaaagtggaggagaatcgacatcaacatagacgataaatcaatcggacggtgtcgagaattaaacttatgcatgaatgggcaaagaactcagaattgacacgatgaattgggccaaaattcacaagtctacgaagtgaagcaacggaggaggccacctgccgattttgggctaggttgggctggccttggatgtggggttggcagtgacgctccagatcttctcttgatgacggttgcggggcacttcagacattttgcagcggttacaaccgtcatacctgcctataaaaagacttcgccttctcacttcactcacacacctcaagcaatatctctctcatttctctcaagttcagtttactagtatctagctggtggaataggaatagagtaggaatcaggagtccggaagcctttgtaaaatcaaaggtgtttttgattattattctatgatgaacaattgggcattggagattattggttttgatatttggaatttattcacgaagtggttttggagatgattggatttcatagatgaatctgcaggattttatcattttgtgcggaccggtcagaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagttggagatagcttggtcttggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagtttccatatggcatacgatagagttattgtgtgcgtgtgggatgcggagtcgaatttggaaggagtccaaatttggtacgtttggttatgtaaagtttctttcttgtactagagggtttcctaaggtgtttaggactcctagtatgagtttggttcgtggctttaggctacctacctcacgtataaatagagagggagcgtgaggattcccggcatcgcttttgagagcaatatagttaagttttgagttagggtttcgagtttagtcgaaatttttgtaaggagt

SEQ ID NO: 24117 - DNA, 641 bp, Oryza sativa
cgtgctttactaatgagcctgcgaacgtccgaaacgcgcgctgagttgacccgttggcgcgtacgcacacaacagcaaatccgtatgatttcttgcaccaggatcctgataaaagatgtaagtatacaagtggatcacccgcgaagctttatagattaaattaaataaataggcaacccacggccggttcccgtcgtcaagttggttagtaagtaacccgtggattaattcataggttgcccactaattttgtttaagtgggtacactaattttgtttaagtaattttgtttaagtgggttcacggtcaactcacttcacagattcatcttgacttcaaagtaagacttcaaagtaagaggaaccgtcacatatcatgaaaaatttgcctcacagcagctactgtacatatctgcttcgatctaaactgctcatcgactcatagagtcataatgcagtcgtcctactgctacaccagggcctcaaaagaagaacaagatagtgatccactgcatttgcaaaacagttttcaggtaactgctgtactgattttacacgcgagaagatttcaagccatgatgcatctttcacacataagaagggcagtatcccactgggcagttcatcacaagaccatataca

SEQ ID NO: 24118 - DNA, 1501 bp, Oryza sativa
agaggacctagtgttgttcgctacactgcagtcattgctcgtggtagcgacgtcgtcgcttcggtgctaaagagagtgcaagaaggttctggtagcaagctgctagaccaagagtctcgaaggggggtatcttcggtcccggtttcactgcgagctcaagtccgtatcatcaaggatatggggattttgcaacaaggagagctggtgggcaatgatgtggttgctgatcagtacatcaagcactttgaggctcctctgccgatggttgtggtgaagggaatcgggcactcgccaggatggatggaggcacgcctctgccacctgatgtggcaggggagaccgatggcacgcagccagagtggtctgattttcttgcttgcattcgaatgtggcggctccctgcttagtgctaatgtacccttgactctctgtatcgtttatggtcctacataccccctaccagatattagtgctgtcggtgttgatgtttggatgcttagcatgtccaatgatgcctagtcttcagctaggctttagtagttcatgatggttcgtgcacgacaggagtagttattttgggaaaattgtaaggaactacaccaccccatatgtattgtgtaaggtggtatctcttgttttaatgaattgccattggagaatgttcgatgttcttgtgatcatgcataggagatacatgttgtttcagaaatgatggatggcttaaaaatcttaaattggaatgtcagggggctcaacaacccagaaaaaaagcaggcctaaaacgtgattgggacgcgcgtggctgatcactaaatagcaattttgcccatacgatggtcgtgactccaagcgtacctcacgctggccggtatccacaactgtgcctcgcttggctcaactcgtgcttcacttgtgggcgtggctcccagaaccagaaccacaagcagaaaagccgagccaattggtactccgattctccctacaacgccgccgcctcgatctaccgatctccctccctcattagtcgtcgccactgatttgccctttggtggacccttagcactattaagacaatggccaaagtaatgcatgaggtcttcgaaccaatgctgtatggtgggattcagtaccattgtcttcatcatcatcaggaccgaagtcgtcccgctggacacgatggatagcatgcagtcatgcaataaccatctcagccatggcactccttgccatggtcgttggactggcctgccccgcaccaattgcctaatgggactcctttggacgccgcttccccgataaccattgttgcccaagaccgacatccctcacagtgattccgaccagcatgtgtagcccaccgcttttctgctaaccgtggactacaaccgggcaccttgctcatcgagattagtttgatatgttagaatagctagcttgctccacctttgtactcggtgtgatacatctcaaatgtatatatattcaccttctcaggagtcta

SEQ ID NO: 24119 - DNA, 782 bp, Oryza sativa
  unsure (1)..(782): unsure at all n locations
atttttaaaagaatggggggctcctttntttacccaagggaaaagggtattttccaaacatttattgggaacccggtttttcccatcccagtttaaaacgcggcctgtttttttaaccctccattaggggaatttgggcggggcacattttttttttaaaaaaaacaatgtatttttttgggccttttcccaaaatcatacccaaaattttgtgggtgttttttgaaaaaaaaaaggtttttcaattaaaacagtttgtaaaggggggaaaaaccaaccaatttttggtggaataccaaattaaccggtttgttccatggaacccaaaggcccctttgatttaaaaacctactttttgggaaaactaaccagggaagcactttcaggtttaacaaaaggttgaagaaaggactggccctttatgtataacatttttcatatgaaactgacatgcagttactgcagaatattttaggagctttcatgtggaccattacgttgtgttttcaacattactatttttattgctttatattaggagtgttggtagtagtacaattataagctgcctaatttagctcaatgactagcatctacttaattagttattcattccatttatatgccaagccttctaataagctgtatcgtatacttacaccttcctgttatgcttgaattgcagcctttgtttgtttgatggcctcacctgcatcaccgagagagttcactcaggaagctgcccgtcagtctctgattgcgatctcccggtctgttccagc

SEQ ID NO: 24120 - DNA, 1501 bp, Oryza sativa
ccctggcataacgccgggggctactgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggaggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgttgccggaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggggggttggaaggggggaggatctagagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaatcggcaaaggggggcctgcgcggtctcccggtgaggagccccacgctccgtcaggcggatctactcattaggtggggtgggtcaaccctcaagaccccccttacccccttatagtagttatgggccatcaaatttagatataacaaggtgtgaacacccaacaaattgagggagttatgcgaatgaactattaatatgatatctgttgtgttcgaatgctcttatcgagtgaacatctccgttctccgccccatctatattttaaagctacgtccgtcactgaatttag

SEQ ID NO: 24121 - DNA, 280 bp, Oryza sativa
agccctttggggtgggaacaatgttgcacaacgcacaaaaaggaccctggttttgaggttcccaaggaagggaaaaatttaaatgcaaattgttaaccataaaaagttccgtgtaaaggtttaggaaatgtttttttccaatttggatttcccttactctaaattaaaatttacccgggaaaggtgttttccccttttttaaaaaatggggccaaacaaaggttaaggctcccatttttaacagagaaaaaaacctttcccccgggaaaatgattctttt

SEQ ID NO: 24122 - DNA, 218 bp, Oryza sativa
tactctctccggcctaaaatatagatagcaatgtactagatgtgacacatcttagtacaacgaatctggacagggtagaatgtatcacatctagtatatagttgttatattatgtatatagttgttatattttgagacggagggagtagttcgcaccactcgatggaagacatttcaaccggccagttccgctgttccgtgtcagtgaagataagcta

SEQ ID NO: 24123 - DNA, 623 bp, Oryza sativa
tcttgctctctttacgtccacgttcatttcatgcatagaagcgtccttgtgtacaatgccgcaactagggtccttcatataggggatatgcatgccctcaacaggtcctccacgtggacctagttagtgtataaatcattggtagtgcgtcacattgtcttgatgcgcagtgcaggtctgtatgcccgattcaataatatagatggtggtacagcttttcagtccggacatcaagcgccggtcacaccatccctcacccatgatagttcgcgctttggacactacggtcaaaccggcccactcttagggctccgagtattctatggagttttgagctgtctctccttctctaatcgtagctacctattttgggtagtttgacatgccctcgggccgatctgataacatatgtgaatctgcaagcatacaacatgtttttggccgaagaacaataattcagccagggaccatagttcatcgtaagggtcgcgactacccttaaatatttattggtggcccgcatccccttaccgccagcgaagatacaataccttcactggtgtgagcttaagagagccgcaagagaagatatcctatcttcgctggcggccttcttaagtaga

SEQ ID NO: 24124 - DNA, 465 bp, Oryza sativa
cgccccgcaacggcttgaggacgagcgagaaagagacgacgccggctgtgttggccttgacggccatggccatggttgaggcggtggcgagtgagaagctcggcggcgccggctccaggaggaggcggcggacaacggcggctagggcggacacggcggccccctccccttcttttcatgctgatcttggtgtgtccttcctcttcttctttgttcctttgatttttttggttcagaacaattaagcaagcatttccttttattaaaaatgtgtttctctctcttttattggctttctgagcgcatctgttgctttttttctttgagattagtttcattggtttaccctgccaagtatacatgttcttccatctgttcagttcttgttcttccctccccttttgattcggctcctgggaattttcttatccctgcgatttttttttaccgtttgcttgcacatca

SEQ ID NO: 24125 - DNA, 1148 bp, Oryza sativa
agggcaatttcttccacatgatgtacaacatcgcattgattaatcgatttctcacttacataacttgtcaaaacatattgatttcaataagtgttaaaggacgtgaagattttccttgtagctgagagttgtttttcaagccggtcttgcacaattttcaaaacgaattaaatccgaataaatctgacctttcgccgcccatccttcttgatcgatctcctaccttttttttctttgttttttttccaatatacctctacgagattaattaattaagtgattcagggaaaacaatgaactgaatttttctctgcaaaaacagcatttacagagccataaattggatcgaatgagacaaactctatccaccaaaacctgattgggatcgctgtgccgtccacgtgcacgataatatactcaaagttgcattgagcattgagggtcaggcgtttgcaggtttcagaagcgcatgcatgcgttgcagctgctctgattcgaatgagcgaaaaggcagcacagcacaggaaaacccccttgaagtccacaaaatctcgaatcaatcggcgcaaacatatcgccctctgatcaaccgatcaatctcgcctctgatgcagcttacattgctggtcctatcatcccaataattgtttcaattttcggcagcttttgtgcgatagatagatagatagatcgatatgtaggggaccgcgagcggctcgatcatatcatatcgatcggccgggtactgtcactcttttactccatttcactggtacagacacatgtgaactgatcaactgaacacaagtaaaattaaaatttaccaaggtttcaatcatgcagatggtgatatgggcaatatgtagatatattgttgaaattttgatcaccaaggacacgtcctgaaagtgagcagagcaggacgagacagtggtggatttatatgcagcaaccccacacgttttcgagaaactttcagagaaataggtgtttaactttaacaggtcattgtgatcagtgatcttacacccaaattaatacatcatacaagattttcatgtcattgaggccttatgctgcctgttattcctaattccttcccatgtagtactactggatcagtactccttgagtaatagctagtagca

SEQ ID NO: 24126 - DNA, 834 bp, Oryza sativa
ataatttcaaggttttctcttttgtttttctttctactactgccagaaatgttcagagttagttttatattcagaatcttgtaaatcaagaaacacctcactctccccaaaatctaccttttctctgtcttcctcatttgcacactaacctcaatatttatatccttgtgtgtctcctgcatgtcagaacctttttctcaccatgtcctgtgactgaattccttacccatcatgcatctaccatgtgtttccattttatcttgcatatgggatctttcagtcatcttctgtctattcaaactttctgactgctccttatgttatgcttttacaatctatagccactcttgtctgaagatctcacacactttcactgtttatttgttcatcagttctggaacagactcgcaagtaacctccctccctgacatatatatactctgagacttcttgcatccatgtcacaatccttattgactggctgcttgtcttctctcttattctcctcattgactggctgcttaccttctctctaattctgtcttatgtttgaagttcctttatgtatgtccctcctcaaaacattcatccttgaaccatcctttttctaacacttcattcagagtaaaaacagattaatacaaaaaaaaccttttagggttgtaagcaccaacttcaaagctagcacacccaactccatcattcctactttgactctaatggtattgctagcttcatatctactttcattactggccccaaatttaaacctacttccattaccagccccaaatttgaatctattttaaaaagagcttggtaatttttcatctc

SEQ ID NO: 24127 - DNA, 1501 bp, Oryza sativa
acaaagagctggagagccagagagctcttattctaaaaaccctcttctcctttttttttctctcgtgggatctcctctctagatcctccccccttccaacccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttccggcaacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatggtgatggcgctttggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgtcctaccttcgccacacgcgctcgctctcaaacatctcttcttccggcgtca

SEQ ID NO: 24128 - DNA, 1286 bp, Oryza sativa
tgggtaggggggcatgtgaggggagcattttagttattacgcaccctggatatttttttaaacaatcataattttacaaaacaaagaatctaccgtcatataacaaagaaacttcctttcaaatattgcactattttaaaataaattttacacatttatattctgtacctattaaacgcactcaagccgccaagtgatgctctaataaaatagagaaaatcctagaaattctaagaaaaaaacaaaacatctaccccttgattttcacttaaattggtgagtccaatattatacaccattagatatatcgatcttaaaacaaactaaatatcatgggtcccacctatcctcctcccgcgcgttggtaggtggcaggtggagtatatacgtacgtacatgtatgtatgcttcctttcttttcctttttttcctttttacatttatatatatataatggatatattttttaaataatcataattttacaaaacaaagaatctaccatcatataacaaagaatcttcctttcaaataatgcactattttaaaataaattttacacaattatattgatatgtacctattaaataaacaatatctatattaattaatttatacatgcacataaactgatggccccattacataaatcatcagatctacttttcattaccttggtctattattcactgtttcaaaataaggtctacaccattatattgtgtacccattaaattaacaatttaaaatctatattaactaatttaacttacactagaactggtggacttattattataatcatcggatctattgtttgctaataaataaagtgtccgaaattctctttttgcccgctgcacaatacacgtctgcacctttgcctttcccatgtgtgacaaagtgtagtgtctgagacatataaggtgatcacaaccgctgtaaagcttccaccttgccacaaatcaaatcatatatggagatgattaattttgttataacatgaaaagaaaattaaatgtgtgatgcagtgagagaataattaagtaccatggattgtgtttttctcaacactaattagctctatttaaattgaaaccgagagttgattacataataattataatgtatctgtgttatgtcgtatttggattttgtactatttgttcgtataggtgaaaggaatcattatgttataaatatgagcgcaatattgacgaatattaatagaactcttactacgacaagggtgataaagggagtttaaggccctctctttttttccc

SEQ ID NO: 24129 - DNA, 1501 bp, Oryza sativa
ctcccacttcctcgtccgctcagccaaacttttgactgcacggcagtccgcgaggtcgtgaagggaggtgttgtggacggtgcaccacttgccggttgggcgctccctgctgggagcgctggcctcctttttgtcgctcgcaggcctcccctttcgggtggcccgtgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcaccacaaaggctctacagccgacaccaccaaccgggggcacggagggctgatccccgcgtccgtgttgaggtgacactccggacgaggaggcgccctccgttgcgtgggcagcacgtcggccattacgccggcgctcgatactgatgcgggcatccggctccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatttaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaggggcggtggagtacgagctcgacggcgtgggttcggctccccgtcgtcaccgctaacactcggagagaggttgtgcgcctttgcttgttcggcca

SEQ ID NO: 24130 - DNA, 1501 bp, Oryza sativa
gggtggcggaggtaggcggtgcacggtgggggtgcacccatctcctcgaggatgccgccgccgtagttcgggtaggcgacagcggagtctttgtgaggggcggcacgcacgaaggggtcgcaattgtagcaccagtaggaggaggacgccggcgcagcaccggcagcggaaggggaggaggagaaggaagaggaaggggaagaagccatcggaaaccactttttgttctctctcagatctgcttggaaaccactgcaagaagggatttttgtttggtttgttgtttaccggcggtggtcaaggacttaggttcctgagggcggcgcggttgcagcagcaggaggaggaggaggagcggtgttgtggtgggaggttggtcggaggagaggagaggataggagaggaaacatgaggggaaacgaataaactgggggaggggggacaaagacggcgtgagagaggagacagaaaatgtgacgggagtggcatggttctaattttagaaatttcgagtggcattgtagctgatatgacaaatagtagtggcgtttttttttaaatttagcaaagttgcagtggcatgatccaattaaccctaattattatgatcaaaattaacttaattactactcgctctgtttcagattacaagtcatttttgactttgatcaaagtccatctgtttcaagtttggtcaagtttgtataaaaaaatactaacatttttaacccaagataaatatattatgaatatattcgattatagattcagtgtaacttatttggtgttacaaatattactatatttatttataaacttgattaaatttggagtagtttgattttaaccaaagtaaaactgacttataacatgcaacacaaaatgacttataatatgaaatggacgaagtacgactagattctacaaccacattagtattattttaccggacagagtatttcattgcagcagacacatttatccaacctgaaccgtccatgtttccatcgagggagcagtaaaaaaaccattccccggagcgctcgaggcgaatcgcgaattcgacatttcgaggtacatacagctccctcctcccttccatctctccatgcatcgatcccctcccctagaatgttcttcacggatcaatctctcctcgagcgtgctttgctgtgttacgatctcaaatcttgcttggagttgtgctgtggattcatggcttattgattctttggtcttgtgcagtttccacgcgcgccacctgttcgacgaaacgcctgcctgcgcggtttcgaggtacggcttccaactcttcttgcatcgatccttcttctctatatgttcttccctgaccaatcaatgtcttctcgagcgtcgtttcttgtgcttggagttgagctgcgggttgttcggttcctgattcttggtcttcctctctcgtgcaggttccacgcgcgccacctgttcgacgaaacgcctctgcgcgcgtgctcggccgcca

SEQ ID NO: 24131 - DNA, 1501 bp, Oryza sativa
ctttgtccaccacgtgtcagtttagcaatctgcatgttcgcccttcttcatacaacgttttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccctcccgagggggttaggccacgtgggtgatcgtgtctgcctcaagtctctaagtcatgatactcccggtcccatgttaccgacaccgcccctgactaaattagtgtcatcaaatcaataattgaatgtattttcataataaatttatcttgggttgaaaatgttactttttttctataaacttaatcaaacttaaagctgtttgattttgatcaaagttaaaacgtcttataacttgaaacgaatgaagtatttcataagcttctctacgtgcaccatgtttttttttagggagtgcatcatgtttactctaattttgtagatcatatactatttcatctcaaaataataggataagtctccgaaatctcaaatcccaccgcattatatatttattactcgcgttcatcctcatgagcgcaaaaccctaattatccccccccccccccacctttcaaatttgttcgcagtcttaattaacatgttctctctaaccactggaagagaactcgatcggtcaggtaccagagccgcaatctgttcttttaatgacgctagaggtgcaccttttcagcaatatttcgtaacgtcactgaccgtgatgtttaacccaactatacatgtgctaattattggaattacgaaaatgagtaattggtgtgacgaataatcagcgttgactggtctatttaattaatgctctggctctacaaattgaattagacttagcgctcatatagtcgtatggagtactccctctttttgtaaaaagaaataatctaattccaaatatataatctgaacatgttcagatttatctttagaattaattttttttatagagggagtatgttatttttggatttgcttaattaaagcacaagctactattattttcgacaaaatcccagctcaaattatatttttcatatcattaattttacggttgagcctatagtttgttcgtgttaaattaactcatttttcaagtattttaacatcgtgtgtgactgtacaattaat

SEQ ID NO: 24132 - DNA, 1501 bp, Oryza sativa
tcaagtgaattacaataaggaaaagataattcaattacaataaggaagcgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaatataactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttcca

SEQ ID NO: 24133 - DNA, 1501 bp, Oryza sativa
cttcagtccttctcctcctcccccactcctctatccctctccctcctcctcctcctccctctccctctaagtcacagacgcggcgccctgcggggccgcgcccggccaggccgccgtgtccggtggaggccggtgcgagggccacgcccagcggcggcaggcggtggattttttttttcttttcttttttcgttgttatttgtgaatgattgtttgttgagaataatttgttcagtcgatctgtgatttgagaatgagtatgttgttgtgatttgagaatgattatgttgttgtggatgatttgatttgagaatgttgttgtggataatttgggatgttgggagatgatatttttttaatgattaggagatatcgagcgcgatatatgtaaaatagggaaaaaaaagccttatgttaccaaccgggactaaaaatccatctttagtccgggttatttcaaccaggattaaagatgaaaatctttagtcccggttgcataatcgggactactggaggttacaaaccgagattaaaaaggtttcttcagcaattgagtttgagcttagagaaattgagaatgtgagaggttgagtggatctggatgacggtccaaatttctacagtatgtcaaaaaccctagggtggcttatccatttttcaatattacccctgagttcatagtaccaacgaccaaggcaagcaaaaggaagggtattgtgtgtccaaacacaaaaccacccagttctacagaaccgcaccggttcagcggtccataaaaactacccggtttatccgatttttaccggtccgactgcggggacggtctttgtgctgaaccgagccgtcatggtcaccagttccagtttttccggttcaacagccggaccggtcccttttttttactatgatatacagcagtgtccccaccagtcagtagcagtggcgaaggaagcgtatctcccattccccggagcgctcgagggcagcgaatcgcgatttcgaggtacgtacagctccctcctcccttccatctcttcttgcatcgatcccctccctcctctagatgttcttcacggatcaatcactgctcgagcgttgtttcttgcgctgagatctcgaatcttgctcggagttgtgctgctgtggattcatggcttattgattcttgggtcttgtgcagtttccacgcgcgccacctgttcgacgaaacgcctgcctgagcgagcgatttcgaggtatggctcctttccttccttccttcctcccaactcttcttgcatcgatccttcttctctggatgttcttcacggaaaaactgctcgagcgttgtaaccgttgtttcttgtgttacggtgtcagatatttcttcgaagttaagctgcaggttgatgggttcctgattcttggtcttcctcttctgtgtgcagtttccacgcgcgccatctgttcgacgaaacgactctgcgcgcgtgctcggccaccatggaggggtcgcctggca

SEQ ID NO: 24134 - DNA, 1501 bp, Oryza sativa
taaagaaaatatagattttatgttttcaaactaaatattttgagagttaggatggtcagagttttaaaattttacttatctaaaattaacagtggcatacatttatcaataggcggagtaccgataatataattactttgagagaacagaatgtacattaattaagtagcattagtaataaccattttaatttgccggcaccaacctcttaattactgtaaagtgagagtagtttaattggttaggtttcttgtggtggaatcagcccattcgagttaggacctggacttagacatcgatgctcgtatttatggctaaacctgttagccgtcgacgataagacaccatatggtgatttcatcaatctgaagatataccgatccaatctcttaaaggtgttcatagatataagatatgcaattgttcattaatagagatgaatgagcatctgctttatattctctccgtcccattataagtgaagctataagttttcgtgcccaactttgatcgtctgtcttgtttgaaatttttttataattagtatttttgttgttattagatgataaaatatgaatagtattttatacgtgacttatgtttttaatttttttttaaaaaaaataaataagacggacgattaatgttggacacggaaaatcatggatgcacttaaaatgagagggatatagtactatatttttttaaaaaaaaactcttaattaccaacgcacgactttctcgcaccaggccaattgacccttccttacccacatatacatgcagatgcggtcatatctcatagactcatactacgtaccctctcagtaacggaaaggtgtttgtcttctggctaactgctacagtgttacttatatacgtatctctcaacttgtgaaagtctgaagctgtcgctgtgccgtcgctgctagttaaaaaaggcttgccttggactttttccccctcctcccatgatcccatccacaccacacgcagcaacgcatccacacgctggatgctgctgctgctgctactcctgctgccgtgatcgatgatgacgcggacgccacgcgcgcgaggcgcgatcgatcgaattcgccgtcgactttgaccgccgacgtggcggcgacgcgcgcgttcatctagccacatagctaagctagcttacttcatttcatttcaagatataagacgttttgactttaaatttaattaaatttgtaaaaaaaaaatagcaatatttttaactaaagataaatttattgtgaaaatatatttaattattgatttgataaaactaatttagtattataaatattattatatttgtctataaattttatcaaacttaaaataatttgactttaactaaaatcaaaatatcttataatctgaaacaggggagaactacctagcaaccttgccttacttccaatggcgcgcgacacgcgcacgtcgacaaaaacctaccccttctggtgggtgtacccgatcattccaa

SEQ ID NO: 24135 - DNA, 1501 bp, Oryza sativa
aaaaataaaatttgctgaaaaataaattatgatgaaaaaacattaaaattattttaaaattaaaaatttaaatttaaattttggctgataagtataaatataagcgaaaattctaaatgggcttatggatctgaatactgcactaattgtccggctaatcggtcaatcgagatctacgggtcgccgtcgccggcgccggccgcccaccatgatggcaggcagtgattgacccatggcgcatcatgacgacggcgacgtacgagcaatcgatcgatcggtcacctgacggcggcgtggcgcgcccgcgtcagtcaccgctaacatcactggatcaaaacccatctatctgtcttaattagccagatggagtatatagattactggaagtaacacgctgttattatcatccgatgttggaacaatcgatgatcctatgactgcacacagcttgctggtcaaagctagtgtgctaaatcgtcttacataactaatttacaagacagggggaaaagagctatatatgctttatttgtaatcctactcacagaatctttctcgggtacacatcagacacatcaactaataaattttatcaaaaatttaaaacaattatttatgtacttccagtactacacctatgtgtaaatacttagcctcaaatttattatattttaacgttaataaaaagatgataattctgacaattttaagagtataaatgtatctgaattttgttttttttactcactaaatataatgattttgaagatgaaactttatacatatatgtaatactactaaaattatagatatatattttttctagaatttttagtgaaatttgttaggtggtgtgcacacaaaaagatttatgtgcatatgatacttttttttacttgttcatcatattatttaactattaatttcatgcttgaaaaaaatacattctaaaaaacattttctactgtattacttggaccactttaaactattcatcatgtttatttcttaaaatttctaaatcaaatcgataatccgctttaatagtccgttcaataatccaaatcaaacgtaccattcggctttcctttatgtccttccaacaccaaagccaaattcaggcaaccggcaccttatctgaaatcagttaattactttgcaagacatttctttatctgaatacaggttaattctgcatatacaacaagcgatcagtgggggtgtatccctgatgttcacagcatatgctacatgggaaaccagcaggttgcgattgtacagcatggaaaccaccaaaaaggcttgtacaccgacaaaatgcgtcgaagaaacgccaaggttttttatcgcctttagcggttagcgcatcagaacgcaacagcaaagcaaaacccaatcaaatccttttcctccaaatctcgccaaattcttcgagcgagacacgtataaactctcactcgctcactcacacctcacacgctgctgctgctgcttctcgatg

SEQ ID NO: 24136 - DNA, 1501 bp, Oryza sativa
ctaagataattcaggtctgcttgaccaaaagtcttatttatgtataaatgagctgaatacaatgaaatagattgcattggatggttgatggcatcagtcatgatttcatgacataagaattggttatgccacgcttagttgtgccggtacaggtaactaatatagtggaattgtgaagtgtcaagaagaaacagcgtgcttaagttttattatttttcatatcaatacctatattaagatgcatgcatataataagggcaggggggatatatatctaagatcaattgcaatacctttttcccatcataatagaaatggcaggtcaaatttttagcagcagaaaggctcctgagattttggcagaaatcactagaggcttgttcgacatgaagtaccagcaatgaattcactagtaatggcatgttattgaacacaattgtgccgctcaaaggccaccacaaggaaaaaatggtaacactcggggtagaaatagtagtcttgtacttccaggggaaccaagtatcaatgatgctcaaaaccttcagtgtctgagaggagatgtgtcactatccacaatgatgcattcatctaaggagagattttccaacgatgggcagcctttctcgagttgcttgaagaaaccttgcttcatagcaacactaacgaagttgattgctgtgaggaagcggcaagcaaacgcagaatagtggtttagctccagtttaccagacaacacaacaatgtccagaactcgggcatatgcttctgcaaagcgtggctaatccatctgctcatatcttccgagttccgaggccgaggcaccttcgattctggtcaatctgtagaacttgaagcagaaggtgcgtatcgacgcggcggggtcgcgtagcttcagcactttgtcaaggaaactgttgaacgacaactccatcttttgatcatacttgataaagccggtttcgttccgcccaaactcatggatgtggatgttgatgcagggcacggtgcgtcagaggttgcgccaccgcgacagcacgcacgtccgcacggcctggcgcgtggtcaggaaggtcatgatgtggaggacgatgtcgtcggggagcgcgctgaaccagtccttgccatcggcgtgcgccggagccatggccgtgagcccgtgagcacacgcgcacgcccagaggcgtttcgtcgaacaggtggcgtgcgtggaaactgcacagtagaggaaaaacaaaatcaaagaatcaagaagccatgaatccgcggctcaaccgtgagcaaagatttgagaccgcggcgctcgagcagagattgaagattgaatccgtgaagaacatcgatagaagaaagatgcgagaagagatggagttgaaggtgatgggaggtgtacctcgaaatcgcgaatggtgttggcgtctcaagcgctcgattgactgcttgtttttgttgggacgctgggtgtatttgcggttttactttagtccctctgatggaagatgga

SEQ ID NO: 24137 - DNA, 1501 bp, Oryza sativa
ttctgctttccagacgagttatgaaattagtttttttatttgtatctcaaacttctttcgatatccgatcaaatatctaatattacattaaaaaatttcttgtcgggaactaaacatgcccttatttggaagaccatgcgcggcatcgcggtggcgcacgccttctcaccatcgcagcctcgccgcggggcgcgccgtcgaacggtcgaagttgcgtgttggactttctgttgcagatcgcggaaaggccgacttgctgacattaactgcggccggcagctgaggcctccgagtttcaacgatgagaagtaggccaggctcaggcatgggggaggacctgccgggaccgggagtgagattgtcaagaacttccggttgtcgactgtgttggctgtctttttagctacaatccccattttctgtgagtagtactagtgtactacgtagctagatgactttgataatactattgcataatgagttttccgtactcatttgccggtattttggttccaataatcaaagctcggagtacttgtcatatatatagctccttttaactcttcttccctgaacatttaaataacaaccaagagaataatcccatgcgaagctgatgcacgcgcatgcatcgtagacaataaaaaaaacataagagtgaaatattgaccggataacacctgtcattttactccccataaaatttaacttaaaaaaacatatttacaatggcatgaatccaatttacccttttttttgggctttttgtcttctcatatcaggccaaatccaataggtgggatatcgggcgcttgggcttcaactcacacacatgtttattctacattttttaagtttagacactaaagtttatactttggtttacatactcaaagtttatatatccaataacaatttgaatttaaattcaacttcaaaacttttaatgtatctatttatatttataatgtttatgtattagaatatatatttttttagaattacacagttcaatgcatacactcacaacgcacgcacacgcgcaaaccctacctctatgagcatctttgaatattgggccagcaaatccatcccaaagccgttaaatctaaatcctggaaaattcgctcacatggagaatatggaaactatagtgctactgagcctcttgtaacttgtaacctctaggctaaaggccccttcacatgcacagagataattttaaacatagttttcttttcttttgttagttttttgtttttctatcaaactaattgtttaaatttgtttcaaaaccaatctaaatgcgcacgtgtattgaaaaattctcgtataaagaggagaaacaaacgctcgatttttggatttgtagacgttttggtattttcctcgtattgcaagccacgggtaccaaactagtataagtagatgcagcaacaggtaacagaattcgcaaacgcaggctccgacactcacgccgaacgcaaacagagtgaattaa

SEQ ID NO: 24138 - DNA, 1501 bp, Oryza sativa
ctatcatctgtcgccagccatcacgatgatgcctaccgctcgctcgatgagtatatatagtttaattggacttacgcatatcctttttacagttctgtatacaagaattaatgaaaacacagtatatatcatggtgcgtatcatatcaccacaaatgcatgcaattcaaatattatagttccttttgaatttctaaacatacctttgtgcttgggaatatatgagatatgaattttcatcctcgagggatgccccatcgttacttgcatgtcatctaagagcatcgccaacagaatcctaaagtttcatccccaaaatttggttttccactagaaagaatgcccgtgcgttacaccgggtgaatatttttagcggcacatgttttggtttaatcgagataaaaaaaaagagagatgatacatgttaggtttttcttattgtcatttcaccctaggcaatctagtatggtaggatgaaggactcataaatggacattgtatcttgagtcgttccgactatagctggagggttcaccctccgaggaggacatctctcaacactacaacagtaggtggatgtggagcacgtgcaatgacatccaaaaacttaatggtgtagagctctataatgtcacttgttccttgatccaaattaattcaattgacctttgatcgagcatcaccagctttgatctaacttgaacaacctcgatctgcgtcctcactcgacctttatgtgactgtcacccaccataggcttaactaaaacttatacgtctaataaatgaattactttattacatggtaggttaccactaaggtaagataatggtaattgcacgagaaccatatcaaattcaaataaattaaaaaataatttaatttttttgataaattttatcttcacgatttgcaattgttaccatatatagtttggatgacactttttatatttctagttttttactgcaaatttgcacctattgaaaattgaatctatctcgtgttttgttattttctccacaaccagctatcgtgctgggatagccttctgacctctacgcaatgatccctgagatcttgctagccagtcattatttgctccaggaaaatatgagtctagctgtgatttgcatgcatgcaaaatctatctacgtgcaaagataattaacagtacatcttgatccggactggccggcctttgctgcgcacggaaaaccttctcgcattgcgtcgaacggaacgatcatacagtcgactaattaaccagctcacggccggaggaaacacatgcgaaacggactcggatgcatgcgaacgcgacgtggggcgtggcgcatgagcgagcagaatcggataccacgaggtacgaaaatagtttcggcaaaaacatcttaaacttttataatagtaaagataatcctaaacaaaatttaagatgtgaaaatatcatctctccaagagatgagctataattaattctctgaaactgaaaagtatag

SEQ ID NO: 24139 - DNA, 875 bp, Oryza sativa
atatacccaaagtttatgctttagttcacgtactcgaagtttatatacccaatgcgaatttgaatttaaattcagattaaaaaattcaatgtatttatttatatttataatgtttatgcacacagatatttttaaacgtagttattttttctttagttagtattttatttcttctatcaaactaattgtttaactttgtttcaaaacaaatctaaatgtgcacgtggtagggagaagaaagttgcagtgtctggtggggtgtggccgattttgactccacgtgatcacccattcattaggtggaccctgaaaacgattaggcttggggacccgaatgttgacagtcgttaagtacagattttaaccgtcaactccggtataaaaaaataaaataaaactaagtggtatgggtttattactaattatttccaccattaactttaaaaaatatatgtatccaagtaatttaaggagaaaatacactcgccgtacaacgaaaatgaaccttcggctaatcacatactagcagaaggattggagggcccacgtgatactaaaaaccgacttgaaatgtggccaaaccatccttaagggcaagttttatagtagaggtgactaccacatccaatttcatacatgacatacataattaaattaagaggtgatatgtataataggttacctctaccacacaatccccaatatctctaacactttcacatatttattgaagtttgtgtaggggctgccccttgcatgagaggtgactatttctctctaatcctttttctcttctccacctcactatttagtcctatgtagcatcttggggctttgtacttagatgcccatagtacttgccctaacgtcgtagg

SEQ ID NO: 24140 - DNA, 1373 bp, Oryza sativa
gacgtcaggttagatgatgatattgctagagattatgtaagacatatgataactcgacgaattacataaacaagattagagtgtcataaagatggaagcactaatcccgagaacgcaagccaccataacaagtttacctcttgttgaagatcgaaaccgatgcaactcaacccgaaagcaagaactcgtcgaaataaaacgaaagtaaaaagggtggcgatgcgccaagattgtattgaacgtgtgtgttttattacatagggctcggggtctatttatacccgaggattgcaagatatgcccataccggacacaaccattatctctaacaaactctaagataccataagtctttgcggcagtcttttgcccacacttatctataaggaattcacataaaatatcctagttaatagatacaattgccttcccaggactctatccatgggtggcaatcatcttgaagtacattaacttgaacccgatgtcgcgcacaacgcgtattgtcggaatcggctatatcgacttatttagctcgactcagactcagccgatcttgtcgtagccgatctggactttagccgattcctgccctgttttcaaactcgatctccgcttccgactttgcttcgatctaatcttctctccgatgctgatgttaccaaatttggttgttaacagaagcctgcgaccacttagcaaacgaggtcaagctcccatgagcctgcgccccaacgctacacattttgttcgctctttcctttcggtggcctccttccaatctctcttccttcttcatggacgattacttccgcacgagtgtgagagccgaaaaattctagagccagcaatccctgtccacagttgagccgggttgggcaccgtagccagccggcgggtccaaagccagccgctatggaagagccagcacagggggtcccgggcttcgacggcacctggagctcaacttaaggctaggataaggctagaagacttagcccccacacttagcaaagaatcgttcatatagatgggagagaggttgggctcttaccacccaggggccaaacaaatgcgcaacacgcgagcgtcgcagggtcatgagaatagaatgggggaaattaaatataagattttaagctaatgaattggaaaattgaaaaaaacttgaagcttgaaaggacgatcagttgagccaggccaggcaccgtagccagccgtcgggaccaaagccagccgctacagaagagccagcacagggggtcccaggcttcgacggcacccgaagctcaaaactgcaagagtcctcctaggagtgaaccgaggcggcagcaggttcatgggataaccccgcgcttggcccctgagggcca

SEQ ID NO: 24141 - DNA, 346 bp, Oryza sativa
  unsure (1)..(346): unsure at all n locations
acgtgcttgatcccctngannccctcggtacccccttcatctccttcgagtcaccatcatcaattgcatctctgatagacggtcctccacttggtgcctacatctccttctgtgtcatcccttgactctcctctctctctctctctctctctctatatatatatatatatatagactattctctacacccccctcccatggatcaaacccacctcccccaccctccctagggcccgaaacccacctcccatcttagtcaaaagggcggtcaaagcatcctccaccggtcaaacccgcccactcaattccccccacgtccacctctttgttgtccttgtctcacagg

SEQ ID NO: 24142 - DNA, 573 bp, Oryza sativa
gccgcatttaagtatattaggcttttgctcaatatattatacttgctttaacatcttgatatagagtagtatcgaagtattagccgatacatgctagatctatctgatcggctatgctataatcatatataatcttgttattgacatatattttgatctaagtgatttatactgtcttggcatgatgactgatctatcccaatcacttgatttaagtatatatcgatataaggagtatatattgttaatatctacagccgatcaagtagatttagttcttctttacttatttataactgccgatcgatacatagatgacatcggctcaaagataaatgatatgtcatcggcatctagccgatcgcctatcatttataaatttaactacgatttctttgcttctatttcttgttgattacaggatcaaatcaactggcacgctaacacatccgaaggcgagttttggacctgcactggagttaagcggatctcccaggccatgtgttttctgtcaacacgcttttggcacgcctggtgggacctgattagaagtcagacgtcagtccctcctga

SEQ ID NO: 24143 - DNA, 1305 bp, Oryza sativa
agatgaagcggatccggctgatgaggagttcttccaggagcaagccggctacgatgagttttagggttttggcctagttcccaagtcacgcctgtgatgattggtccaagtcctggcttccgctttccttttgtaatgcagttgtgagctcgggatctgttcgcagcccaacatgactgtacttctactctataataaagagacttctgttgctgtgatattctgtctccctgtgataccagcactgtttcctgggactggtatcgattaacaggttaataaagaatctattcctttgttatggccaatttgcattgattactttattcctggataccttgggttgttataacttgactagttgagctttatatattggttcagctagatattagatgtaattgcttagccatgcttagaaacattagcacactattgggataacttatgactcattattatttaaggatggcttaatgatacttcacgatggtcaatcgtgattggttaattaattatttgccaactaaaacttgataatggtgggttgtgagcatatggttttgagagtcgtgctcatgacaattaaggaccggttcgcgagctactattgtgaaacattaatcgtgccaaccacaagctagcgtgggcaatggctttaccttttgtacagcatggttcattgcggagcatcagactgagaagtggcagagataagcccacgggggtcgctggggagtccatgcctctggttattgagggggtgattatgatccaggaaaggtgcgctgtggtggattgtgttgtgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgaacaatgtttttcgtgattagtcccacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttctgattaatcactccactgtttttacttctcttaaaagttttgctaaatgctgcttttgcaaatgaacctatattatgccatcctttggtatctttgtgcacttgcatatttgctgtgtggcttgctgagtatgtcatatgctcattcttgcaataatcgatcaacctca

SEQ ID NO: 24144 - DNA, 184 bp, Oryza sativa
actcattatgctatattgtcgaagtcatctagctacgtgataccactgaaagaagatggggattgtagctaaaaagacagccaacagttgacaaccggaagtaaactccttgataatctcactcccgggcaggaccttccccatacctgaacctggcctgcttctcatcgttgaaactcgaagg

SEQ ID NO: 24145 - DNA, 761 bp, Oryza sativa
agatgaagcggatccggctgatgaggagttcttccaggagcaagccggctacgatgagttttagggttttggcctagttcccaagtcacgcctgtgatgattggtccaagtcctggcttccgctttccttttgtaatgcagttgtgagctcgggatctgttcgcagcccaacatgactgtacttctactctataataaagagacttctgttgctgtgatattctgtctccctgtgataccagcactgtttcctgggactggtatcgattaacaggttaataaagaatctattcctttgttatggccaatttgcattgattactttattcctggataccttgggttgttataacttgactagttgagctttatatattggttcagctagatattagatgtaattgcttagccatgcttagaaacattagcacactattgggataacttatgactcattattatttaaggatggcttaatgatacttcacgatggtcaatcgtgattggttaattaattatttgccaactaaaacttgataatggtgggttgtgagcatatggttttgagagtcgtgctcatgacaattaaggaccggttcgcgagctactattgtgaaacattaatcgtgccaaccacaagctagcgtgggcaatggctttaccttttgtacagcatggttcattgcggagcatcagactgagaagtggcagagataagcccacgggggtcgctggggagtccatgcctctggttattgagg

SEQ ID NO: 24146 - DNA, 1501 bp, Oryza sativa
ggttcttttcttgattcacctatgcgatttcttgtgtcagtttcttggccgattcttttttttctctcctgcgaaattgattcagtctcatcagaatttcgtgctgttggctccgcaaaaaccttgatgaaatccctccattttactgaaaatcttccgattgttagatacaagtgcaacgccaaatcccgttaatctccccaaatcgacaaatgaattaaccagaaatggccattaatccctgccattgacggccgtacatgcgggttttactccaatcctacgctttcctgctgctgctgctgccggtggcaattgatgcattgcctccccagcagagcaatcaccagtaatggagggtgcaagtacaggagaaagtggccggagcaaggaggaacacatgggggcatgttctacatttactcatccatgccatggcccccggcaactgtggctgtggtctcttccattggctgcgtctgcacccatggtgtccttccctgtgggatgcagcctgttcttgccatgatctgatgaaagtgtgtgtgtggttgtacaattgatactttgatgcggttgcggctaattgacgcgacaatgcccgcacgctcgtgtcgttgtcaatcttgtggcgatgatcggatcaatgtggctgctaatcgattgagaaattgatttaaggtaggctggatgatggtgacatgcctgtcttgttttgttgttaaaggccacattctctgtgtgcctttcagggtttaggaggaacagtgtggtgttggtgtactagtgacaaatgaatgatccgtgccgcgtgaccaaaccgcggatcagtacacattgacagacagatgcattgccagtttgattgctcatggtgtttgctttaaggatcagtttttagggggggggggggggggttactttgctttaagaaggtggctaattgttgtcatgtataggcgtactatatgattgtgggtgcaatttgactaaagtattaaccacttgtttaattacatctgctttggatgcgtgtgcttcctcctgcaaggtcatctgtcctatgtctgaaggtgtatgcttgtggacgaggcagaagttgttgagtcgattatctgcatgtccttgtcttgatggtagtgaattggatgccatgcgtgcccagcaataaaccaggtcttgactgaaggacttgtatatgcaaattgatttcctgctgcggtgttttccgtagaatccgagtcgcctaaaattatagtagcttgtttggtgcttgccaacttgtttggacttatatgtcagttgcattggttgtttattccttcgtttctgttttctgtacagttggttgctggttactggataggttagttttacttacttttgtagccttctgaatcctgcatcgttatcttgccgccatcatgtgatagatcttcattttctttagtttggctagctgaaggtattgaacatacttgatcagagagatagcggggga

SEQ ID NO: 24147 - DNA, 1501 bp, Oryza sativa
tgctagagattatgtaagacatatgataactcgacgaattacataaacaagattagagtgtcataaagatggaagcactaatcccgagaacgcaagccaccataacaagtttacctcttgttgaagatcaaaaccgatgcagctcaacccgaaagcaacaactcgtcgaaataaaacgaaagtaaaaagggtggcgatgcgccgagattgtattgaacgtgtgtgttttattacatagggctcggggtctatttatacccgaggattacaagatatgcccataccggacacaaccattatctctaacaaactctaagataccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagccgtattgtcggaatcgtctatatcgacttatttagctcgactcagactcagccgatcttgtcgtagctgatccggactttagccgattcctgccctgttttcaaactcgatctccgcttctgactttgcttcgatctaatcttctctccgatgctgatgttaccaaatttggttgttaacacatgccccacaagtccggcatatttgataatgttctggatttgccataagccgactccgagcaagtctcacactccgccacttttaaccgttattccagcgctttaaatactacctgttacccccgagaaatctcacgccgtgacttcctttttcaccgctcaagcgaaaccttttctctctcttcttggcgattcccccggcgcaaaggcaattcctaggcgacttccttcccagcgagatctccgcccgcaccaatgtcgtcttccgccagcccacttcgtgcaccatcggccgaatacgctgaggtaatttctcattggctaaatccccttctttagcagcaaatcgatcttcttcaatctgatatcactctctccctctgaattgctttggatttgcagcacctttccaacctagttgtcattcccagcctggcgcatgaaaatcactactttcttggcccaatcggcaatccagaccccaccgagtttattattggtgaaaccaataggatccccttcagattaaccaacccagatctaggtcactggaagaataccttcaaatcctggccatccctagagaaagttccaccagaaaagagctggaccacatggttcaaacgtgtatcagccagcaagagggttcactgggatgaaattggaatcggccaagcacttgaccttactatagcgaattcggccaaagatgaacccctgatggcaactgcttcttacttttggtcaaacactaccaatgcctttctgttcaatcaagggctgatgactctaactctcatagatatcattatgatcacaggtctggatgttacctcatctggc

SEQ ID NO: 24148 - DNA, 319 bp, Oryza sativa
aaaagaaaaatggtaatttagcaagccctagctaggaattaggatgcatcaatctctagtagttcttgaagctgcagctagtatagctcccaaccatttctcctcttccttttctttactaatatgatcagcatttcattaagatttttttgtatatagtatagctacctacattttctcttgatctgattatgccaagtactaattttctgtccattttactgatgatgatctggttcaattccccatgtgtatatgtactctcaggtggcaggtctccagtccgagctgaactacctgcaaggtcacctctcgacga

SEQ ID NO: 24149 - DNA, 1501 bp, Oryza sativa
agctagctggaaaagaatatatttctgcatgctgcaaatatatggtaccaactgttcagtgctaccctgaactgaagtaaatgtcttattaatgaagagccatcttatgttgttttagaaattctatatgtagtgttggcattgacttgatttacacactatagtgttatatatgcttgtagctgcacaaaagtagcttttagttgctggcatgtcaatttaccaaacagaaaaagagacgttcaatttgtggatgaaaaaaaaaggaatattttttaaagacgcaagtttaacacaattcaaaatgaagcctttcgatgttgagtttaagtaatctttaatttaaatataaaagaataatggtagtcagggttaacactgcacaaaaaagtgaccttggtcctggtcctaatgaagcggtttccttaaaacctgctagtaaccacctcacagttctcaatgctatgaagaaattaaaaagtcggttctaaatcaattaaggtaaatcatggaagaatatagatgtcttacgaaagtaatctgccccaataagcaatagtacagtggtcagtggagatcagagaaataattttgtgatatggagtttaaacattggggtagcggaattaaactactatttggtgtgaaattatattaagtaggtcagaagcatccatacatagtacttcttctgtcccaaaatataaagagtttcggttgaatgggggcatatctaagtattgcgagtttggacaggctacatcccgcatggaaaaaaattgttgtttttcatacctttttgacaggcgggtgagccaaccacgtgaaaaaagtttttttttcgtagtgtatccagtagactgacatgttagcccaatggcgaaatcggccctagagcaaataacgttggaggcaatataatggatcaaacagagatggtgtagcagctagccgtgtgggggccaagggcttttggaggcggctattgcaatttcggtttgaaatttcggatcccaccggcaaatcaatatatcaaccaaaattttcgggatttctcaaatttttgttgcagttggtacaagtttattcaaattcggtcaaaatctatcacaatttccaaaaaaaaaggggtccaaaaaagtaccgaaaatcatgaaatttcataaattttggtcctaccaaaatcgaaagtgtaaaccctggtgagagggtgccagagagacactgctcaagggataacgtggcatctcaaagtgttagacaatatatccatccatgatgcatgatggtcaaactacactcaaattagtgagatcaaggatgcattcacacctgtgtgagtgtgatattatgtgtgtgtattgtggtatgtgtacgtgtgtactaaaattgtcttgtttggactgatgagaaatgtatacttaatataagttgagaataaaaattagactgtaataatttttttgtagaaggactgtaataataattgagagaagaaaag

SEQ ID NO: 24150 - DNA, 1501 bp, Oryza sativa
tggtgaatgaggttaatttacgacagagcttcactgaggtggttgactatgtcaaccagtgtttatgggcctatcaagacaaggagtacatcatgtgcgcacacaaccaagagtaagaggacaatacccttcgtgtatattatttttgaagttaaggttcttagtactaacgctacataacaactgcgcaggtgacattggattcttctagtcatcgtacctaagtggagtagggttatctaccttaactccaataagtccaaagattatgatttcactgaaatcaccaaggtcttaaatatggcttggggcccatatgtggaaaagggtggtaggcacaaggagggcaaggacgaactttaccatgacaccaagttcgcatgcgcacaacagatcggagaccaatatggtttccacgtgtgccacaacatgtcaacacgtctaagagaggtgaaagatttcgaccctgaggttgttgctaatggcgaataagctcatttcaataccaacattgctattcaaaacgtgctaacatcttatttattaaacagaaaggtagagctggcttcaagatctcacccatcaaccctccctcccccctcctccccgcgctatcagaggcgaagtgtgcgccttcattatggcagaaataatgaataagaaaggacgttttcacgtcaaatagactcatgaacttggctagataatttattgtgatgtaaaaaaagatgttttcataatttcttgtgatgtaaaaaaaatatgtttttatggagtgcaatgtaatttactttcatatgtgcaatatttatggtagtttactaaattgtcatcaaatttgatcaactacaatttacgttgtactattcatctgttttctccttttttttccttattgacaggttgtggaggtcgaggacattatggctttaatccatttggtaagtatatatgcggttatatgagcaacgaccaaaattgtggctttcaaggggtgtgaatttgctgtgcaaaattgtggcatttgaactgcatatgtgaatgatgtcaatttttgatatggatctgtgttgttggggatctgtgatgtttgagatggatctgtgatgttatattggggggtgactggaatatatctatgatgtatctgtgtttcagagggcatggctagcaaatcctgaggctagccaatatttagctttttttttctggaattaactcatcagtgacgggtcggaacaaaaatccgtcaaaggtaacatcacctgtatggactagcaaataaaggcccgtcaaaggtgacctacctgtgacgggcctttacttttggggccgtcacaggtagatcgcctgtgacagcttctaactacggagaccatcacctctgacggcctttatttaaagggccgtcagagatgagtcacctgtgacgggtcccaactcgtcctaggctagcggagaccaacacctctgacggctttatagtaacttgcccgtcaga

SEQ ID NO: 24151 - DNA, 1501 bp, Oryza sativa
atcgagctttttcgttcccgccttatctccaacagccaaagctctcgtgctgttcgttaagacatgctcgatcaaagtgaccggtgcatgcacgtgtgtttcatcagtcgttttaactcaaatgttttccttttgtgatacggttggaatttgaattgaggagctgataattaagtgctgggtttatctgcagctctggcctgattgaattgctttccgtgtgccctgtgtacacggttgaggatacacctaaactctatcaacaggaaacattgcagatgtaataatgcttccaacatctaaactttgttaacactaatgattttttttggcattcttatctttaacaatttaccgtattgatgttaaacactaccttttgagtctggtgctgggagcctgggaccgtaacgatggcgttccatccaaatttctttgggcctctcctccccaaaaatatctctttgggccaccttgcttagcccaagtcaaatactcaaaccagaaggcctgagccctcgtttcggaggcccaatttctggcttacattgatcaaagaacaaaatttggaaaaagtacaccgaaggtccctcaacttgtcatcgagttaccttctcaaaaaaaaaaaaaacttgtcatcgagttaaaaaacatcctcaaaccgcaaaaccagatatccggcgtcccttaaatagtcaaaactggtcacaatacgtctttcggtggttttgaccccggctttggcctacgtggggctgagtcagcgtggaacccacatgggccccacatgttagggtgatccacatcatcaccctccctctttctcctcttctctctttctgggcgaggcaaagcggtgggtgcagagaccggtaggcgaggcgggagagaagatggcggcgggccgcaacggtggcctgcggcggggaaacacagcgacacggcgccggcggctacgtgggagaaggggagggcggcggcaacagtagcacaggggaagagcgaagaggacagaggggagcatggtgccagcgacgtctgacatcggaaaaggggcaacgtggcgaccggcgagatatcaagaccgctcttggcaagatgacgtgagcgacaggaggggctctacgaggttcacctgcgctgggggacgatgacgggttggggtagtcgcggcgccacgcctggtcggaggccgcctcggcatgcgctagcaagaggagcgtcggcacaccaagagcggtctcgcccgctaccgccgccgctccgcccgcgtccggaaccgctgctcacccgccgtcgcctctccgtagccgcgcttgcctgccgacgccgccacaccgcctgctcgacatcgccattgtcgtccaagtcgagccctaatgagccgctcgcccctctagcttccagcgacggcgacgccctttagctcctggcaacgacgacgcttggtcctggagagctaccgccgtcgcgcctgtccctgcctcccgcctcaccgccg

SEQ ID NO: 24152 - DNA, 1501 bp, Oryza sativa
gctcccctccgcctcgtccccaccatcaccgccgcagctaccgagagagagataagggagagcgagagggaggatgacatgtgggtcccacaatacttttttgtgtgaatgacatacgggtcccacatttttttttaacttaggtgattccctgcgctttgctgcggaaattactaagtaacttttatattttgtaataatctagctaaaaataaaaattctattagttattaaaaacaaataaaactgatttgtgaaactatgttaatagagaaataaatttagtagactctgtatgaaatataatattccgcactttgattatatggatgaatatttgttaagtattataaaaataatggatatatatatgttaaaaatattgtgaaaaataatgtgaaggaagatgattggatattgatttgtagaattcaatgaattatagatgatgttgcatgcttgcatgttacactatgataagttttgtatgtattattgctagtggatgatgaggtggcatgttgagctttagaattagtaggttataactctatagtaaagataagatttttgtttttattttaataccacgtaagcgccacgtaggacaaagaatcggtcaagaccgccatgtcagccgaaaccacctccaaaaccatctaggaatattgtttgcacatattttaataattgaaggagttgatatatctaattttatggctggagaacatgaatgctactcggacgacagttgagggagttttatctgacgggccctcgtagtccgagcccacacgaccatctaagtgaacagggcccagagagagagagagagagagcccaaagtcaagtgaagtccagcccacggcggtgctcgcgcccgcggcttcccgacgccacccaccgctgccgctgttagtaataagtctagctgctcagagtagttagtttccctctgtttttacgttgagtcttgcacatgatctgttcatcctgtttgtgtgcatagtgggcttgacgcacgctgcgttcgtgcggagtccgtggtgtcgtgcatggtgtgctccagttcgtgggatggcgcgaagtggcaaggagtgtggcacgcacaattaggaggccactatggccacgtttaactttcttgtaatttgctatttaaggttaagctctaatccagaaaagctgccagttaatgcagcgccaaaatactctgtgttgctctgtttctgttttgccagacaagctacagtttttcgttttgccgctaacaattggtatcagagccttcggtgatcgccggggttcctgatgtcgctaccaacgccacgcgtctcccactcaccaccgcgtcgtcgctggcgctcgccgtctccgcgccgtggccgtcatggcagccgcggccaagtcgtggtggaacgcgtcgtccgcgaggcgaccacgagcagcgtcgtctacccgacactcacccacacaaattaccaagactgggcgctggtaa

SEQ ID NO: 24153 - DNA, 1501 bp, Oryza sativa
tgggagtggatatggagagggggatggggtttgggctttctgtgctggatgagcctgcctggccgacaccctgcgtgctcccgccgtggcttgaatcaacccggatcccttcttctacaggtgtttgatcaactaagcattttttcttctcatgtggttatctgttctgcacttcccatctaactaaaaatgtctgaattttattaaaaatggatgccataacgattttcctgttcgctgctaacgcgcctgaattttcatgtaacacgtttgggcttatacaggtgttggtcagtgtagttcctctaagcatcctattgcaatttgatacagattatatctcattagggtccctggcttaaatcttattactgttatccactgagtttctaatttatagtgttctacaattgcttccatctttatgtaattcggactaatgcaataaaaaggatgtttgatgctaactgtttgcttttcaggttactaaattgactggtgaattctattcagattttgtttgtgaactccaaattttgcatctagtttaccttaatttctatctttctctactagtctaatgcagtactattgaaaatgttccattgaagtgatcctgcatagctgccctcaaagtggtgccaccgctaggttaagcagagtcaatcctctctgatagggcttgcacttctagtaaattgactataccagtgataatcatcgacatatatcagcaccagaacttggtatttcccagaagaatctcgcatattgtggtcttggagaggaatgtctgttgtgtaacacttgttattttgttcatatagttaatgcccaggtgttttgatgcaatgttcattaccatgtcttttgcaattattggatatatacgcatattgtttcttgtcactatcatggctgtgttactactgttcaaattcttgtatacatgattgcagaaacccttttgagcaagaagaccaatgttgaaaggaagtctttggcagacatgctggttcgtgtagatagatgctgttaaaaatgaagcacactggctaattcatctattggtattttctcttctaactcatgtgtttgtgtacccttgttttatccactatttgtcatatttcattgctccttccggatctctcatattagttgcaggctttttttttacgggtattagttgcaggcttgcagctaatgcaataggttacttttgagaaacaacttgctcataatctgttagttattacatcgtcagtccaatgctatcgtgtggatgagtctatcatggttgaccaatacttcgatgctatcgatgttcctaatctttttttttctgaattcgttggagtttatgaatgatactaggtacatttgtctacctccttataatggtgttaccatttctagagcttatactcaaattgttgtggagtacttgatttgctcatacatccttattcccaaatgttagtgctgctgagaatagctg

SEQ ID NO: 24154 - DNA, 1501 bp, Oryza sativa
acatgttctatcgccacaatttttatttttgtggcaatttatatagtacacagtacttttcactattttttgttgccatgatcaacaaaattgttgcaataaaaaaattgccatctcataatttaactttattttttcatatggacacggattgagacaaattttatatggaaattatagctctcgacgagatctacaattttataggtgataactttttcatttgaaatcttttagatatcaaatctatgattcaaatctcagttagctaggctcaaatagaactatatgcattttcgaacagaattgatgtgtagttgagttggtaaaggagagcacacctgaaggacaggtcttgggttcgaatcctagccaagacacaaaatcaaaaaaaaagagtagataaatagataggatgatagactaatatttgaacttttaacttggtacgtaaaactaatgctacatatggagtggtggcaataatttttattacaacgatgtgaagtgttgcaatatgactttttgccacatccattccgtggcaacatctaaatttattaccacaaaataaaaatcgttgcaataacctattaccacgctgtttattactacggctagcaacgattttacaattgtggcaacatgtatctatttccacaattttagtattgatgccacgatttttttcgtggcaacaaatgatttatctagtcgcgatgtgctccagtaggacatggcggcgcgagcacatggtgcaagaggagcggaggaagacgtcgggagccgcgaagacggtgatcgaccctggccacgccgcgagcaacgttgagttggcgaggagcggcgccgcggaggccatctcgttgtaccacagcgaggagagcaccctcgccagctgctccagttgctgctcgtcgcccaagcccgcgaccccggcgtggactggaggcggagggctcgctacgtggcagtatctcgggagcggaagtgtcgtcgtggactcgtggtcgtggccgtggccgcagcaggttcgtcgagaacaaaaatgcctggatctctatcaactggttcactcagctcattcactgtactttttattaagcattcgactgtctccagagcttcagactcaatacagcaagaagagaaggctctaagtctgtctttcccacaacaccctcctcggccaaaatagcctttacacgatataagttgagaaacacagtcctgcacttcatccactgacatagcaccaccaaggatgaccttgatgagcactggatttacttcaaatttgtattctgattccagaccagcaatcaggtttgtcagagctgcctcaatgtgttggtcagttaaatcgtacattcgtatcccaagagaaggcatttccatggccccagccatgattcctccatgtctctgttcaaaaggaacataacataccagaaccaaaaagttattaaaaatatgatcgatttcaacaacagaaaattca

SEQ ID NO: 24155 - DNA, 1501 bp, Oryza sativa
ctcggagaaggaatcaaggatggctttgagcaccacaagttgttcttgctctgccggcaagatgacgagtccagcaaagcaatctaggaagcagactacatttgtttacagaaaaaaaaacagacaaacaatcgtaattcttctaccccatatctcattctttgtacaatggcacccccataagtttttttttatgctggaaggtagatatactctaccttataaccattttattaatgatgggtcgggtaatacatgccacccccataagtgagtaaattaacttcccacaattattggctttattatttgcttgcttttcttttcttgtatgataaaatcatgtacttactgcgtaaagctttctcggagtctttcttggaattgtccaaaggcgactgagcgattgtgggggggatttggagtcctctccgacgaggctgcatgatcagataaatcatgcagatagtcctaaaaccaacacaagagaaatatggggaaaaaaactatttaccctgagactcctccatccgcctcggcgccgcacaaggacaaccacatcctctgggggcagaagtgcggtgcgcggcgaagggggtgaccttgatcaacgggaggaggcggtccagctcgtcgacatctaggtctgcaaggcgacgagaatcggtcgccgccatgaggcctcggagtggatcggaatcaggggaggagcaatcgaggaggacgattgatgagtataagtcagttagggtttacggacgggaagatgaaggagaccggcttttcttttttttttaaaggaaattttttttctccaactttgcttttctcctttttaaaaaaaaaattctacaactcgggaaggtttgtagtcggagtctcatagataaattactgtagatgggctacaggcccaacagttatcttaactataaaggttttattaggcccttcgattttgtcacctgagaaagcattaggggcgcgttcagtttgagaaaatttctaaattatttggatttctaaaaattaattcctactgaaataccattaaatgcagctttgtagttaaaatatccaaagtaattaaatgcagcttgtaattaaagaaaaaaaaatatccgagtacagcttgatagtaaagtctgaagagtcttcccttcttcttttgaccacgctgcttttccttggtccgtagagcgagttcatgttcattccgcatccccttctctcggtttctcccacaaacacaaaaccctcttctccccttctctgctaccagtagtacactacaggctactactactactactactacaccaaatcaccgcgacctccacctccacgcctccgcgcgcgatgctccgcctccgccgcctcaccggcgccgtctccggcggcctcgcccgctacctctccacgcgcgccgcgtcgccggcgcggcccccgtgggcgctgctccagctgtcgaagatggaccggtccggggcgtcgtcgcagc

SEQ ID NO: 24156 - DNA, 1501 bp, Oryza sativa
tcctgatttcattctgtgagtttcgataattgattattttctgttcttaccttttcttgtggacatttctttggcttggaaattggaatcgttgaatcgagttcaattcgtgctacaaaagagtccagatttaattttgtgagttcttgatttctctcccatataggttgcggaggtacaacggggccggagctggcagacagtgcaaaaactcgtaaactcgagttataatcaagaacatttaaaagaccggttctgtttgacatgcaagctcagcttcagctcacagaagtgtttggaccataggcttcatcatccagttaaagagcgagataaccttgtggtgttggagattgtgatggaagatggatggagtgtcaatgtcttatctctggggaacaactcccaataggttcttgtgatagcatagatgtaaatttttaagaccagtttcagttcactggtaacttttctatgcaatgcagaaacaaaaaaaaaaaaaaaactagttctggattgatttgctcaatttcaccgcgcgtcaagcttgtggacggccagtggcggaggacccggtatggcgaggtctggcgctcgccataccttaggctgcctgcgagtaccccctgctccggccttcagctccagggtcaagccgggcagcggccatgcgcggcgtccagccgacgtgtgacgcgatggcgtcggcgtggtgttgacgaaaaacacgaggcctgggagatctgcttaactccagtgcaggtccaaagctcgccttcgggtgtgttagcgtgccagttgatttgatcctgtaatcaacaagaaatagagacaaagaaaccacggttaaacctataaatgatagccggtcggctaagtgccgatgacatatcatttatctttgagccgatgtcatatgtaaatcgatcggcggttgtaaataggtaataaagaactaaatctacccgatcggttgtagatattaacaatatgtagttcttatatcggtatatacttaaatcaagtgattgggatagatcggtcgccatgccgaaacagtataaatcacttagatcgaaatatatattaataaaaggactatatatgttcatggcatagccgatcagattgatctagcatgtatcggctaatactccgatacaactctatgtttagatgttaaaacaagcagaatatgctaaacagaagcttagtatacttagatgcaataatatcttgacataaagggtggatttaacatgtcaatgaagcatatagagcaaatatagttaaatcagataaggtaggctgaaactccgatactaccctaattggcaaccagaaggcatgctagagattgatatgctaagcacgacttaatagatcaaactcaactgatgcagcattaagtatgaaaagaagaacaacatctaaacaatcaagccgctggaaatttcatagagtggtagatatcttatataatttaaatcaacgttgaaat

SEQ ID NO: 24157 - DNA, 1501 bp, Oryza sativa
cggagaggcgacggcgggtgagcagcggttccggacgcgggcggagcggcggcggtagcgggcgagaccgctcttggtgtgccgacgctcctcttgctagcgcatgccgaggcggcctccgaccaggcgtggcgccgcgactaccccaacccgtcatcgtcccccagcgcaggtgaacctcgtagagcccctcctgtcgctcacgtcatcttgccaagagcggtcttgatatctcgccggtcgccacgttgccccttttccgatgtcagacgtcgctggcaccatgctcccctctgtcctcttcgctcttcccctgtgctactgttgccgccgccctccccttctcccacgtagccgccggcgccgtgtcgctgtgtttccccgccgcaggccaccgttgcggcccgccgccatcttctctcccgcctcgcctaccggtctctgcacccaccgctttgcctcgcccagaaagagagaagaggagaaagagggagggtgatgatgtggatcaccctaacatgtggggcccatgtgggttccacgctgactcagccccacgtaggccaaagccggggtcaaaaccaccgaaagacgtattgtgaccagttttgactatttaagggacgccggatatctggttttgcggtttgaggatgttttttaactcgatgacaagttttttttttttttgagaaggtaactcgatgacaagttgagggaccttcggtgtactttttccaaattttgttctttgatcaatgtaagccagaaattgggcctccgaaacgagggctcaggccttctggtttgagtatttgacttgggctaagcaaggtggcccaaagagatatttttggggaggagaggcccaaagaaatttggatggaacgccatcgttacggtcccaggctcccagcaccagactcaaaaggtagtgtttaacatcaatacggtaaattgttaaagataagaatgccaaaaaaaatcattagtgttaacaaagtttagatgttggaagcattattacatctgcaatgtttcctgttgatagagtttaggtgtatcctcaaccgtgtacacagggcacacggaaagcaattcaatcaggccagagctgcagataaacccagcacttaattatcagctcctcaattcaaattccaaccgtatcacaaaaggaaaacatttgagttaaaacgactgatgaaacacacgtgcatgcaccggtcactttgatcgagcatgtcttaacgaacagcacgagagctttggctgttggagataaggcgggaacgaaaaagctcgatgtcttaacgaaacgattacaccttcgtttgaaaaatttaaatctcctgcacgcgtaaatctctcatcgccccgccactatataaggcgaccaggtacccgaccccatgaacacacaccaaaccacctcgagatcgcttcactctcgtagcaatggcgccgtcgctagccaccgtcgttgcgatcttcctcgccg

SEQ ID NO: 24158 - DNA, 1501 bp, Oryza sativa
gtcggcgagcgagaacgacctgatcaagaactgcttccccaaagacacctcgacatagcggagcttgccctcgctgacccccatgcgcctgtacttgccaagctcccttagcatcaccacgtcgtcaaggtcaggcagcacgctctccttgggcagctcgacgaaccggagctccggccggtcgctgaaggggtcgatggtgacggcgccccagctcgcatcgacccaccatagccggtcgccgaaggccaccacctcctggtcgatgtcgaccgtcctcctggctggcaatggggacggcatgcccaccagcttgtcccactccccggaatccgagagaaatcgccgcacgagccacccctggccgtcttcctcgcggttgccgtcgagctccgccaccgcgtaccgagcaggcggcccctgaccggcatcggactgggtgaggagcccgaagtggaggtacctcgaggtcttcttcgtgccgttgaggtcggggaggcggtacatctcgccgctgagcgggttgcagatgaaccgcgtcacctccgggtcgcggtcgacgccgtcgagggcccactcgcgcatcggctcgccgccgcggctgccgacggtggggaggtggttgcgggagtcgtagaagcggacggggacgaggccgtcgccgctcgtggcgcggacgtccgtggagaccgtgccgaacatctcggactcggcgtcgtggcggaggcgggggtcgacgaagctggcggcgaaggtgaggtaggagacgcacggcgggtagtcggcgtggagcgacgcgcccggctgcgacgacgccccggaccggtccatcttcgacagctggagcagcgcccacgggggccgcgccggcgacgcggcgcgcgtggagaggtagcgggcgaggccgccggagacggcgccggtgaggcggcggaggcggagcatcgcgcgcggaggcgtggaggtggaggtcgcggtgatttggtgtagtagtagtagtagtagtagcctgtagtgtactactggtagcagagaaggggagaagagggttttgtgtttgtgggagaaaccgagagaaggggatgcggaatgaacatgaactcgctctacggaccaaggaaaagcagcgtggtcaaaagaagaagggaagactcttcagactttactatcaagctgtactcggatatttttttttctttaattacaagctgcatttaattactttggatattttaactacaaagctgcatttaatggtatttcagtaggaattaatttttagaaatccaaataatttagaaattttctcaaactgaacgcgcccctaatgctttctcaggtgacaaaatcgaagggcctaataaaacctttatagttaagataactgttgggcctgtagcccatctacagtaatttatctatgagactccgactacaaaccttcccgagttgtagaattttttttttaaaaaggagaaaagcaaagttggagaaaaaaaat

SEQ ID NO: 24159 - DNA, 1501 bp, Oryza sativa
atcaacaattgacatacgtgaaaaaactacaaactattaatagaaactagattgtaagagaatatatgggatttaagttttggaaggaaattagcccactggcattataaagatcaaatgatagaaaataacatctcaactagatgaaagtatgagaccaggtagtagtaacatcctagagagagaaatctatctacacctaactagttacctcaggaaaattcccacataaaacttcagaattagtaaatattaaatataaatttcatttgtatataaataggtttcgaaaaagaaggttactaaacatctgtttacatataatttcaatttaataactagtatagttaggcagatatacttaatatcaatagcccatgcaaatgcgtggtttaacaactagtgcacctttgttaggttctgttatttaccagttcagtttagttgcagtggcatgttgctaaaatgcaatcttactgatacaacttacgtagttacctcagagttgtgggcagaccaataattgagacttcctgagttcaaaactccaatgtttgaggtacaacttctcccttcggcctaaatcaagagaaactcacagattcagtgttactttctgtttgtttatgaagagaaaataagtaatgcacttgactaaccccgtgccaacgccacacattcctttcatacagaaatcttgtgctggacaagtcttccaaaagtgctttagcaaatctgaacaacagaataccagcatgctgtgatgcctacatgggaacagacaaccgtgaaaacaaatatggaatgtgtaacccttcgctaaaaaaagaaactaaatgctgtgataggtgcaccccaaagatcataggtaccaccatttatccatctgtcacgcgaccatcaataatatagtaccatgatcatttgtatacacatcaggggcatttcaaaaaaaaatacaaacaccattttaaatttcaaattgttgagcagcaatgcaacaaagttacactagaacatgatgttgatatctggtcagcacataaagtgataagggaaacatgaagtatgggtcaatttatcaaataaatgtacctaaaactcacaaattcatggttgcatacatgctgcacagatttttttggaacacatcaatggccaattgctggttcatgtgaaaccaatttcccaaaaattccatatatagaattgaggacagtatgaaggaatgcagtgttaatgtatacaccatatatatatttctgttttggttcagttggcccacttagcccatttggcccatgtatatgtatataaccttcactaccatctagggtttactgctgaatatatttttcgtgatttcccccaaatgttgaacatggtatcagagcttgcctgggattcgccggagctgcgtcctggacgtcgcatcagcgatctgctctgctgctaataatctcttctcctccgccggcaagtttcccctgtcctcaatctt

SEQ ID NO: 24160 - DNA, 1501 bp, Oryza sativa
ttacacacatgtgaatcaatgacaaattgtgcattaacttttgcaaattgcaatgttttcacttgtcatttgtcaaatactcaacaaatgttatctttttaagatgccaaagcctttcctttcccctttctatccatttgtgctgaatcgggccagttgctttgctgccttgcccttgctgacttgttggtgtagctgccctgctcggcttagagctgggttgctgcgtgcagcccagtggcggacacaggattttgaagatggtgtacagagttatcaaatcgttgttccataaagaaactaaagcttaatagtaggaaaagtaatgagaaagtttttcttgctagaacaaataaaaatagaaacattgcaaaatagctaaagaaaaattaaatcttggagaagagatagtatgttttcatcccaaacactccatagagatttttgcactaccatttaactttttgactgctctaccatataaattcagatatgcacattaatcaaatttcctaaaagcaaccatcaattgaatcaaacattaactacagaaagatgagttaggagcctaaaaatatatatgatacgaacacattcaacccattgagccatgaggttgcttctccagtgcagtggcttgtcgatcagctgcttgttctcggcttctctccgtgaccacgagcagcgcctgcacacggctgccattggttggttgtcccaaaccataggaaggcatgcaatatgctcggtattctggttgtaagccccatagacaaaccagagattcagggtcatgagacgagatcgaggagcttgtgttgttctgccagagccgttttctatgagttgtattgtgattttaggctaaagaatagctgttttgacccaactaatgatatatataggtaatatacctattaattcaaagattattagtcaaaaattttgggggtacagatgtacccccatgtcccatgctaggttcacccctggcgcagccgtgcatgccaggtggcaccgcgacactaggagcagacgagcaccgccatgccggcctgcagcctgcagatgctcgccgcctagcctagatgcattgcccacgtgttaacaaccaaatttggtaatatcggcatcggaaaagaagattagatcgaagtggagtcgaaggcggagatcgattcgagaacagagcaagaatcggctggagtccagatcggctacgaataggatcggctgggtctgagtcggactaggtaagccgatacagccaattccgacaatacgacttggtgtatgacatcgggttgaattgaggtacttcaagatgattgccgcacatggatagagtcctgagaaggcaattgtatctattaatttggatattttatgtaatttccatagagatatgtttgggcaaaagtctgccgcaaagacttatggtatcttagagtatgttagagataagagtcgtgtccgatatggacatagtttgtaattttcg

SEQ ID NO: 24161 - DNA, 1501 bp, Oryza sativa
ggtcgcccggcacgtcgtctcgctgcgccgccaccctcgtcctcatcgcagcagcgcgttccacgccgtcctcgtctccgtgcagccgctgccggctgcccttgtcgcctcctcgccgattccggtcgtcgtcctctcgtcgttcccggtcgtcgtggcgttcgtccctccgtcaagccgttctcgtccgttgtccgcgtccgtcaagtgtgccgctgcagccccgtcgtcgtcttcgtcctcgcctccgcatcgccaagcgttacgccggccgcgtctcgccttcgtccaaggatcaccgccgaagtcgtcccctcgcctttcgtctccgtcgttcccggccgtctctgccgcgctcgttcgtcgttgtcgttccctcgcctcgtcgcgtggtggtaaggatctctcctctcgctgccccgtcctcgtcctttcggtgtcgccccgtacccgttgtgcggttgtcgacgccggtacccgtgtactggtgttggtaatcgttcgcttgtgtgtgtggtgtccgtgttagtgtgcccgctcggtagccgcgttgtttccacgtgtgcggcccgcgtggtgtctagtggagtccgtttgtcagctactcgcctcggttgacacacggggtccgcttccatcgacccgtggaccgtctctgtatactcggtctaccgcggtcctttaggttgacatgtggggtccgtatgtcaacggcgcagccttcctgtcttttccaggctagcgcttacacatgttttatagttgtaaaacctaattataataatccgcaaatctccatataacagcattaaacttcggatgaccatgtcttggtcatacgagctccgaatcgatccgttcaagtctcctaatgtttgttataacctaaagaactgtgtgctttctttttatgtattgttattgcttctttataggcttgtagctttgcttgtgtgcttcgcgtagcttctatcgttccggaggttcccgaagcatggttcgtggtcgtcgccgaaggttcggaaggccgttgtctctgagcaaggaaagtcacatcatccttgagcatattgaatcccagtttataaaattattttgatttaaattaatgcattatcgctttatttaaattcctgcgttatcactgttttatttagccatgcctatttacctttgttatgaccttattattatttctattgttattattaccttgttcaccctaggaaaataaaaccccaactagtgggtactctatttatggttccactagtatgaacttaggtagatgcttcgctggttaattaggcaacattaggtggttttataactttagactttgggaattctcatatcatttggacactatggagtggttggcttatgttggaattggacacacacctccacctctattcaaaacccccaaaatggttttaggctgggctcaaggtgcgtggttgggttttgttagtcgtacctcgggtactataaggattaa

SEQ ID NO: 24162 - DNA, 1501 bp, Oryza sativa
aatttgctaactcgcgaccctcgccgtctacaattttgaatgcgcctggccgcaagacttgtgtgatcgtgtaaggtccttcccatttgggtgagagtttgtttcgccatgcttggctttgaacccatcggaggacgtagtcgccgatcgaaagtatgcgtgctcggatgcgcttctcgtggtaacggcggagggcctattgatagctggctgctcgaatggcaactcgttcgcgatgttcctccagtagatttacatcgatgtttcgctgctcctcctggtcctcatcggaatgcttctgtactcgtgtactctgatgtcgtagctcgctggggagcatggcctctgagccgtacacgaggaagaagggtgtttcctggttggacgttgtcggtgtggtgcatatggcccatagtactgatgggagttcttcgacccattttttgtcatgtgacatgagcctgtcgtagacgcgggttttgatcccttgtagtactataccgtttgccctctcgacttgtccgttgctttgagggtgggagaccgaggcgaagcatatcttgactcccagcccgatgcaataatcctggaaatcagcgctgatgaactgggagccgttgtcggttatgatgcggtgcggtagtccgtatctgcaaaatatccccttaatgaatttgatggcgttgtcggccttgatttcccccgtgggtactgcttcgatccatttggtgaatttgtcgatcgccacgaataggaacctgtagccgctctgtcctcgtgggaatggcccgagtatatctagcccccagcacgagaacggccaagtaagagggatagtctggagcgcttgcgcgggtagctttgtgtgtttactgtggaattaacaggcttcacatcgctggaccatgtcacatgcatctttaagggcggttggccagaaaaacccttgtcgaaaagctttcctgaccaatgtccgaccagcggcgtgtgacccacaaatgccttcatgtatatcaaggaggaggtgtctgccatcgttggacgagacgcatttgagaagtaccccgtttggcgctttcttgtatagatcgtcgccaaccatacagtagatttttgctttacgggttattttctcggcctctgtatcatcctcgggcagctcctcgctgttgatgaatttgattagtgggatgcgccagtcgtctgggtctcgatatcggcaacggcgcgttctgcctttgtggcctccgagctaatgtcgggggtgtgtcacgtcctgataaattcatcccgaaataaaaatcattttctaaaaggaataatagaattaattaaaattcgaaaagaaattggcaaacactaaaatacgtacaagaaaatttcgaatgtagcccggagaatttttgttaaattctccttggtctaaaaggagccctcaaattttacttgaattttcagagcaccggaaatatttattaaacaacaacaacaattaacaaag

SEQ ID NO: 24163 - DNA, 1501 bp, Oryza sativa
gtgaggccaagaagaaagggcaccgcaaccacactatgcttggcatggactctgtaagcctcttcccttctcgtaatcctattgtcttccgatataggatgggcaagaaactgcgaaagatcgtggagaaaatcaaggaacttgtctcggagatgaactccttcggactcgtacaccagcaggaaacacccaagcagtggaggaaaactgattccatcatggttgattttgacaaggatattgttatcagatctagagatgaggagaagaagaagattatcaggatattgcttgataaagctaataacacggacctcactgtccttcctattgttggaatgggtgggctgggcaagactacctttgcgcaactcatttacaatgaccctgaaattgagaagcatttcccgctccgcaggtggtgttgtgtgtcggatgtgtttgatgttgtcactattgcaaacaacatatgtatgagcacagagagagatcgtgaaaaggctttgcaggacctgcagaaagaagtaggtggaaagaagtatctcattgtgttggatgacgtatgggaacgggattatgataagtggggaaagctaaagacctgccttaagaagggtggtatgggtagtgcagtactaacaacaactcgagatgcagaagttgctagaattatggtcacgggtgaagttgaagtgcataatcttgaaaatctaggagaaatttacatgaaggaaataatcctgaggagagcattaactctgccaaacaatgatgaacattttggaattctttgtaagattgtgcacagatgtcatggctcgcctttaggtgcaaaagcctttggttctatgttaagtaccaggactactatgcaagaatggaatgatgtattaactaaaagcaacatttgcaatgaaggggaggataaaatttttcctatacttcggctgagctatgatgatctgccatcacacatgaagcagtgctttgctttctgtgctatattcccaaaagattatgagattgatgtggagacattgatccaattatggttggcacatgacttcataccactgcaggaggaagaccatctggaaacagtagcccagaatattttcaaggaactagtttggaggtcattttttcaagatgtgaataaaatttctcagcgggaggagaatgtgtataggagtcagctccgtgacagaacaacgtgcaagatacatgatcttatgcatgacatttctcaatctgttatggggaaagaatgtctcagtataattggttcgtctaatttgaaaaatctgatgcgagaacatcctttatatcacgttctcataccatacaccagcattgctcttccagatgactttatgggaaatgaagctccagctctccgaactttattgtttcgagggtattatggtaatgtctcaacatcacatttatttaagtacaattctctacagctaagagcattagagctcccaagaagggaaga

SEQ ID NO: 24164 - DNA, 1501 bp, Oryza sativa
ccactattccatacttaaatttaatgatacttatctcacatgatgtcttggatgttgtgtacaaactcttggtttccttctctttccttctttattcacttgttacattattttttaattctaggtggcagcttatttaatgctatggacatcatcctaatcattgagctgggaatagcctaacatagtacacaattaatacctagtcccacttgtcatacgcacatgtatcttgaagtccgtgcttcagctggctacaaatctatagcccgctgctcttctctcttatcttttagagcaggtacaatggcagactattagccaactataaacatattttaataagataaaagatgagagagaaaagtagcaggctacagatctgtagccagctgcagcacggatttcaaaacgcaatatatgtatgacatgtgagaacatatattaatagtatagtaagcaactattgtataaattggctattagatcggctatagataaattagagctagtagtggattatactattaaatttgctcttatctttttaaaatatgtttatagcttatagtctattgctgtacctgctctaaagtgaccttaggacagtcccaaccctccacctaggatggtgtttatggcattaactacattgctatgtaggacttttagcttatgtggcactatattaattaagagagagagagagtgaagagaggaagaaactgagtctcatacaagacacagtttcaacacgagaacttatgcactagacactatcaagtttttaattgggagataatagtgtcttcataatagatgaagaataaatataatcggtagagaagagagatgatgaatttattaatggaccactttaaaaaaccatgggttatagagtgtagtttctatcgtaaagttttattgacatggcaccataaatactacttatagatactgtgggttggtattgtccttgttcaaagcaggcagaccacgggcccacgaagccacgccgaccaaacctctgcagaaacagaggaagaggcgaaagagcggctcgccgcccgacaaatcccctccaggcctccatccacctccgcctcgcgccacctgtgaccccctgcacgccccgtcacccgtcaccttgtccacgcgcggcgcggctacactgcacctgcacctgcacctgcacgcagcacgcgcgcctctgcgcccacccatggctatagccaagctagcccacccgcgcccgcacggccgcactcgcacccacgggagaattcccggccgcgcggcgcgcgagcaccaatctaaaattggcacggcctctccctccccctcccccccgcatcccgcggcgtgtcctctcgccttctgcctttcctcccttagccagtagcccaaatttacaccgcgccatttcttcattggcctggaacgacgacgaccacgtacgccatggcgcccggggccacgctcctcctgcggtgagggcacc

SEQ ID NO: 24165 - DNA, 1501 bp, Oryza sativa
gtattcatatatatcactaagtcaaaaatctgttctgatgggcacttgcactaggtgaaactcggtgaaccaaaggaacagactggattggttccatctgatgcaccttaccaacagtattgacattctttgagttgcagctgacatgatcctctatagtactagaaaccagcttctttttcactgtacttccatgtaccaacatctcttcggtaccaacttctggtgtactttgcatattaggttctttgtcttttttctcacattgtttgcttgctgtggtagtgtgaacagcttgacttgggggcccttgaacagtgctgcagccagctaaagtcaaagctttctcactcgcttttttccaatctagcttgggcattaatgactggctggtcccacttcctctctcttgctgcttctgctgttcttgaatgttcttgaattgaggagaagaaaaatgttgcctgaatttttccacaattgaatttttgttggattcctccatatccaaaaatgcctctgatggaccctgctattggcaccaacgaagtgcaacacagaagaagcacaagagctaccaagatttatgagacagcctcacaacatttaagtaagaagagagggtttcatgaagcagcccatgaatctaccaaacgccattgctccccaactacttcagctgcctcttccttctcgattgtgggaggtgaagaacatggagggattgaatcaagaagagctcctccaactaaccatcattcagcaccaatcagggttccaagtagaagaggtgggcagagagttacaagatgggatcagagaggaggttatggtggttgaatggtgacctccacttcttggagacctcttgctgctgctcattctgatgtctttcaaagagatgctccaagatcccctcaaagcattaacaatattcatagcaggaagcatacttggagtgctttggaggcgcatcatgatatctttgttgatcaagctgctggagatactcaagggggtggtgcaagtgatgctggagctagctccagactgatactggctatagatcctagggaatgcaatgtttcagagattcagcttgttgatcccagtgctggaaatggtggagatggaagtggaaagaatgatggatgggcaatggcgccagcccataaggcatcaagggcgccatgagtcttttaagctggaactgccgaggtatgggggggtcacctcggcagtaggaaaatgcaacacctccaacgcctaatatactctactaatgctaaggtaatctttatttcagaaacaaaaagctctaaagttactgcttctgatctgatccatcattttcatgtagctaatagtcatgtggttcctgctgatcaagcttctggtggtttgtggctgatgtgggatgaagacatggatcttactatagttcagtctagtgttaattatattttagcttatggagtctataagaactctggtcctattt

SEQ ID NO: 24166 - DNA, 1501 bp, Oryza sativa
ttcagagacgccgccacctgatggtccgcgagcggcccgatgatgtcagtcagaggaagggcctacgcttaatcaagtcacaatgtgatatcgaaaggaaaatgcagaatgcctttggagtacacttacattgatggcaacatcacgttcggccgcccctttctcacaaaggggaacggggatggtactcgccgttgtcggaccactgatcatcacctggccaacacgacgttccacggcttcgctgttcagacctgtgaatcgagaccaaattttgataaatcaagaggaacgcgaacatgagcatgtcaggataaatgcgagaaagataccccgaggagaaacccgagtcgcgtcctacggtctggaataatcaaaggctggatgggcccgagcctggagcggctggatccgcctaccaacgaagtctgcagcgacttcataccccgacaagcctcgtactcggagatcgtcgataatgtcgataaacgactagagagagggggtcaaagggggctttgcggtccaagacgaaatcttgtccggttgttctttgggaacaacgaagacagggtccgaatctttgatctgaaggtagaaccacctagtccgccatttgctgcgagaagaagggcactggaaggggatataacgcgacttcaggccatctcgaagtcggaacccgacgcaaccagacaccctgttggactccatccaacgcagctcgtagtagaaccgaaagagatcaataaagggctctaccccaatgtaggcctcacaaagatgagaaaagatgctaagaaaggcgatagagttggggttcaaatggaaaagagaaagaccgtagaagttcaaaaccaagagaagaaattcagaaggcggggggagaaaaccgcagagaatatagtcttcgatcgcaaccatgcgacctaagatgggctggggattagtacctcctgcttccctttccatggttccgcgaccgggaagggcgctgtcttcctgaagcttcttcagcgacgcactggtggaggatgatttgccgagatccatcgctgatcagagatcgccggagaaagggctcagatcgatgaactagggtttcttgtggcaacggagaagacgaagagcgcttacaggtgggatgttttcttcacaataggcggacttcaaaatggatccccaaaattcctttaaatagacgcacttacgactgtgcgaattccaaggaaaggggagagatgcccgccggagatttctgggtccgttacgtgcggcagttttttggacttcagtttaaattcactcgtgaccgttgggcttcacacggtgttctcgactacgtcctgtctctatggtcctcacaccgggaatgacaacagtctcgacacgacaagtcgcgaatggttacacgagttcatttaagcagaagtcgggggctactgtcagggttacgggttaggcataccctttacccttcgatatacgttacatatcggta

SEQ ID NO: 24167 - DNA, 1501 bp, Oryza sativa
gctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaagggaaaaaattcagcaacaaatctctagactcattaaaaaatccacggaaagcttacccagtactatgtatttatgggcacaatgatttaaagtctatgagtgaaattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaacttgacagggtgcaggcaagcatg

SEQ ID NO: 24168 - DNA, 1501 bp, Oryza sativa
tgtccattgacttattgtatttgacagtatggttcatgtcatgattcaatataaatttcatattttgacatgttaacatcacaaaaaggaaactgtaagtttcttgtgctactgaaattctatttagtttcttctgtagcaccttttttttcatggaataatggtggacgctgtttgtttcattagatgctcttgtctcttaatagttttactgcaagtcttaggtctttggtcttaccttgggtggatttgatcaggtatgtctgatattaatgatacaaaatgcattgtatgaagttaaaactaccttggccgttcacttgtctatgaacagtaagattttctaggaggagacaaatgggctgtcaattatcagatgtgaccaatccttttctatccacaatacactcactgtttctagttccatgcatagtgtgctactttgctttatgggggaactgtttagttttccagtctgctcaccagctttctcaaagctcttctgatccttggagtggtattgtggtaagttcctgtttcttactttcttatagtcaaatatctaattatggatagttctacagatatctgaaaatgacaccaaccttagatggaactcttgcaaattgctgcaatagtgatgctttcatgttggctacagaaccaggatctcattgtacagaatcaaagataggactgctgggaaacctctagactctgtttaaggattaaaattgaaacctttggaagttgagaaaggcgggcttgagtttccttgtagcaagcagtatacggatatcaactacagtatgtcttctacacctttctatcccttctccatatgttagttgctagtcctgttgccttggtgattctcgtggaccaaagtatatgtgagctgtgcatttatatttgaaacctgttgcttgttactgtcccaaattctgttcataattggctcactgaactcttttatttttttaaaaaaatatgtgcagtgcaatacataaataaaataattgaagtccactgtttcctagttcttgaaaatgtgctatggaattctttaagtaggtttcttagaaaaaggtaggagcttcttatttctcatgtgtatcagggagggacaagttcaggctgtgactgctgtgagcttgtgatttgattgaagatttcaaaactaccattcctggtaagatcaccggtatatacatgctcgcggtaggtccacgtacaaaaatagcagtagcagatggttttctgtaccttcgttcatctcttaatacagaaggattgatggcaccttttccttttcttaatacatgtatggttggagcatattccttagctatgggtctgacacctgttcattcttcaactcttaaattcagcatgcttcttagtcttttatcaaagcagctagattttgaacatcttttgctttgttggaaaatattctcgtttccaatgtcctttttttcaactacatttccaatgtctt

SEQ ID NO: 24169 - DNA, 1501 bp, Oryza sativa
aacaaaaaggtgccggttttttgtacgacaagacaaaggtgtcggtttttgtctagaaccggcacctttgttccaatagtgcttttcatgcccgatggtgggccctacacatatgtgctggtttttttgtatgacaagacaaaggtgccgatttttggtctagaactgacacctatgttccaaagtgcttgtagtagccattggtgagccctacacataggtgccggttgggaagacaaaggtgttggttttgggtctagaaccggcacctttgttctgacaatagtacatatatatatataatccatcccttgccactcgaactgattgagcaagaagagagtggcgcctctcgttcttgccccgagcagctagaggagggcaggaggttttactccattttttttgtggtgtttggttaaaggttgaagcctaaatgtaaaaatcaattatttctcgctccgtttaactcttggttgttgatttgaattgccatgtgctatatgcatgcatgtaaaatacactatgggtgttgtttttagggataattctttttatctttttttgtgtctattgttgcatgaaatgctaaatttgcgttaatgttttcttccatccttcgtcacggccgttagtcaaattaatgctagtcaaactatgttaaggccatggaaatgtccattgatagcttgatttatctcaaatttatgttacgggtgcccatcgatccactagaggagatggaaatggttttgctcgatttttcttgggttttggttgaagattgaagcctacaaagtaaatattcattatttctcacccagattcacacctgctcgttgaattgaattgccgtgtggtaatacatgtaaaatgcactagtcatttgtatggatccatcagtcatttgtagatatgttcttagatgtcatgctaaattttaattaatgttttattccatctacgccatcgtcgttaatgtttcacattagccaaatattttttttgcattgacgaaaaatagaattttttttatcttttcattagccatgaatatctaattaaggtgatgtgggcgtgcgcaaaaatctcaattttatcgtagggtaaaatgggcattactctttgtttttattctaatgtgcttgtacattatgaaatcctcattgtttttttccttcacgattggtaataaacgataattattgcaggtacccattggatataatggatctagaatggataactatagcggatcgtgactctgtggagtatttcaggggagtaacggctcttgttgatgcaccggaatatatttggtgtccatgccatgaatgcaagaaagacagacaacttccggctcacgggtaaattcacatctccttacaatgggttttagggacaacttccttggcgaggaggtgcacgtgaggaaagtgccggcaactgtcacgggcatgatgcggatgttggctgcgaggaggataaccaaacatgtgtc

SEQ ID NO: 24170 - DNA, 1501 bp, Oryza sativa
ctttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctaaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggcgttttttgtgtattcttttaatatataatttttttcttttcaaaaatgcggaagaaaaacaaattggaattgcaaaatttaacgctgacaaagcatccattcaaggcattcctttcttttttgagagaatcccttatatgccactagaaattggttagttctcttatatgccactcaaaattggcttctcccttatacaccactagttcaagtttttctatccttttatgctactcccagcactatagcatttgttgactgttagtcaaatattagttttttttcataaatgaccaatatgccatctcaactaaaaaatgtgtaaacttcaaaaaaatcataactaattttttttaaatcctttttgagtgaacaaagttttgtcagaacaagtggaaaatgctctttgtaataaaaatattgttggaaagctgcatgtttcatacttgtattgaaaatttgtttgtgatagtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcataaaaaggaagagacaatttgaaggggcatataaaggaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttttggttcaatatgttaagaaaaaaaaccattg

SEQ ID NO: 24171 - DNA, 1501 bp, Oryza sativa
atgcaggcttcaaggaaaggctgttgtttttgcagttgattttatttgaactcctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccaggcctagctgatcccatcagctgcagatttttcaaacagcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttcaaagccgatacaggtttaccatatgccgacgagaggggtcccagaccaacaacaggttaggtcccagaccatactatgccaggaagcccaggggtcctccccgacaccaccccgacgaatccacatgtctctcgacatcaaggctcccctgataagctagttactcagccaagggtgtcatattccacccatgtggtcgtacttgtcttatgtttggatgaaattcctaggaatcggtccttaagtgcgagagcgggaaaaccgtacacccggtacgttccccggtccacggttttggaaattcatttagttcacaagcaccgacccaagtgtcgggttttccaagtcttttgtaaaactcaagttttacccaagaagttgctcagattttaaatttgaaggcgcccttcggtactcgcacagattgcacgatttccgaggcgcaactgggtggttacaagggaatatggtataacaattaacaaaggaaggatcaaatgcaacaaactaggtagatccgccaatctgccttgctgacgggacagcagattaagtgcgatcctatcaatgcaaaatattttgcaagtaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaatattgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgggcggctagggcgcggcccaagggaaaaggagcgaaccagccgagctaaa

SEQ ID NO: 24172 - DNA, 1501 bp, Oryza sativa
actttctagtataaaatttggaaacaccatgcttgatttcttcacttcatttctgccagagtaccagactgccattcatgcagacaacaattgttgaaaatatatgcaaaaacagtgcgaaagggcatgtagcctagtggttgcagtgacctgagtagcaccccaaggtcctgagttcaaatctccataggagcacatatatccagttggatgtagagtccgggtaaatatacccttctctaaaaaaaaaatgcaaaaacagcacactaccaccaaaccgcatttcattgacacggatgcctgagtagcatcgagatagtgagcacttcagcaaaacccagtaagtaactatgccatacaataataactctgtagtgaagattcctgttaagaagccaaattattgattatactcgccagtccttcagagaaaccacgccacaaacatcagaagaaagaagctcgaactaaagccaactttcatcttgcacaactgttggattcaagtctgagatgaaaacaatcagttccacgaacctgtcaggaacccattgagctacacatgggctgactcaattgctaatccatgccaaggcccaaacaaacaaaggagatgaatacaaaagggagcagcaggagaacttcaagcaacgaacagattcatcggcggcttcggccacggcggcggcggcggcggcttggttcggttgaacctcgtcgatctctatctttttcttactctctcgtgttcctcttcactgccacttctagaagcttcctctacttcttctcactcaattcctcttctattttctgagattgtatttgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaagtttttcagcaccaaaactctgtttttgctctgtttttctatgttgtcgtattttcgtcagatactgttcatcgttctgaactactcagacaagctaggatagccacaatctcgcgtgtgttcagagtgttctagctaacaattggtatcagagcagtactggaacgatccggcgatgtcatacacaccgcctggccgtcgtggtggcggtggcggcggggggagcggcaacggccgcggcggcgcaagcggcagcggcggggggaatggagcagacggcgcattacttccgctcgtgtctcaggggagagacgcatcgcacaccgctcgcctcccagtcctctcgaggacaaactacccggattgggcgctcctga

SEQ ID NO: 24173 - DNA, 1501 bp, Oryza sativa
cgccgccgtcttccgccgcaccgctggacgccgccggagctgctgcttgttgccgcgtgggctgctccacctggttggaggaagagaggtggcgtcgcgcttgggccggcccgccgccgagctttgctgcgccggtcggagcacaccgccatggcctccctagagaagacacgagaggattaggtgggggtgggggaggggtgagattttttatattatctgtgggtcctattataaagtttctaaaccacactagcttgccacacttgaattgtggatgtagtgtcttttggagttcccagacctacgtggcagttgtggcatagcaatatgctaggacgcattgctactgcccttagagcaggtacaatagcagagtataagcaagctgcaaacatattttaagagataaatgaggagagagaagggcagcgggctacagatttgtagccagctgtagtacggactccaaggcagtgtgtgtatgacaggtgggaccagatattaatagcatagtatgtaactattgtatgaataagctattagattggctatagatgaattgtagctagtagttggctatactattaaacttgctcttagagtaccttgttgtatgtaaggtggcgcggcctccgatgctgaattattgcaaaccagaagttcaccagcaaagcgacatggagcgctgacccaccaagcccagcaaacagcagcatgcaaatggctgatgcacaggaatgcacgctgatggcagagaagttagaaatccgatggagctctggttcttaatctacttcctctatcccatataaagaagcaactcctaacattctaatataaaattaaaggagagaataaaagaccaaaatatcccatcgtcctattctaagatgctgaagccgatagtgattttaagccgatgatgactatagggcttaccgaattttgatgttaacaggtgtgcagatggctgatccgcgcacccacttataaatcaagataaacaagtttgcagctttagcttataagttaattttatggattagctccttacacccttaaatacagtagagccgatgtgagtctggatcctgcaagtggaagggaaggcggggcgagtcgccgggcgttgtgtttggctggccgtacgtccccttcgactgagcttggcaggctgcctggctgtcctgcccggttggggtggttgtctttgcatgactggccggctgggtccccggccttcttagctggttgagcacttgagctacggctagggttgggcccactaaaaacaatcactaactgcctgccaacttggagccatgctgtgatccaacttgttgtacagaacctcatgcattattgcaggtggtggcctcctgcattattgcagacggaacacatcatcacgacatctcactcaatttctagtgatattttttcagtcatttatttccagaccaccaagaacaaactaaagcacacatcgatcagtagc

SEQ ID NO: 24174 - DNA, 1501 bp, Oryza sativa
tgaaaatattttaccaaagtgtatgggatgtcatggtatagattgaaccgagaggagaggaagggagtcggactcggtggagatgatagcacgaggtggacactcggccttagtttggaaaggtcccccgtgaaaactagaaacaaatctgcccttcctttttttttctcttcttcctatccgaaacaaacccacggaaatgaaaggtagataagttggagtcccgaagacaagcacttaggtggtctagctgacacgcgtaactatacgataaagtagcaatggctaatgtttaatctaagcaaacccaataaaccctgaaggggtaccaagctatttaaggaggtgggtagatgactaaggggtccctagggtcctgctccacctagttggggcacgccctgcatggccccacttaggccgagatcccagatgaatttacgagttcataggctaaatataggtgacacaacaccttgtttctattattccagcctatgtagttggaatttggagctgagcttggatccgtttgaaagaggactgcaaaagctttccatcaagtactcacggacaaaaaacggagcacgtatgcatatttggtggccgtttgaaatcagcactttagcatgtggccgaattggatttcagaacttggtcagattgatcttgatgcaagcaaaggttatattaaaagtcaccatggtcacatcatcgtatgaaatattaattaaattgactatttgaagaaacgagtactttcttgctaacgcacatggctaggtgtgaaagtttctaaaaactatgagggaccatttatcaaaggaaagcaacaagttgattatgggaagctagaactcgtccacttgataaactttgagctgcactcaagaaatttttaccaaagcttatgagatttcatggtatagattgaaccgacaggagaggaatggagtcggacttggtcgagatgatagcacgaggtggacacttggccttagtttgggaaggtgccacgtcaaaactaaaaacaaacccgcgattggagaactgatctttcactagtggagagttgccctttttttttatttgcatggccctgttgctgcatggtttatatatatatatatatatatatgcaccatggtgcccgggcaccatggcatcaaatacacaaattcaatcaaaattttcaaattgtgagtatatacctagttataagtattcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcacca

SEQ ID NO: 24175 - DNA, 1501 bp, Oryza sativa
gaagaaacgagtactttcttgctaacgcacatggctaggtgtgaaagtttctaaaaactatgagggaccatttatcaaaggaaagcaacaagttgattatgggaagctagaactcgtccacttgataaactttgagctgcactcaagaaatttttaccaaagcttatgagatttcatggtatagattgaaccgacaggagaggaatggagtcggacttggtcgagatgatagcacgaggtggacacttggccttagtttgggaaggtgccacgtcaaaactaaaaacaaacccgcgattggagaactgatctttcactagtggagagttgccctttttttttatttgcatggccctgttgctgcatggtttatatatatatatatatatatatgcaccatggtgcccgggcaccatggcatcaaatacacaaattcaatcaaaattttcaaattgtgagtatatacctagttataagtattcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatacatatatatatatatatatatatatatatgagttggattttttgcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatata

SEQ ID NO: 24176 - DNA, 1501 bp, Oryza sativa
aagaaactttacattgatactaagtttcacatgttgttctgaaacgaaatgcttgatatccatgtccgttgctctcacattagcataatgtacatcagaagtagaatcctaccagattttttttttttgtaattcttatcaaaataaattcatacttaaaagagagggagatcatggaaaacaacgattgctgaatatcatttaatcatgtatgaattattcaactagttattttttcaagattattagtaagtactaacaaggagaaaaagacataatttgctagacatgattgattagttttggaaatagtatcatttacgacatcaaaatgtggagattattctagttccacaaactaataactagattgtagatgtaaaacatgccaaaccttcagttactaaatgaaataaactgcatgggccagatatgtaacaagaagcagtccatgtgatgtaataattttagtaactaaattggcagaaaacattatggaactactacatgcaacaggtttgcaagtcccagctcccaaaggtcaaccaaatttactgaaaatgaaagcatcacaagagaatgataggggttgaaatcatcagtggggtcaataagtcaagagggttggtgtaacttgtaaggctatgtatttagtgctctagattaggttagtgaaaatacaattctaagctactagagaagagacagagaagaccagtatttcttccagagcttaccatgaaatcacactccagtctctctccaagcttcagaaccagacatctctcctcttctgtgcaatgaggtcttctaactttagtggttgaattttggcagtctccatgccttcttcacaagattatatatacatcagtttcaccggtcaaagtaagcacagccttccttgattctcttttgtgcgactttgtgatgccttcttgcattatatacactacatattaaagtcacacattcttggagcagagctatgtacctaaatcattcttagaagtaactaaccttcttcaacccttactttgtaaccatggctttctctactactgaaatctctctatgtagctccattggacttctaggaaaggaggtggtctttacatcttgagcgtccagaactgagctatttgaacagccttcacttgtttgtttttcttctggtgaaatattggcatcacctttctttgacaaagttgaacattcatgaattcttcttaacttttttttttatcctctcattttcctgagatcctacttccagctcttcagttggtcttgcaagttcatatgttccactgctttcttgcaaagaatccttgccttgtttacatgcctaagtttgttgctagcatcattctgcctatactttgattttctcttgttttctcttccttcttgcaatcgtgacaagatttacaattgtaatgctccactctgttctgaaaaaactaccatacttatccaaatcattctagcacaatcacaa

SEQ ID NO: 24177 - DNA, 1501 bp, Oryza sativa
atatatgttaattctaattaagtgctaaatataacatagatttgtctttcttatcttctggtgtgaaaggttatatgtgtggaccccgtagtccgcacaaccccacgtaagcatcatggtcccactagtcaatttttgtccctctcacgtgaatagcgcagctatttagaataaaagaggtgtcacaactccaataagatttatcatcggcaccgttcgagcagacttccatcgtgccacggaccaccgctatgggtggccgtcgatcaagacctacttagtaggggagaaacggatgctagaaagtttcaatctcgaccatcggattatttatctaaatttggatacaaaagctttaggaagatagagatcaatttaatatatcaaattctcattatcttaaaaaaaatactagattaacatcaactctttttttttcatttccatgaataacgaggtacacgcatgggggcgacctgtgggcccaacccagtggtccccacagtcctgcgtgggcattgtgacccggcctccacccccaggtttgctgtctccctttctctggtaaaatagcatcacctgctctgtgctgtggatggcgaaggcaaagctagcttgcatatattggcgagatatatatcagcttgcaaccactcccaccaccaccaccaccacaatagtgtactattccccggcgagagatatcctaaactccaaagcaggtagagttcagagaagtgagtgattgggaaagaaacaagcggtagggttcattcccctcctcggttcctgtgtgtttgtgtgtgtgccacacataattcctctctccttgatgaatcatctggccactatatttttaatctctctttgctcgtttggtgtgtttctcctgttgtttttaagggtttggttggctcagcatagctttcccaaatctttgtttttcttctaaccttgttcctctctctttctcgcccgagccatttctccgcgacctcttcttctccctcgcttggcacggtgtgctagcttccatatctcttcctcttttgattagttccttcttctgccgtctcgcggttgcttctgtgtttgtttgcgtgagtgcaacttgttcgtttgtcatctctctcttgcgttaattgttgttttgcatgcaaacatgagtgttttttttttgttttgtggtttgtcctgtggcaggaaccacacatatttgttatctaggtgaatgctaaatttggttacaagtatttatgtgttgctcacttctttcacttgtcttttagatcagaagcggccggaggagaggcagatagataaacagtgccagccatgtcgcctcctctgtgacttaaattggactgaattgatcaggtggctgcgcctcacctgaagccaacaaagtaagcagcgagaggacgcgccgccagggtagggagagcaagctatatatctagctgtgctgtgctgtagtgatcgatctctccctgttgttttg

SEQ ID NO: 24178 - DNA, 315 bp, Oryza sativa
atttccaatataaaacaaatatattataaaaatatattccgtgttatatttaatgaaactaatttggttttgtagatgttgctaatttttttataaacttagtcaaacctatagaagtttgactaagaaaaaaacaaatcaacttataatatgaaacagagggagtataagataaatggatatattttcctttactaaaatctgtaaaaaaaaatgaaaatagttctcctttagttcatatagtttcttgttattaggctgattgctacgggtcatggaggaggcaatccgctctggccatacatcaccttccca

SEQ ID NO: 24179 - DNA, 1501 bp, Oryza sativa
cacaatttttatggtggttaatttctctaagaagaagggggaaaaaagggatataattggatgttgtcaaatgcctgagtactgatcagcatattagttatgagcagtcaaaagatatttaccaaggcaccaacttaatttatttatgcacaaggtgaagatgcgtgtgttgaacgtatggatcgatatatgctacacgtgtggatacaaacattgcctctactgcatgcccctcgaatctctctagtttgtaattatatgccatgaattttgtactcttccccggaaaatgttttgacctctcgatggatcgttgtaccacgtttatttagaaaccatcgaaatagttataattttttaatttaaaaaattatattattcatacaatatatgtatatccctttataaaatttttatgtccaaacttaactcatacattgagatataaaaaaagaaaaattcaaccatataaaagtagtagtgtactatttatatctgaatttattttttccctctcaatgtagagtggtatatttcaatatttccctataccgtatattatcattttttaaaaaagaatacaactattctacttttttttaaaaaaataactattttgcaatgaatttggaagaaaatgtgtacgatgggacattgtaaacccttaaggaggtacatgatggaacatttacttgagatattaaaattcatttcacctcttttcctttgtaaaatggaaactgtcgacgggctatacccgactacggtatttgtaaagtatgaagatcgtacgtaccagaatatacgcgggattgtatcaagaagataagaggcaatgatttatattggttcgggctcttaagataagtaataaccctactacagtttatatgtattgttgggagatgtgccccacagattacaacggaggagaaagagatgatcaatctaatccgccgactagaacctaccacagtccagctagatctaatcatcaactagggcttcggcttcttccagattgtatcttgatgtggctttggctatggttgtaaggactctttatatttatagcgatgagtatcttcttcaagtagaactcagagtttatgctagacactagtgggagaaactttgttttttctaaataggactctgacaccttataccccggataaacaatttccttacagactcgcaaaaatctgtatataaggaatttccttcctgtatacttattaagtatgtggtatttttgtatatcacaaacccttgtatagaagagatataccttatctataacccaaacaaatatatatatatatatatatatatatatatatatatatatatatatatatatatatatatatatatatatatatatatagacacacacacagatgaaggaagatctctcgctcatttgaccttttttttaaaaaaaatacacaattaagttatgccagggagacctacacaagtattaattaatgatcaa

SEQ ID NO: 24180 - DNA, 1501 bp, Oryza sativa
agcttaataaatttgtctcgcagtttacaggcgaaatttgtaatttgttttgttattagactatgtttaatagttcaaatgtgtgtccatatatccgatgtgacacggcaaaaatttttaccccctggatctaaacacatccttaggaagtgtttgagaggagggaaaggagaagattgagaagatacacaaaacgatgtgaaccattagcacataattaattgagtattaagtatttcaaacttaaaaatgattaatataatttttaaaagcattttttaacgttttcgtagaacttctcttttaaaaaaagacattgtttaacaagtcaggaagtatacgcgcagaccgaattctacggcgaagggagtactttctctgtcccgaaaaaacaaacatcgtctcgcaaaaaataaatattcagttttagattttttttttttgacggagggagtagtttgctaggtttccctggtaggagtatatgcttgcctggtcgaactgatgggagaaaaaaaacaaaaaaagggtactttttgtactgtgctatgaccagctggtactgcctccagcttgagcttacctgactctcagactgaaagcaaccattcatgccactagcctcccattctccctgtgtcttcgagtccctgtcacagtctaaagttgctggctggctctccttacaaagtctatctggtagtacagtacaagaccaaataacttatttttattaatcaagaaaagttgtatgagaccaaataatttggcctggatgacttgggagaatcgcttatcgcttatcgctaggccctatttagtccccaaaacaaaaattttcacgcaatcacatcgagtgtttgaacacatacatagaatattaaatgtagaaaaaaacaattacacagattgcgtgtaaattgcaagacgaatcgtttaagcctaattgcgtcatgatttgataatatggtgctacactaaacatttgctaacaacggattaattaggcttaataaattcgtctcgtagtttcctgaattctacagtaatttgttttgttattagactacgtttaatacttcaaatgtgtgtccgtatatctgatgtgacaaccaaaccaaaattttttttccccaactaaacaaggcctttttggaatttggaagtctttttacagccacggttcatgaccagcagcaaagtaaataaatgaatgattataacacttctactcttattttagcagttcaaaaggccgaggattgaaaaatggaaggcgcctaaaaccattacaataattctaaaataaaattctactagaattaccagaataccgagcactgaacatcacttccatccaccatgatgatgaattgtgtggatactccgagcaagcaacagaataccagatcaatatggaccagaataccggcctgcccctgtcatccctcgccttccaattgcaggcatgaaccttgcttacaacttacaagataaaata

SEQ ID NO: 24181 - DNA, 1501 bp, Oryza sativa
actttggcgtctttgccagcgggtaatagtggaggatgtcctcatcagagcctttgtgttttggcttcatacatatcctcttttcaaattttcatttcagatatttctatttgcgtgcttaaaagcatccaactaacctgcgagaagctaacacaaagcatgcgattattaaaaccaccgaaacttcacgacatatattactccatccgtcccaaaatataagggattttagatgcatgtgacacttctgagtatgatgaatatgacagagagtatatctgcattcactgtattaggaagtgtcacatccgtccaaaatccgttatatttttggacggagggaatagatgtttagaggcatggtagagttttgcattttaccattatagattgatttgcccgtattaattgcaccttattgattgctctctctcctatgcgggcattccatgcagcggcttgctcgagtgctgctgttgttgctcaacttcttgcaagccacaaattgatactacacaaatgtatcatataccaagccagagcaaagatggctctcagatctacctatgtcgcctccttgcgagccagcccaaaggtggctcccaaatccgccgatgtcgcgtccttgcgagccggagtgaaggaggccctcgtagctttccattcctggccacccatcactgccggagttgaggtcgaaggcggccatgcctatcctagaagcactgccactgccggatccagtgaagtggtacagggagtcggtgaaggggtcgtgcccgccggcgggggaaagtgaatcggactacgacatgaagtccctcgtgctggagccgtccgtctccgcctcggactaatgcggtgggtgagatcggcggaggcgggcgtgagcggtggcggtgagcgagatcggcagaggaggaggcatacgagatggggaaattttgggggagcggatgagagagagcgtgcgagggtaagggatgcgagagagcgagcaggggcagtgtgcgtcccacatggctcccaacgctctttttagcaaaacttgctgctttggactcccaaatgataaatgccaacttgtctacttttgctagtagtgtttagatctattttgccaaaaagtggtccaaaacgacaaaactttcactattttggaggatctaaacagacccttaatatgctatatttgtctccaataaaactgttgtcatatactcttcggattcacattttgaactagacttttttctctctctaaaacttcaggtacatactatatataaatttagtaacaaaataaggaattcaaataagcccatcaagaggtacttgtatttcccttttatttttcataattccactgttcagtggaacgaaattaaatcgtggggcggaaaacccaaaaaaaatgggaaaagagggaaacgctatccgctaacccctcgcgccgtcgcgcttcctgtgcctcgaggaccgaccatggcggcggcgaggc

SEQ ID NO: 24182 - DNA, 1501 bp, Oryza sativa
gatttaataggagaacaacagaaagaactgcataataataaaaattaagcaccataggaaaaacaccaatgatccatactgcatgcatattttacctgtttaatcatgtttataatctgatcaatgtggtctgaaacgcgaggctccacagatggtggtaaacaatgaagattagccatgtctgataggaagtcatcagagtaccttttgcttaagctaaaaggatcttctcccaattgatttgctcttgcaattatctacagaattccagaagtgcaactcaggtatcctgtgcagattagcaattggcatataaattttctttctaggtttcaagcaaaatagcttaatataatgagggaggtaaatatattgaaacaaatttgaagttaaattcaggtattaatctgaaacaaacacaacattggttgcaatatgaatcaaacatgaccttggtctactctacttcaactggtcaacatgacacgttttctccatattaaaggtatggatataatgacttctaactatagaagatgaacaggtagaataactgtagcataaataaatacaatacgattccttgtttacattaaatttagctttcagataatgaggaccagcatcacttgtttgaaaataaatttgacccataaatcaccttgtcatcaatgtcagtaaaattccgaacatagcgcactttatggtccaaataacgcaagtacctgccagatatcatgatacatgagataagcatatgaccgtatggtactttctagcaggagaggaaaataagacaagacaacatggtaagagtgtgctgaatgtgaataaaaagaccataaaggaatacggccggattcagggtgtgaaattgttcctgggtatgatggttgagttgctccgttatgcttagctaattgagatgcaacagtgaattggcttgttttcctaacgtcataacaaattaacaaccattcccagagtaccttttctgtttccggcagatctgttgctaagggaagagttaggatcatttcgcacgcaactaccataacagtttgccgtagttctaatgtcagaacatcctaaaccgagctatttagagcgcaaaatgtttctcacagtgtgtccacaaacaaattgtgaatgtacataatacattgtgtaattttgcaatgcacttactgctataaacatgtctcctcatttctccatgtatagaatactgctattaagtcggtgtaaatttgttaacacatccatataactaattaagtacataacgcctcattgggtgagtcaattgcacagcacagtcaacatcactatcactagagcacgcaattcaccaacgggaccaaatccggagaagaatgaagctagggggaacctgtagaggacgtcgaaggcgacgtaggcgcgggcgtggccgatgtggctgtcgtcgtagggggtgacgccgcagacgtacatgccgacctccccgccgggcacccgg

SEQ ID NO: 24183 - DNA, 1501 bp, Oryza sativa
gccccgttgacattctatgatatgcacaaaaggacatataactataaaaggttcatctcccactcaatggaaaagtagaaaactctgtttatgtatcttcaagatatacacctaagatcatgaataacataaagatgagaaacaaagaaatcgttgaggtaacttaaaaacataatatatgtatttccctcaacccataaaatttgcccctttcttttttgatacactctaacatacaatattgcacctttaatgcatcagctagagcacaaaccacaaagttacgattctataatcactagaaaggctgaataagactcaactttcctataaatctttgcatgaaagaactaaatttcattatgttagaaatgctatttattatagaatcatcaacagcttgaaagagcaacaaagtcctttattttgaatttattccaacaaagccagcaagctcacacatggtagcaacccctcaatcatattacacatgaagcaagttcgctgaatccattatcacttggccatatctttattgtgcaaaccgatacagtgattaaggagatgaactaaacatcaccagctaaataaatcctactgtaaaaggattatcttcttcaataatcaataccatatcaatgacactccaactaataaatggcatcaagaacttggacctgataattgatatagtgatatgtgccatccgaagactaactattaccacgcaaaccaaaacgaaagtcaaagaagaaactcagatttgaagcaaaacgggcctaactttaatcaagatccgatcgtttcttaatgtgcacacttcttcagttgtagcaatccaagaacacggattattcataagctacatcgaaaaataaattaggaatatagtcctgaaaaatcccaaatccaatccaattgcaggactgcaacatcgtccctcttgtttcaccctcccaagatcgattcccccctccacggtgagccccaagatcgaatgacaagagtcagagcatagaaccggctgaccttctcggagtattggcaggggacgcagggcccggatggggagcaccggtaggaggagttcccctgcgcctccacgaacccgagcagcgacctccgccccccggaggacgtcgtggcggcggcggccgcggcggccatcgcgatcgccggagggatccagcacagggcggccaccgcgaggagcagcagcagcagcagccgccaccgccacgaggtcgtcgccggcgccttgttcgccatggctgcctccgccgcggtttcgctctcgctggcgcggtggtggttgccttttgttggaggttggagagatgcacccgttaacccgatactcttctcgggtcgggactcgcgttaacgggtctgaacacgcgaacctgacagagcggggttaacgggttagaaacctaatgggcgctaagtgattcgggttaacgggtttgaaccctcgaacccggatttatactgttcgtct

SEQ ID NO: 24184 - DNA, 687 bp, Oryza sativa
cggccggacggcgtgttttgtgaaaattttatttttggaatgatttgtaatttttgttgtagattattttagattttgggatgattttgtgaatgactcgtggatgtggatgattttgtggatgggctaagaactgtggatgatttgttgtgcatgatttggtgatgatttgtgtggtttggggatgatttgtggggatgagggtgacaataaatgcaagaagcaaaaaaaaataaaggaaagaaaaaagcctaaccaaccggactaaaatgggactaaaaatccattgagtatctttagtcccggattggtcgtcccggtttacaacctgggactaaaaggggttataaaccgagactaaagagcccttccccagtaatgccatgtacaagtgaaaagtaaatacaagaatcattcatctctagagttctttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttatagg

SEQ ID NO: 24185 - DNA, 415 bp, Oryza sativa
cctacgattcaatatagtgtcacagtttgagatctcaaattcaaatatgtttggtgcattaattaatgtaattcaatatggtatcagcacaaaagacctcgaattcgaatccagctaagtccttagctgcgatgcaattagataaaaacataaaacctattaccgtttcacacttcaggttttaggaggcgtatataagtgaattctccacagtttgttaaaaataaatgataataaatttatctgctctaaactatgaaggtatagtatcaagttaattattgatgtccacaatattgataggtgaaaaaaaagatggaagccctatttttagccttttctcttagtaatatcagatttgatttgtacgtcaaaagaaacaaataaacaagcaataaaattgacaaaagacatg

SEQ ID NO: 24186 - DNA, 414 bp, Oryza sativa
cactttagtgatttttaattggttaaaattatttctagagctctgaaaattccactaaaaatcctgttaatgcatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacaaccagcacccaggcgctgctgggccgtcacgaccaagttggccacgtcgtccagccatcgctgagctggagactcagggtcatggacgacgggtgggtgacgtaggagcgcgctagcagcctgaagcgcaccctgaggcgtgctgccgtcgccgtagacgaggaggcgacgctccccatctcgccg

SEQ ID NO: 24187 - DNA, 1501 bp, Oryza sativa
ctcggctcgtttcctggctcgagccagctcgagctggcttgcaagcctttctgttgaaacacctcttcatatatatttaataattattaaaaaaaagtaaaaacaaatcatcaacatgtaaaatttaaataagtttttatattcaattcttcaaaatcttaatgataaatttcaagttgacaaataataacactatataaagtaaaataatcaatataaacacacgatggcctaggcttacgagccaaaacaagcggctcgcgagctagctcggctcggctcatttcagcaacgagctaaaaaggaggcttgggcttggcttgtttgacttacgagctgagccaagccaaccaagctcgagccaagtccgagctgagctcacgagcccgagcttttttttccacccctacatgagacgtagttgtcagtgtcacgctcggacacaatgcatgtgggggctggctgatgcgcgggtggtcgcgtgccagtgcgataagttcgccgccctctctaagagcaagtttaatagtatagtatagcccactactagctctaattcgtttatagccaatctaatagccaatttatacaatagatgctttactatactattaatatatggtcccacctatcatacacacactgtgtcttgaagtccgtgctgcagctggctacagatctgtaacctgctgctcttctctctcatcttttatctcattaaaatatgtttgtagctgccttatagcctgctattgtacctgctccaagcgagattgctagtatatgcgatcagtcgcgcgcccctccccgcgcgactggacacatgtcgcgcgtggagagagaggacggtagacgtgccgtgcgggatgagggaggagcgggttttccctttttttggtttttttctgttttttttttctcttcggttggttttttcttttttttcctgtttcttttatggtccgttttttccgggtgtttttaacatgtatgtatactaagtttgtattcgtatgtatacaaaatttgtatacgtcctatataaattttgtgtgtatatattttttatgcattaaaaatatattactatatatatacacacacgtatggatatactatatacattgtatactgtaagagagactagaagggggggggggggggggcgactgacctcccaaggccatccatagtgcttcacttgaaaaagctatgccatctagaacaaagctacacattggatacaattctcacaatgcacacttatgtcattcagcctcaggattcgggaggcactgattggcgatcagtcgcgcccctcgcgtgccgttcgatcagtttctcacgttttagtctctctgtacagtgcatgtatatgcatatactttatatagacacgtatacaaagtttatatgtatgtatataaagtgtgtgtctatatatatatatatatatatatatatgtatgtatgtatgtatgtatgtatgtatgtatgtatg

SEQ ID NO: 24188 - DNA, 1501 bp, Oryza sativa
gagagcaagaggaatatggatttgattcagattgctccccattgatgcatccctcatttttgctccatgaattcaagatttgatagtaaaggccatttttttttacaaaagactacaaaagctctcttctcaaatacctttctctaaaaaagcgaaaagaagcaaatgagatggttttggagagaaatgagtatgaatgaatcttatgtacccatttgagctagaatgatgcatttatgcaacccaacaatgagaactcatctaagtgctagtaggtggccgtttatggtcaagataatgttttggataagattgagatttaaatttcttttgattgattggcttcttggagaaattttgaataccaaaaatgtttgaattagccaaactatctttttcattttgaaaccattcacaaattccttttagaattaagtatacaaaacatttaagttaaaagctaaaacaagatacttagagctacatttttgttgaattcattttctttgaaaattagctcttctttgaaatacaaaagtattgagagacatttcaaacatactttaaaatcatttccaaatatattctcatagaaaagctatacttgttcaaaattttcacttttggctaaatggtttattttgaaattaccaactagcacttagccaacttgagcacatatgagggatgtgatatgcatgaatatgattgagtactaaacactcgtatgccacaacctatcttgctcaaaaatgcataaatgatgactttcacatatgcaaggaatgtaaattcttaaatgctatgagaatacaatacaacctacacaaggttaaatacaagataaatcaatatcgatacatgttaccgagatgacattggttttttatgtgctccaaattccaaacttggtgagatcactaacaagtatatggatttacaagaaacacatgatgaacttttgtgttctcatgagaaccttgtagattatcatgtcagggtagagatagctcatgaggtgataattgcaacggtaaaatcctatgagccacatgttcaagttgattttacttgtggctaacacttgttgctccaaaacaaacatttccccgagcactacatgtgacgcgggccccacctctgctatgcctctcgggtcttcgcaaggccacgtgaaccacatcaaaatgttggctcgtggagcccacccaacacagccagtaacctgcgaacctcactgggagagctacttgcactgtgagggcattcacagctgtaatgccccgattttcggtcgggattaaaaatcatttaatattgcattgtctagaaattaaataaaagataaatcaatttaatcaagtgaaattatggaggaaattaaaatttcctttaaaaatcattggccaagaatattttgtaatattttttgtgccctaatatactctccggaattttccgtgaattttcggagctcaagaagtaattttaatagtacaaa

SEQ ID NO: 24189 - DNA, 355 bp, Oryza sativa
ttcaaaatcttttagtcaaacttccaactttttcgtcacatcaaatatttggatatatgcatggagcattaaatgtggacgaaaaaaaaccaattatacaatttgcatgtaaattgcgagacgaatcttttgagcctaattacaccatcatttgataatataatgctatactagccatttactactaatagattaattagatttaataaattcgtttgcagtttagaacggaatctgtagtttaacacagcctcagtcggtttactgatttctctgaacctctctctcctcttctccctcgtgtggactctcctcttctctctctcctctctctctcgcgcgcgcgtcgcagcca

SEQ ID NO: 24190 - DNA, 1404 bp, Oryza sativa
aattcactttaaaaaaagagagaatcaattatttaccactgactttatcacacgtctacgatttgccactgactttatcatgttctacaatatgccatcgacttttgcttaacttctacaatttatcatcgccgtccggttagtctccgttagtactgtacaaatttgtcaaaatgaccaaaatacccctgggagaaaaggtttcaaaatttggataaaaattatgaaatatcatatttcaagtttttggtcaaattttggatgtttacaatcttatgtttataatataatattttgataattttatccaaattttggaagtttttgtcatatggtattttggtcatttcgacaaatttgtacagtactaacggtggctaaccggacggtgatggtaaatcgtagaagttaagcaaaagtcgatggcatattgtagaacgtgacaaagtcagtggcaaatcgtagacgtgcgacaaagtcagtggcatataatggattatctcttaaaaaaatcaaaacggagaggcccacttgccatccccatatgctttttcctttatttttcctgctctaatttttcccctttcctcctcggccgttgccgttgccgttgctccccaccatctttctctctctctctctctctctcctcctgccagtagccgctgccgccgccggcgagcgattccgcggtgatgttcgcctggctcctccgcggctgccgcgacgagtgctccgcctccgaccagctcaagcaggtccgtctccttcctctcccatctcatcccccaagaatcttctctcccaccaatttgaatgcgatagtgagcaaaaagaaaagggggcggaatgcgtttttttttttttttttttttttttttttttttttgcgtttgtcgactcaagagagggagatgctacggtttgtcatgcccccagtgggtgaatcgatgagtgcgtgcttgtttcgtccctgcgcccccggtgggaggaggagatggagcgagcgattcgtgtgtttttcttttttttttttcttcagtggtgttcatgactttcttgtccacagtgatcttctaggactctgtatcgcgggcgtacaatgcgagttgttcatggttcagaccccagttgctgcctagtgccctaccctcctaccgaggcctcctgatggcactgaatggatgtagtatctgttaattgaattactagttcttttggttagatcaaattatgttttttttttctcacctgttgctgatgcagggagttgtgaaagagaaaaacagatgctggttttggggtgcttttagtgtcaatgtgggctttagtagcgatgccaaattataatgtgaaaagcacagtaagaaattaaagggaaacaccctttgaatgcaactttca

SEQ ID NO: 24191 - DNA, 246 bp, Oryza sativa
gacgtgcggcggcgggacgacgcggcgcaacggcgacagtgccggcgcgggcgggctcgaggcgctgatggcgacggcggtgacgcgaaggcgtggtagcggcacggggctcggggcgcggcagcggctcagggcgacggcgacaggacggccgcgcggcggggcgcaggcgcgaggcagcgagaggacgggcgtgcggcggctcggggtgcaaggccgacggctacggctcgcggcgcatggcga

SEQ ID NO: 24192 - DNA, 1077 bp, Oryza sativa
gtggatccccccttttgtggattttcagctcttaattcaaaattggagtgttagaaatagatgatttaaagaagagacatgacgattataccttgcaaaacatacctgcttgcgttaatgggcctactggactggactcaatcctagtgcaccaaagaaaagatttagccatttataagggcttatttttaccgaaaatcaagaccttcatcaatagtcatacactactccctctatttttaaatatagaaaaaaagttcatttcactctcccgaactatttcattggatcacttaaccccctaaattatttttttcttatttcacccccaaactattagaaatggttcatcttaatccttaattaacagtatctatcaatcctacaaattaaattccattacaaaatatgacttataaagcgaggaaaaaaggagatgccattaaagattaagatgaaccgttttcaatagttcagagtgtaaaatgagctgagaaattgtttaggggttaagtgccctggcgaaatagttcgagtgagtaaaatagactattttcttaaataaatgatgatgttgaccattcatattgtataaaaaaatgtagcatcacttattttgttgtgattttgtttatcatcaaagatattttaagtatgacttgcattttgcatatttgcactaagttcttaatacaataaatgaccatgctcaaatattgacaacgcgatgtaattaaaaactaaaaaaacggagatactagtactcctatgtcatataaaaaattttaataatagctataaatctgaatatgtgtagattaaattttttatgggacgcagggtgtaaattggatattatatagttgaaatatctagtactaacacacatacacccatctgatcaaagagtagatatatctgttcatttccaatacataaaaaaaaaagaagagaaattggtccatatatctccaagctagcatttcgtagcttctagctagcatgatcacttcaccgatagctagacggatggatggaacccatccgtatgaacatgacggggcaggtgagaagaga

SEQ ID NO: 24193 - DNA, 1501 bp, Oryza sativa
tcagggaaccagagagcgatctccttcttcccgttgtccacggagtcgctcccatggatgacattcctacacaagaaacaacagcttgagcttaggcatcgataagcaggaagcattatgatttttattttcaaaaacaaaagctagaattgaacatagtttaacataatccaagtagttattatgtctaaatacactaacatcgtaacatatagaaaagatgaacatcataatgcatgcaaaagtttttgtaaatcatatcacagcacattcactatctgataccttctgactggtaaaaaacagaggttcacacatttatatagatcaaaataaaagccacttaaccacccattttcaaacaaaatcatcgtttgatgctagcagcaaaacaaataaagaaccatccatcgctcaggatccttacatgattaaaaggatcacaagaactgactgaaaattcaagcaataatgagctgatgaccaagacagacaagaatgactcacctgccaacttccacggcatagtcagcacggatggtgccgggggctgcctcccagggcctggtggccccaatgatcctgcggccagtggcaacaacatccttcccttcccaaaccatcgcaacgacggggccagagatgatgtactccaccaacccagggaagaagggcttgtcggaaaggtcggcatagtgctgctgtgcaaaggacctctccacattcatgaacttcatccctggatcattgcagttcaaaaagtaattcgtaagcaccatcatccctcaaccgaatattacctccgttccaaaataaaaagcatttatacttgtttttcagaatgaatctcaagatcgagattcattgtgaataacacgcataaatgcttatagtttggaatggaggaagtatatttcttaaacaggggaagttaaatgaaattaagtttttggatgatgttttgcgtgcatttcgaataattctcataaaaatgggcttcacagttgttataatcgccacatcaaccaatacatggctacacagttgttataaacaggggaagttaaatgaaagtcctttacttctgttctttgttgctgttccttaagacagctgtttttgttgttctgtaatgctttataaaacattttggtttccactaaagtacaacaacttttaataaggaacaaaaaatggaaaagagcacgttaaatgcatgccaaagatattagttgaactctattgcaagtacaaatgatgttttcttttcagaaagatatttccatgattacaagtacaaatagtagactacatctttgaggctttgacgatctctgctataataataaataagttgcccatgtcatgtaatgcaaaattagacttgacaacgaatcagttgatatactaaattgaatattactgtgtcagtctgttgtccccagttaaaaatggccaatcatcaacatataaattatataaaaaaatcttgcttttgaat

SEQ ID NO: 24194 - DNA, 319 bp, Oryza sativa
aaaagaaacaaaagtttgggcaaataaatactgaattagagtattgatagactagcatgcttatgaatggcaaggtcagtgcaaaagagagcatctagttactgaggtagtgaggtcgatccatagaaagatgtctattacagatgtctccgtagttcataatgaattgatgatttggtagtaagcttcacaatactattctgaccagctcttattggtttccatttttgtcacataattttatacagttgttaacactgcatgtttcctctaatcttatgatgttgctccaaaaactaatttttcaaattttggcagg

SEQ ID NO: 24195 - DNA, 1019 bp, Oryza sativa
cccttactgccaaattatcaatttataatccttggttctattaacattttaaaacatgaaaattactggtaccttttcaaattaatactttagttgttgctgaccataatttttctgtgtatatgatatgaagcattgatttggtaaacacaagtgcactatcatctataattattcaagaaaccaaccatgcaggctgattttgtttttttcaccaaattattttgggaatgttctgtgttattatatggtgtattgtgggggccaagggtcttattagtttttgaccataaagtttgtttggttgctgatcgtagtttccttcttttctagttttttcttcgttgtgtttaaccctggcccttaagggcctgtacgagtctttctagactcactcccctatcttcttaatataatgatgcacagctctcttgcacgttcgagaaaaaaaaggtggtattatggaccggatagggtaagggtcaaaagactgagggataactcaccctctaatagtgccagcaaggcttctccttgctgagttaagagaggctttgaggcttagagctaacttaagaatttatatattgattgattcataatggagtacatgtggtccctttatatataggtaggactcaggactgacttgacatctaaggagctaatctctaatattgtatgaaccaatccatctctatctcttgtttacaaacctcgccactttcctaactagataatctcctatctttatttgacctattccttatttataatgcctaaactgtttcagggcctggccaatgcccataacataacatgtggactgagcttcttgacattatttcttttagggtttagcaaaaatacatgtttgccttgtgaacaaaaggagcattctgattattttactcattgtttacaattacttggaacttggtagaaagtaacaaccctcttcatgctgttagttctgtaagtgcaacaatttaagtgctttaccatgtaactatttcagg

SEQ ID NO: 24196 - DNA, 1501 bp, Oryza sativa
ttatatgctattcccacctgaatggattatcattcaaacactttgctcatcctttggtgcagatatcgtacctccggaacctggggtgcaccatcacacccacgtctcgcctgcacgcgtcgcatcttatcgagaagtacaaatctctatgacttttcactgcttgaacctgcaggggacacatgatttcaagctcagtctcagaattgggaccatatatacagcaacgctggtgaaagttcctcatattaactgtacatgctgtacatatcgatgtacttttcccgtggacatggtgtggttagagcaaacgtcttgttacattaccaggctgttcttgggccacaagggccaaccaagaaacgaaccgggccttctctttggggaatctggctcggcccacaaaataaccagctatgggagactcagtcacatccctcatgcaacgtacatcctccgtcttgtaaaaaaaatatcaacttctagctatgtactttatgggatggattgagtacgggttatgtgatcattgcctcttgtttttgcgatgatccttgtacgctagtgcctagtggtataaaatgagctttgtatataatttggtccattttttttaaaaaaataaacctgcaataaaacgttttctagaaactggacctacaatatggggccgtgatattcaatgtgatgtgcatacagcatggtgttgtataatttggacgtcgatgtaggatattttgtgagaccattatacgcggttgcctacatagcctcaaattatgtgacacggtgccaatgtgccataaacatctctatctctaaaatgctaccgacggtctagaatatatatgatgtttaggagaaccaaaattgacttaaatgttgttatatttttctgtcctaaacgtcgtatatgatcatgattggatggagtattttattagaggcccacatgtaaaagatatttaagaaaaaaaaagactaaattaccaaaactaccccgctatgtactcctatactgcccagtctgccctacaagaaactcgtgcgtgaacttctactgtcactgcactcttcctctgcacacacgtttcagtctctcatcagcccgacgtttctgctgcaaaaccacggcctgattccgattcacgcaaatcgcggccaaatctcgcaaaccaaaaccaaaatcgccacctgtaatgtaaagaaaagaaaaacaaaaacaaacaaaagtgaaaaacagccaaaccgacggcccaaaaagaagccgcagcggtgcgtttccatgtggcgaatatttccaggatgattccaatcggcgcacggcacctcagcacatcacaccagatatataattaaccaccccgtctctttcacgacccactccgcctcgcctccactcctctcctctccgcatcctcctcatcgcctccgcttctgcttttttttttcttttttctcgttgatcggtttgttcgatcagatcggttctttggagaga

SEQ ID NO: 24197 - DNA, 749 bp, Oryza sativa
agttcgttttagccgagctcttcattactggttgctcgattcctccacacttcattttagtcactcacaagtgactcttcttaaatcccttaattgacatttcccattgatttcgtgaaagatttcgttttcttgatatagtcactcttgactcatttctaattcacttttttttttttgtttcttcagaaattatatttcggcatgcccatttcggctgcacaccatttaggaatgttgtatctcgattcaaactattgtcttaaagttctaagaagatagtgttgaaataagacggcttgggtataaaatgagaaaagtattgaaggatagtacattttaggtcattctcactgaaagcgaagctaacgaagtttgtttctacagaaaaaaaaaacaactcttcacttaggtagtgcaaaacctcattctgaagaatttatcgttgaatacatgctaaatgggactacttaattattcacttttgaaaaaaaaaatacccttacaagttacaagttgttccagaccagagtaaaagtagcaacaaattgaaccttctactaacttctcagaaatgattaaaatcttggcaggatacaggtgttttctgttagcggttctaacttctaaagaattctacaagttctttctgcaatcaccaattttaagtttaatttgagatacagtactttgaattaatagaacttccatggagaaagacttactggctgctttgttgttcctgtagg

SEQ ID NO: 24198 - DNA, 1501 bp, Oryza sativa
agcctatgtcaccatacttataaactaatactggggcatccacatgatctaggcagcagccaaaaagcttggcgacattgcaatgctcaattctagattgcttgatcatctcataaagaaacatctctttccaaatctcatcagcctcaacagacatctttatcacgataaatcgaatgtttttcaaatgtcccatgcaaatcttgccaatggcacgctgaatgagaacactactttttcctgaaaatgcctctgaggttgatacctgtttcgggttgcctacgatggaatctattttttcttttgtgacgagtctttcaaaaccaatatcttgcaatatggccttgatttccctaaatgccacagttcttcgctctgtcaactctgcaatccttctctcttccatcaactctgcaatcttcctctcctgttccaacattttccttttgagactataaagatgttccaagacttctttcatttgaggccgatcttctatttcagacttcaaacaatcaagtgcaaggtttgccatttcctgtatgaagtccacattctcgttggttacaatttcgttgtcaaatagtttatatctttcatctatactagagtgagcaaaaactctagctagacttctgttctgatcatcaatccctttgcttctggtgatgagttccaacagaacaaccccaaaactgtagacatcacattttgggcttagtcgtccagtctcacggtacactggatccatgtatcccatacttcctataacaaaccccgtgtattcatcattgtccatgcagagaagcctagatattccaaagtcacatagcttcgccacatacttgtcgcctagaagtatgtttgatggtttgatgtctccatgaaggattggatgattttgagagtaatgcatatatacaactgcttctgctacatccaatgcaatctggaagcgtgtctctaatgagacaggaagctgaccaatgttcccatgcagaagttcagaaaggtttccattcgggacaaactcagtcaccagcattggagcatctgcctccacacaacaacccaataatctaacaatgttcctatgactacactgggactgtatgatcacttcttttgtgaactcctttttctgtgttctccaattatattgtttcactgccactgaatggccatcgtcgagcatacccttgtacaccacagaaaaccctcctcttcccaaggtagtgctgtagttatttgtgatgcgtttcatctgtcttcttgtgaagcacctaacatttggatcaatatccgcttttgccaatacttccttcgcagtatccctaaaagattgtgaaagtttatcataccaatctcccatatgagtgacacagaagatgtggttatattgtgcctgcaaattcgtgaagccggtgcattattcaaagcactgcatttattatttatctgtaacttacaatgcgcaaagctaaggccctgtttctttgag

SEQ ID NO: 24199 - DNA, 1374 bp, Oryza sativa
tgtcatatgtattctaggaaagaaaaacatgatttaaccctaaattaaccacatgaacagcaaatgacatattacaaatgcttagcccacggcatgcatagcaatttcaatatcatgagcaacaattgacatatttcgaaagcaataaaacaaacggaacagatttgaaccatcggggtttaccatgcgctgaccatcaggaccgaagtcctcttcgtcttcgtcgttgccgtcgtcctcagccacatatgtcccttgagacgacgacgcaccgactcccggtcctcctccgaagactccaaagtcgaaggcgggtggcccgctgtgcgacatggatgccgcatgacctcggaagcctccatcgccagatgctgagccagggggaacccatcctcagattcccctgccagatccaacgccattggtcaacgacctgccgtagcctcatcctcctcctctccctccacgacttctgccgcgtccccctccccccgctggaggacgcgacggggcgatggtggatctgctccctgcctgaatcggaggtaacccaaggctacccggttgaaggatctgttagtaggaggggaaatcagggaaggcgtcggcctgggagttcagatccaggccccccgatccccctcccccaaaatggatgccagcgccagatccagcatatcctgaagacccctgcgagaagccgtagtcggagccgtccatgtgggcggctggagcttcattgaacgactgggagaagaaatcgtgaggatttccccccgccattgctgatgcgcgattcgtgaggcttgcgcgagtggcagcggcttgcacgacgccagcgagccaatcggcgggcagaggacaagctagcgcgaagcagtggtggaggctagcgcagggagatggcggcgacggcgcggggtcgagaggagcaagagagagatgacacgaggaagagatgaggcgaggaagagagtgggcgaggaaatggatagggttggctaccgtgaaggggcagcgggtggaaaagaggcactttagtcccaataagcacctccatttgggacttctggactaatgcactttagtcccattttaatccctcctgtttgggactctagggacttaaagtgacttaaagtggaggaacttcttttttagaccctcaaagaaacagggccttagctttgcgcattgtaagttacagataaataataaatgcagtgctttgaataatgcaccggcttcacgaatttgcaggcacaatataaccacatcttctgtgtcactcatatgggagattggtatgataaactttcacaatcttttagggatactgcgaaggaagtattggcaaaagcggatattgatcca

SEQ ID NO: 24200 - DNA, 271 bp, Oryza sativa
ttaaatccgagaaagtcattaagatgataagtggttcaattgaaatatgtctatcaaaaatattttttttagatttagaaatatgtctatcaaaagtagacggagagagtagcatgtttaaatggatgataagtagaattacttattcttggtcattgtgctaagatgaaatatgcctattaaaagtagacggagggagtagtagagatagagatagagatagaaatagagatattagttattactacttaaaaaatttataatggtattg

SEQ ID NO: 24201 - DNA, 886 bp, Oryza sativa
ttaacacaataaaagactattagtagtagaatagtcatgaaaacacttttatatatgaattttaatacttttttaaacatataattagaaaaagtagtgatcagttttgtgcattgaaaactgtgttgtccaaaacgacaagtaaaaaggaacaaaggtggtactaattacttcctctagccattctaaaatataaggattgtttctagttgtttagcagtagtttaatcacttcaattgtcaatttttgaattttgaattgtttagattacctttccaagtatccgactgggctttggaattcatgatgatgggaaccatatgagttattagtgtagtactccttccgcctcataatataagggattttagagggatacgatatttttctagtactacgaatctggacaggcctattcagactcgaagtgcttgaaaaatatcacatccctctaaaatctcttatattatgggatggagggagtaatgtttatattgtgttatgaatttgaatcaaagaaaccttatattttgaaacgaatggaatataaagctatgtcatttaactggctagtcaacaagtggattggtaactctagtccacaagcgttttgccttttacagaatccatgagtgacctgaggcttctaaatggtccaaatggaacgaggggagcattacaggtttaaaccacggtatctatggattccaattttttacgtattcagaaaagtaaatttcggttatttgtttggaccagaaccttttatgtggtgcaataatgggcaagtccaaaacagacgtggcttgggctaacgataacaggtgtgtgcccactcgtcacgtgtatgccatgcctgacacctccagcttatctacagggcga

SEQ ID NO: 24202 - DNA, 1501 bp, Oryza sativa; identical to SEQ ID NO: 24180

SEQ ID NO: 24203 - DNA, 368 bp, Oryza sativa
atattttgatcactattcgtcgatcagtcagtgcgtgcaagctgctgcccagcatcgatgtgatgtacttagagcaagtttaatagcatagcccactactagcttcaattcatctataggcaatctaatagcttattcatataatagttacatatatactacactattaatatctggtcccacatggcatacacacactaagtcttggagtccatgctacagctggctacaaatctgtagcccgctgttcttctttctcctcatttatctttttaaaatatatttacagctggtttatagtatgctattggacatgctcttaatggtggcaaatggcggccaaaacgacgtttgtctgtgtgtgcagg

SEQ ID NO: 24204 - DNA, 508 bp, Oryza sativa
aagacgaatggtcaaacatgtgagaaaaagtcaacggcgttatctattaaaaaacggaggtaatattaaactgtggtgttattttctcctgaagatgaagatgaagttttttttacgcaaaacgaggtggtattaccgtatgattgattgagttttaattattataaacttgaaaaatagattaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagt

SEQ ID NO: 24205 - DNA, 1501 bp, Oryza sativa
aggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatatatatatatatatatatatatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttttcttcttttagttgacaagttcaaccagatggtttgatcggaattttcgaaaccatagatgttatatttttaatgtgacaccgcttacaagaatactatatcaatatattattaccattccaattagttccttaccatcgtatcatttccatccctataataatctaaggttgcgttcgtttgaggggttgttaaacaaaacggagctgtgaattagtatataactaattaaatattataaaaaacctaataaataaattaatataatttttaaaagcattttcctacatagatttttcaaaaaaaaacacacagtttaactgtttaggaaacgtccacgtgaaaaacgagacacatacacagtatacactaattcaaacaatatttcactcatgataataaaaattcaaatcacaaactgcacttcccctcaaataatatcgaaattgatgcttgaccagtcaacactacttaatcacacacaccacccagagccaaaccagattaaatcaaggtcgggggttgccttgcctaaaccaatacaaacaagctgctaatccaaaatcaatgtcccgtccgatcgcgagatcgcgatcgcaaactggcaaaatcgcacccgcaaaaatatctcggcacgagtcgacgcgacattccaatagcagcagcagcaagcagcattcgcattggccttcgcgcgcttttgcgtttacacccctcgcgccccctcaaaattgcagacgcccccctcccctcccctctcgtgctctcctctcctctcctcttcctcctcgcctcgcgtcgcctcctccgcggcgtaccctaaccctagcctcgccttccccccaatggcgcgtcacgcgtgaggagccgccgccggagcagcaggagcgggagcgggagggagggaggaggaga

SEQ ID NO: 24206 - DNA, 1501 bp, Oryza sativa
cttgcttagattaaccataaatttgtggctctaaatagccttacattgaactaatcttgctaaaacaaagggataacaaaacagcaaaacaacttaaaccaatctctagcaattcgcgcggtactgtttctgatccgacacgctgctagtccttcttcgccgcacgctgtctgcgctcatacgtgatgccgaccatgacatcaaaaaacaaatttagtccaccaataattattgaatactctcatgtatgattgtcgatttatgatactcgaggaaaaaaataatttggataaactaaaaattaatgtaagttcgaaaggtagggaaacatgataaattgtgtaactacacctcaacgaacactgagagccatctcgttgacgtggtaacttcccgttttaacagttcgatcagtctaaggctcaaaaggtggaaccaaataagccttgtacactcaacataaacccttgtagaaatgatcgacagtagcactaaataagctataacagtaaaattaaccattatattcctaagactaactaaaatgcactctctcaatcttatttgctttgtgctgccatataaaattacaggcatgttgagttacatgtagcaagcactccatgacatttaactaggtgagcatgacatatacgccgttcataaaaaacatacaacaacggagtcgaactaaatgaagtgatgataaaaagaacctacaatgcaacggagtaagttactccctctatttcatattactagccaaatactcctgctttgcaatagattaaaacaaattaatagtgatatttttgggataattttgtacccatgtgtgctatattgtacaggtgaaatatgatagaatcatatatttagaggaattattttataacattaaagtacatggatagttggtagaaaatatgataaagtaggtggtaaataaaaaaaacaactatacttggtgagtggtgacagattcactgctaccatccttgtcttcttctaatataaaaagagtatgataagtcgtttagtcaaaattttaagtttgacactatactgtgcataaagctttcatctgcgcaaaaaccgaaattgggagaggagagcggcgagggtaaacaaggttttgcctttacctcaaaggcagcaatggcggtcgtcgggtgattgtggctgcggcgcgggcgagcgccagttgcggctgtgatcctgccagcacgcgcatgcctcgggggatctctctgaagcagccgccggcggccggccggggatcggatcaggcggtctgttgcccatcattaccgaagtgggcgagggatccctcatcgagaaaatggacatttagccatcttcaaaacacggtttcgctagaatgccatctttaaaacgtgatccgataaaatgccaatatcaaggccacacaactcgccggattgccattttctcattttctcttaattccaaaatcattttgcctcttctttatggtgat

SEQ ID NO: 24207 - DNA, 1262 bp, Oryza sativa
ataaatgaaggtccaattcaccttgtcatatgcttttcaaagtctactttgaataaaatccaatttgtttgttttgatgcactgagttaagaatctcatgtaaaataacaacacccttcatgatgaaacgactcttcaagaaggcagtttgatatttggagatgatgtaagccataatgtcattgatcctattcatcatcacttttgttatgattttaaaactgacattcaaaaggcatattggtctatacttaacgcatgtggctattacggtagctcctttattgtgagtatcttacactcgaattgcacaaaaaaatgccgagataggagcaattcaagaaattctaatctgcacgcaataaactggtgcgcgctatttaaccttttcttctgcaagggacacaatggaacactatatactcctcatgtatagacattaacaccgcaacagccgtgcaaaagggtgctagatcttgacatattggatgctttacggttaggatctgttggttttccaagtgtacaagcaaagaaagttcaaaccgccatggcagcgaccgttagactcttagagtccagggattgcttcaagattgtacttctctgatgatgtcagtgttagtgatatgccaaatcatagagatgattgtatcacatactatgtttacatatttatccgacattgttccttgaaatagataactcattattggttaatgaatatgtgattctttcatgagactctttatgttgtttgttactatttctaaaggatccctgatcaaatatcatatgtggaacaaatatgtttatatgatcagcacatgtattaattaatgatcatgtctcatggatcatggtatagagataccaaattaataatgtggacacatgttggtgaacatgttgttggatagacccaacatgagacattgtaagagccatatgtgttgtgtcatcagtgatctcatttagtattggtgttgaatccttagacctgatattatcatggttcccaacatgtgtagtagcttacttagggactgctaaacgctactccgtaattgggtagttataaaagtagttttcgggtatgctatgaaacatgtagtgggattgcatacatattggatttagccgatggcaacaaaggttttactgtttaatctaatcttgtggattttatgacatcggacctccagccgatgtatgctttaaccttcggattagtatttcttttattatattatattgctagc

SEQ ID NO: 24208 - DNA, 620 bp, Oryza sativa
ataaatgaaggtccaattcaccttgtcatatgcttttcaaagtctactttgaataaaatccaatttgtttgttttgatgcactgagttaagaatctcatgtaaaataacaacacccttcatgatgaaacgactcttcaagaaggcagtttgatatttggagatgatgtaagccataatgtcattgatcctattcatcatcacttttgttatgattttaaaactgacattcaaaaggcatattggtctatacttaacgcatgtggctattacggtagctcctttattgtgagtatcttacactcgaattgcacaaaaaaatgccgagataggagcaattcaagaaattctaatctgcacgcaataaactggtgcgcgctatttaaccttttcttctgcaagggacacaatggaacactatatactcctcatgtatagacattaacaccgcaacagccgtgcaaaagggtgctagatcttgacatattggatgctttacggttaggatctgttggttttccaagtgtacaagcaaagaaagttcaaaccgccatggcagcgaccgttagactcttagagtccagggattgcttcaagattgtacttctctgatgatgtcagt

SEQ ID NO: 24209 - DNA, 1501 bp, Oryza sativa
agggagcagggccgctccggccgccggcggccgctcggggccgtcgcgctggtgcgaccttcctgcctggcttgtcgatgcgccctcgaacggcacgtgtcccgggggcaagcaatctccgacgcgcggggacgagggagagaaaatgggcatttagccacttttaaaacacggttttgctataatactattctgaaaatgcgtttcgctaaaatgccaatatgaaatacgcactcaccaccactttgtcattttggccattttgtgcattttcgaaatcattttctctcctccaccggatgatgagatgaaattgcccttcctcgtgagcgcggcgagcaggggacaaaacaccatggcctcgccggcgtattgagtggcggcagtggcggcagctatggtcttctcccaactccgtcgccccatctcactctccaccctactgctgaccacatcgagagaacaagcatgggctgcctctttggtctcaatcccatcgccggacgagatgaagacgatgatcatattcaccaccaagccacggtcgtccttgtcccttttgcgttccatacttaactcatcttgccgaacaaactttcttttgacgccatcgcgtttgatccattgtagcaacgggaacaccgccgtgccatcgtcatgctggagcacgctctgaagtgccgccgcttcggcagcgtcgatgtccggttcctcatccatcctggagcaagccaccgcgccatcagctcctccttgaggtcctctttaaaacccctcaagaaccgagaagattggagcatcaaggagggagatcgacattgtcttctccaactttggctgccggcgtcaatcttcgattccctccgctccggtgaccccctcgttgattctttgcgcatgcaccatccctgggacctaaccaacctcatggatgcacatgcatggcttcacatcgaatggaatgagttgacgtcgtctcgccgaagctcggagccgccactgagacgttttcttgatcgctgccatcaaccaagccccatggcctttgctcggcctcgccctgtccaacaccgtcgtcgccaacttgttccaccgcatccccgacaggtcgacgcccttgtcagcaacgacgatgaccacctcgctgcgctcgaccatctccaccggcggcacaaaacgaagaaggagagaaagaaagagaagagatggaccttccattggccccaagggcatttatgtctaatcaccataaagaagaggcaaaatgattttggaattaagagaaaatgagaaaatggcaatccggcgagttgtgtggccttgatattggcattttatcggatcacgttttaaagatggcattctagcgaaaccgtgttttgaagatggctaaatgtccattttctcgatgagggatccctcgcccacttcggtaatgatgggcaacagaccgcctgatccgatccccggccggccgccggcggctgcttcagagagatcc

SEQ ID NO: 24210 - DNA, 1501 bp, Oryza sativa
gtcagcgaccgcataggtgatgtggcttatcgtctcaagctaccggccggcgcacggatccacgacgtcttccacattggcctgctcaaggaattcaaggctacaccgccggaccaaccgcctgctctgcctgcattgtccaatggcggtgttttgccaatgctggcgaaagctgttcgtgctcatttggcacgcggtgtgcgtcaggttctcatccagtgggaaggcaagccggctgcagacgcgacatgggaagacgaggcagaattcaggcacatgtatcctgcgttctagcttgaggacgagctgtttgcgaaggaggggagagatgtcatggtcggcatcacgtatgagcgcagacgtcgcgcggcgaagaaggacgagcagcgtgtcggatgagaaacagtaccgcgcgaattgctagcgattggtttcagtttgttttgctattttgttatccctttgttttagcaagattagttcaatgtaaggctatttagagccacgaatttatggttaatctaagcaagattcaatctacacttctcatcccattttctctgctcccttcctctgttcttcccactcgccgtcacgggcagggtaaagaggctgccgaagcctcgccctccagtgacccattcatatccaatccgttcccttgccagtgctcgtaacatttcatgtttgtgttcttggcagttcatgactttcaccaatttaattcatatatagtaccagttggttatttaacttgctttcgttgtattacgcaaccttttttcaactggtgaataagaccgcgaatcatagtaaagtgtttagcaagctagttagcgtgtggattggatgtgtcatgcgtgcatctaaatttacttaacacgagcgtgagattgaaaatcatgcaaataaaaccatttgcaattgcacatctacatctcggttgaaactacaaataatagatcggagggatcaattaaataaatagccaggaagagtatgccatagattctgaagtacaacttgcagtattattgcgcagaatctcaactagaatttgttactgcgcatgcagtacaaatttggtgttagattaatgggctaggcccaattaaatcttaataaattccaatggcccacatttaatgcaataggtaataataccaccttgaaaatctgaagtagtagagaggctctgttgaccggttgagatggagctagtagagagtctctgttcaccagttgagatggtgggcggacagccacacgcatgcgcgcgcgctccgagccggctaggccgaggtaggctgcttctctctctcataaattttgcaatggaggagaattgaatccaaggcaattgatacgatatcaatatgggcgcgattactcctgtaactcgtaaattctgcaacggatgagaattgagtccatcgcaattgatactatttcaatcaattgatacgatttcaatacatgtgtgattactcctataactcgt

SEQ ID NO: 24211 - DNA, 1501 bp, Oryza sativa
tgtaggttgtaggaagggttggcgctgtcggcagggatgcggacactgtaggaatggccttcctcgcggacgttgggcagccggcagctgcggcggtggctggtagagcaggcacaacggattgacatttggcatcactaagggcatgagcaatgtatatggcccaagttgtccttaaggtgggccctgttgatgcgaaaaacacacactggtctaggagatctgcttagcttcagtgcaggtccaaatcttgatgagatacgggcgtgccagtcagtttgaccctgcaactgacaagatatacaaattgaagatcaatgagccgatcggctgacaagctgatggagtaattttagccgatgtcgataccagccgatgtcgatagggttttgatcagtcagctatatgtccaatacagataatgatataaaggcgatcggctgatgataatcaatataacaataatataatccagtataaaccaattggctagcaatataatataataaaagaaatactaatccgaaggttaaagcatacatcggctggaggtccgatgtcataaaatccacaagattagattaaacagtaaaacctttgttgccatcggctaaatccaatatgtatgcaatcccactacatgtttcatagcatacccgaaaactacttttataactacccaattacggagtagcgtttagcagtccctaagtaagctactacacatgttgggaaccatgataatatcaggtctaaggattcaacaccaatactaaatgagatcactgatgacacaacacatatggctcttacaatgtctcatgttgggtctatccaacaacatgttcaccaacatgtgtccacattattaatttggtatctctataccatgatccatgagacatgatcattaattaatacatgtgctgatcatataaacatatttgttccacatatgatatttgatcagggatcctttagaaatagtaacaaacaacataaagagtctcatgaaagaatcacatattcattaaccaataatgagttatctatttcaaggaacaatgtcggataaatatgtaaacatagtatgtgatacaatcatctctatgatttggcatatcactaacactgacatcatcagagaagtacaatcttgaagcaatccctggactctaagagtctaacggtcgctgccatggcggtttgaactttctttgcttgtacacttggaaaaccaacagatcctaaccgtaaagcatccaatatgtcaagatctagcacccttttgcacggctgttgcggtgttaatgtctatacatgaggagtatatagtgttccattgtgtcccttgcagaagaaaaggttaaatagcgcgcaccagtttattgcgtgcagattagaatttcttgaattgctcctatctcggcatttttttgtgcaattcgagtgtaagatactcacaataaaggagctaccgtaatagccacatgcgttaagt

SEQ ID NO: 24212 - DNA, 1501 bp, Oryza sativa
gggggggatttgcgggggagaggagagagagagagtggagtggatgtgaggcggcggcggcggcacactcgtggacggtggttggtaggtgggccccacttggtgactcggatgccattgcccacctgcccggctcccccaccacctctgttctctccattcacgattgatcattcacacttgtataaaagaatctggattttcatttgatagcccgttgagtcttgtcggattagtcgttttagttcgcacacgaaattaattaaccaccacgtggacgtttcatgagtactaaaccaaatcctagatttaaatctggacataatatatattcaaatttaaacacatgattaagttttttatgggacggagggagtacttcgtaaaagcccgttgcatatgtatgcacgagaaagtaatcatatttgcaattgactatagatcataccgataagtcttctatcactcattttctaatccaccatgtgcagcaacgcatccacgacaaactcttctttaccatcgctcctgtctgctcaccgtgataatttacagagtagatcatctgttactttcgttgttcggtggtagaggcagccaggtagggaggaaaagaattgaaaacttaagtcctttcttcaaccaagtgctatttaaatagggctatttgatctgctctttcaattttgttttggtttaggttgcatgggcaatggctaattactaattttcatctttagtaggcaaaaatagctgcaaggcatagtaaaacagttaaatttcgcgtgtgatcacaagcgctatgggtaagaagcatacgatcaaggatgtggcaacaacaatttggttgtgttggtgccaaagcgttgccacaggtgtgttggcctagagtactagattagtaggaatattataagcgtgtttggtcttggtgcgaagccagaatatgaccatcaaacttgaatgaagagagtattatgctcttttctagaggctagagtaggaagctaggaacgcgggattaacgaaacccgatcgaaaatcactcctgaatgattttgttgatttccgtaagatcatttgaaaaccggtaaaatatagatagagtaaaattttgttaaactagcaaaacaactgtgttttgcagtggacaaaaatgtattatacatgtgctaacattgtttggaacaattaattgtatggcttttgaaacaatttcatccttgtatatgtctttgcatgaaacttaaatagagatgaaaaaaagatattaacaatatgtgaaagacttttgtaatattgaagtacacaaaggtagttggtaaagaaaatataatagagttggtgggcaccaccattgctttcttttaaatgcgtatagaaatctaagctaaagaaaaggcaagggttctgtatgaaccgtagtattcatattggagtagcatattagcgacacacaaaacgaggtgactcactagcgtatgattaatcgagtattaat

SEQ ID NO: 24213 - DNA, 577 bp, Oryza sativa
cccccttgccgccctccgcgaccccccttctgtgctgcgggggggccgcctgcaaatgggcggcgagggggcatggaattttgcaggcggcccccttgctgccctgggggagggcgatttttgcctctccccctataaagcccagtccctcctctgtgaaatttcattatattcactaaaaatccaaaaaaaacaaaagagagagaggggaaggcagcagaaggggagcggcgaagccctgctggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 24214 - DNA, 1501 bp, Oryza sativa
cttccagttggtcatagaagacacaataggttgggtgcgacagactacgcttctctaaccggtcagccgtccagcagctccgttgagcgacaaaccataggaagtagcgacactgagaggggcaaaaaagcgccagattggtaggtgctaaaatgagatcctgcctgggaagagggcaaggtaagccgaccgggtagagtacgaccccgaactctcccacctctagatgaaagaatcaggatggtcctttgagagagttgttgtctgcaacaacgaccaaatctgcaagtattgcagcattgcctggactcccaaggagccatggagatcgcggatccaacggttgttggccaacgcatcagcgaccaagagctttcggcggacacgcaccgggacgcgatcataaagctcaggtgcctaagagcgaaggctcgaatcctgtagccatctgtcctcctagaagaggatcgacttgatattctcgataatctgcccatttaagtttactgctcaggccatgacatgataaaccaagtggctggagagtggcctttgtatggtagcgaatctatacgagggatgaatctacatatgtgttataaatgtttttaaacctatatgtatattagtgaatctagaccatggacggagaaaacaatacgttatataatatgaaattgaagaagtaattaagtcactagttcaatctcatttcctcagaagaattatccatgaataagtccaacacaactaagatatacacactacatatatgaatgattcagtatgcatccgtcaacatagtacaatatagaaattttctagtacgatgattcttgatatgagatatgctcagattcgtagtaatatgatgtatcacattctgtattgcattgtttgttatattttgggatgtatgtagtagtttatttttttgtttcaatagataaataattcagtagctcagcctcagatgaaatatcagcagatgaggtcagtcagtcccattttcaccacacagcagcagcatccatacatttttctctctttcttttctttctttttatttggtgttgaaaagagcattcaaacatgcacgcatcaacatccacactccacagtgtggctgacgccctgccggtttctgccgcctcacgtcgccgcgagcgccaccacagtagtactagtacactagtacacgagtcctccctccataataataataataataataataataataataataaaaaaaaaaccgagtctccgtgtacaacgtgaccgtccatcttatttgaacggagggagtagcacgcaagagcacagaagccacaaaaaacgagttcgaaagcgaggctgcctttttggcgccatccatggcgctcgctgtcgtgcgcgcgcgcgcgcgccccccggcccttttaacggcagccgcatggtgcgggtagcgcgcgcgcgcatcgcctcgtcggaggaggaggagggagatcggagatggggg

SEQ ID NO: 24215 - DNA, 1501 bp, Oryza sativa
atggctcatatttgttagattttcgggctgcaatgggctgagagcaaatgcttatggaggaaaatttggcccaacaaatactagacttacttttttttaagaggaaagtactccctctgttgcaaaatgtttgacaccgttgactttttagcacatgtttgaccgttcgttttattcgaaaaaatttgtgaaatatgtaaaactatatgtgcacatgaaagtatatttaacaatgaatcaaatgatatgaaaagaataaataattacttaaaattttttgaataaaacaaattgtcaaacacgtactaaaaagtcaacggtgtcaaatattttgaaacagagggagtactagacttactagtactgttttttaccactatttctgaacaccgtttggcgcatccaaccattatcataatttcaatttatggcagtaaagacataaacatcttgcctcttcttgatcatattagaatatgagaaagttgagagtttaactcatgaacctatgaacctatgtctcgaatcttaactcatgaaccatcattgtcgacaggtgatgcccgtagaccggatatagagggtattggggtactttggtacaaggatctacgtagtacgacatcaagcgaacaaaagacaagaattatactggttcaggccccttgataggtaatagccctaatccagttgatgtgggattatatggtagaaaacacaggttacaaagggaacaatggaacttgtcgaatccggcgaaatcgtagtcgagttgattcgactagatctcgatggcttggctccttgcaggctccggcttcgtaggttatgtgggttgtgtcggctctgagattcgatcctttaagccctcaccaggggtcccttttatatcacagatctggaggtctccaagtagaactcggagatatcagaccctattcgatacgtcaacgacccaatcttgtccgagtaggattcttcccatccgtagattccgtgaagtatttccatagaatatataggaagtatctgtatgcgcgtgggtataccataccgatatgtaacatatatcgaagggtaaagggtatgcctaacccgtaaccctgacagtagcccccgacttctgcttaaaatgggctcgtgtaaccattcacgacttcgggtgtcgagattgttgtcgttcccggtgcgaggatcgcggagacaggccgtagtcgagcacgccattcaaagcccaacggtcacgagcgaattttaaactgaagtccagaaaaccgccgcgcgtaacggacccagaaatttccggcgggcatctctctctgtccttggaattcgcaccgtcggtagtgcgcctatttaaaggaattttggagatccattttgaagtccgccaaccgtgttgaaaacattccacctgtaagcgctcttcgccttcttcgccgtcacaagaaaccctagttcatcaacctaggccctttctccggcgatcttgaatcagcaa

SEQ ID NO: 24216 - DNA, 345 bp, Oryza sativa
tgcttcctccggtggcagaagcggccgctcatgtcggtgtcgtcgtggcagccgcagccatagcaatggccaagctcccaagtgatcacccatggtgttcgacggttcgacctcgagagctccatcaatggcgtctagcttgctctcaagctaaaggtaccccactccatccatcgttcgcattggcaaaaaaaagattggatcttacgaaggatgaactgatcatagtctcagtgcttcatgtatcgatgatctagcattctagctagggatcaagcaatgatcctagctagctaagctaagctacctgccatttttcatggcaactcgagcttggatttgtga

SEQ ID NO: 24217 - DNA, 1501 bp, Oryza sativa
agagacgccgccacctgatggtctgtgagtggcccgatgatgtcagtcagaggaagagcctacgcttaatcaagtcataaggtgatctcgaaggaaaaatgcgtgatgcttatcgggtgcacttacgttgatagcgtcatcacgctcggccgcccccttttcacaaagaggcgtggggatgttgctcgccgttgtcggaccgctgatcatcacctggccgacacggcgctccacggcctcactgttcagacctgtaaatcgagaaccagatttcgatgagtcaataggaacgcgaacataagcatgtcaggataaatgcgagaaagataccccgaggagaaacccgggtcgcgtcctccggtccggaataattataagctggataggcccgagcctggagtggctggatccgcctaccaacgaagtctgcaatgacttcataccccgacaagccccgtactcggagatcatcgatgatgtcgataaacggctgaagagaaggggtcaaggggggctttgcggtccaagacgaaatcttgtccggttgttctttgggaacaacgaagacagggttcgaatctttgatctcaaggtagaaccacctattccgctatttgctgcgagaagaagggcactggaaggggatataacgcgacttcaggccatcctgaagtcggaacccgacgcaaccagataccctgttggattccatccaacacagttcatagtaagagcgaaagagatcaagaaaaggctctaccccaatgtaggcctcgcaaagatggggcaaagatgctaagaaaggcaatggaattggggttcaaatggagaagagaaagaccatagaaattcaaaaccaagagaagaaactcggaaggtggagggagaagaccgcagagaacataatcttcgatcgcaaccatgcgacccaagatgggctggggattagtacctcctgcttctctctccatggttccacggccaggaaggacgccgtcttcctgaagcttcttcagcgacgcactggtggaagatgacttgctgaggtccattgctgattcaagatcgccggagaaagggcctaggttgatgaactagggtttcttgtgacggcgaagaaggcgaagagcgcttacaggtggaatgttttcaacacggttggcggacttcaaaatggatctccaaaattcctttaaataggcgcactaccgacggtgcgaattccaaggacagagagagatgcccgccggaaatttctgggtccgttacgcgcggcggttttctggacttcagtttaaaattcgctcgtgaccgttgggctttgaatggcgtgctcgactacggcctgtctccgcgatcctcgcaccgggaacgacaacaatctcgacacccgaagtcgtgaatggttacacgagcccattttaagcagaagtcgggggctactgtcagggttacgggttaggcataccctttacccttcgatatatgttacatatcggta

SEQ ID NO: 24218 - DNA, 175 bp, Oryza sativa
ttggtaagaaaataagacttctgtatcactaagcatacaaccagacatgcattcctattgaacttacaccaggccattattcaaactgtttcttgatatatgttgtgtggctttgcttccttgttccttgagatactacaacaatctgatttgatacttattatgagcctgcagg

SEQ ID NO: 24219 - DNA, 766 bp, Oryza sativa
cttcattagccctaataattccaatgctttgttaatgtgcttctactagttgttaatgcgagattggattggtgcagtagattgctttctgtgctgcattgggattcaagcactgaggagtggagtgatttgttcaggccttgttggatgctaaaattggagaacgtttaggtcttgcaaatatataggaatgcaacttttgctctgtccttacatcataatttcaccccattttgtggcgatgataagtttaaccgcatttcatggccaatatgtacatagatattgattgcccatactacctctagcaccacttttcctatttgaggttatctataattctttatccaacacgatttttctgctagtaatgtgatagatcatcataatacaaaaactaatgttgttcctggtaggctgtacaatggcaatgaccttatcttgagtgccaccaggagtgacaagtgtcttgatttctcaatgttttcctttccttttttttttttgttaatttgtgctcccactcatattttcattgcatacttatagaaatatgcacgtcctagtttggaacaaaatgtgtagatagaattacttctgccatttttttccttctcctactaggagccaaaatattctgacagaatgttgtttgcatggctgtaaacatgtaatggcggtgctgaatagctcatatggttaaactctgtatcatgctttgatgtttgaactgttgattgaccttcttgtttccaggacaataaat

SEQ ID NO: 24220 - DNA, 594 bp, Oryza sativa
gaggagcgaggcggggggcgaggtcgcgggcgggagagggaggcggtgggcggtgagaggaaggcgaggaggagacggcggcggcggcggcggaggaggaggcggaggcggcatgaccaccgccggtgtttgagggggagtgggtggtggcgcggcgaccggtcggggcgaaacgggtcgagacttttttgtgtattgtttagatcgggcgattagggaacgtgccggccgcccgggtaattggttcaacttctacagcctacggagtagtagaggatttacgagtagatgttgaagtagatgaccgattaggatttaggaacataacactgtacaaaaatctgtggatgttaagtattgtaatttgcaaaagatgtagaatcagaaaaggtgttctatcaaaagaagtaaatcacattcacatggcatgagcttggtaagtgggtgttaagtaggtgtatttattgtaataacttaaaaccaagcatatcggtgcatcgaaatgtcgatgggtgtatttttggtcacatcggcagggaacatcattttctgttatttaccacaaaatctccatttttaccttttttttttaga

SEQ ID NO: 24221 - DNA, 1433 bp, Oryza sativa
  unsure (1)..(1433): unsure at all n locations
atcaaatatttagacacatgcatgaagtattaaatatagacaaaaagaaaaactaattacacagatttgacaatgtgatttgacaatgtgatgctacagtaaacatttgctaatgatggattaattaggcttaataaattcatctcgcagtttacaggcggattctgtaattttattttgttattagaccacgtttaatacttcaaatatgtgtctgtatatctgatgtgacacgacaaaaaatttcactcctacatctaaacacaaccttactcatgttgacaatcttcccagtttacacgcatgtcacatttttgcagagggagaagttggaagtacctaggaaaaagtgttagggtctgtttggataatggaaaatgggggatgggattgggattgggaaataaatgaagggttatgattaaatgaaagagggggaatgaatggttaggatttaaagatgttttttggtgggtggaaaattatttaacatttccattagacaaacattgcctcggggtggtcaaaattacaacaaattcaaaaatacctagtctaaaatgaaataattgaataaatggattgccgaaagttaaatttcggtaataaaagattgccaaagtgtaattcacatcgtaaaatcacactttcctaagcctaaatctgtagtactacgtaaagtaacaaaaaaaaaagttgtactccgtatggattgtgtaattttacttcttttgactttaattttgttgttatatatgacttttatcagtttgaatttttttcatgtattttttttcaaaaattaagaatcataaatttatttcatttaattttataatttttgtatggttaaatatcttgttcaaccatttatatgggaaaaaaggagaagtagtgagataatggcattttggtacttttgaaatatgccaaggatttatagatagtctccgagtgtgtgagatagtagtcatattcttctatttcattttatccacatagtatatttgtttccttccttctatttatcatgaattcgcaactctcaggttaatccattactaaagagcttattcaacttattcatataattgtttactcctacttcaaaaaatacatttattcatttntaagctattggttaaatttattttcaaaagtatttgatttattccttttcgaacggtcaggccgttgccgacgttttatattaagaagaaggtgttccattttaaggagaaaacaggaccaaaccttacagtgtctagttaattaggaaaaactgagcgaaaactacaactacaacaccacatcaatagctaacctaacttacactaccatgacggagcccaacataagacatcggtcaagcttgccatagaggcgacacggcaacccacacatgttatcattgccaagcttaccacccaagc

SEQ ID NO: 24222 - DNA, 1501 bp, Oryza sativa
actgtgttgcaggcaattgcagacggctgcaaagttcctgcaaccattcagtcagatgttcaagaacctgaacttccaaaagaaagcgtggaacaatttgatgaagaccaagaactccagcaagttattgatgggcaagtctgcatgaaagtgtatcacttttctggtatactttgtcactcgatgttgctatgtgtgcacacttgaatatttcattttcactcttaaatcatactacatccatcccaaaatatagcagacaagtagtatctcttaatactagtttgcagccgtcctgggtttttctctctcttaaatctatttctttttttccttgcagattcaatggataaaaacttcaacaggaaaataattctacctggttcattcaatcccctgcatgatggacaccttaggctgttagaagttgcatcaaggtgtgattttatcatgtgaaaacactgaagagaatagatcatagcattttcacaactggattttttttcatgttaaaaattagcgaggaagcaagaatagaaatgaacaaagaagtaatttaatgaaaaggcactctgttaaactggaaattacaagtcacataaagatacatactgtatgtctgtatcaaggactagattgcccctctccattttgacgcttcaattattttaaaactataagtgtgacgttggttccacgagctgcatgtgcataaaaagtgcacaacatgacatataaagcttttagtctgcttgttctgacctcaagagagtaagaactaatatttcctccccacaaatctgcttcttgtagcatgtgtgatgatggtcttccatgctttgagatatcagcaatcaatgccgacaaacctccactatctatcgcagaaatcaagcgccgggttgagcaatttagaaaagtaggtatgacccactgccatgaatgaaagtctcaatgtgatatgatacaccaattagattggtaacagcgaacagatggggtgtctttatagatttgaaattcatgtttctgattcagtttgtttttataatcaattgtatgaaataataattgaaaagcgacaacctgaacaactccttttctatttactgaaatctgtcttcagctaaccaataatccttcacatattttgtgttttggggggcttgatgcttgagataagaatgtactacctttctgtaggtaggaaactccaattgatcgatggttttgttcttctttctgatgcagggaagaatgtgataatatctaaccaaccatacttttacaagaaagcggagctatttccaggcagtgcatttgtaatcggtgcagacactgcagctaggcttgttaatgtaagaagttagatggaactaaacacaatatttcaagccaattgctgaattctgaaagacagtttaactgctttacttgttgctcgtactgaatgaagtttactcgttgcagcctaagtattatggaggtgattacaatagaa

SEQ ID NO: 24223 - DNA, 415 bp, Oryza sativa
ttgcaatataaagtccacatgttccaatttctagtatagctttttgtgatactccttccatttagaatgtaaaatgttttgctattgttattagtcaaaacttctttaagtttgactaagttcataaataactaaagacgtagctatattttcaacaccaaacaaataatattataaaattatattcaattgtggatttaatgaaattaatttggcattgtgaatcttattacattttttctatatataaacttgatcaaacttggagaagtttgacttaggagaaaaccaaatcatcttacattaaaatgttggttttcttgtgctttgtacatgccagacatgaatttattggtcaatgtgcttgtttatcaaatcttgtcatcttcgaggattgcactaaccctggcctatc

SEQ ID NO: 24224 - DNA, 525 bp, Oryza sativa
tggatttgcccaatacaaattaatttagtgatgactctaatacaaaattcataccaactgtcaagtgttaacaaacatgattttaactgttgttaacgtacttttatatatggacacatgatgtaaccatgtgatccattctgtgcctcttcgtgaataaataggaaccaaataattataattaaactgtcatgagaaaagccctattctgggtacagtcaaatcttccaatacggaatagtcgctgtacaaaaacctccaatccaaatggggcttcactatgaaacaattctttgggtatttttcacttttttaagcgtttgaacctatgcccatccctgttgcttcattcatttggctgactgctgtgacaattttttgttttgaaatattgttaattttcttttataaatttagtcaaatctaaaaaaattacctcataaaaaagtcaaaaggacttatatgatcaaacgacctaaagtagtagatagcacaattctcaactcaacccagttggcattggca

SEQ ID NO: 24225 - DNA, 1501 bp, Oryza sativa
tggctcctcctccgccgctacagaagcagaagaatctggcgatctcggtgtctcggtcactgcaacgccggcggcaacatgctctggaacctctacctcctctccatcctgatacctggtaccttggtatcagtcggtaccaggtacctttggtaccgactgatacctttggtacctggtaccaggctagtacctagtatctggtaccgggtacccgtgatatctagtacctggtggcctggaggaggagagagaggaggaggtagccgcgtggtggagcaggagaaggaggtggcgcgcgaatccggtggtcggcgaggcgaagcgtggaggaggcagcggcgaatccggtggtcggcgaggcggggcagccgatgagaagaccgacgagagcggggagccagagcggcgcggcaagggaggcgagcttgagggcgacccttgccgaggccgcgccgtcgtcgtcctcctcggcggccggggtcctgagccagcagcggcttccccggcgccggcagcggcctccgcgcccccgctcccgctctccctcttgttcacctcacccgtcgccaagctcctcgtcgtcgccgcctcccccgcggcggtggccgccggctccgacgagcggtggggcgacggcgacggggacgacggcggccaccggctccgacgagcggtggggcgacagcgacggggacgacagtggccgctggctccgacgattttggggagaagagtgaggtatgatgaggggatcgattctgattacttatccgtcttcacgggatgtcggtggaatagattttctgaaccaagatatatgctgtgatggactctgtccgattgattcttcaccacacgttctgaatcgaacggttcccataatgaactcatcatctagggtcggagaaaaattaattctcgtaaccccatctggtgctgagcagtagaaattaagaagatttatttattgtaactaattaactaactcacctgatgtgtttgacagtgattccgtggggcgggaggaggcgctggatcttgagccgccaggcctcgccgtcgtggtggaacagcccgcgccgcgcgtcctgcagtgacgcctcggaggcggcgaggtcggcgacgaggtcctggtcggcgtagtggaagagcaggtcgtcgtggatgagctggtggcgcgggacgacgcagaagaggtggacgaggcgctcggcggcggcgccgacgatggggcgcacgtggtcgcgggcgacgtcgggttcgaagatggcgaggttgacgtaggagttggagtaggcggagtggtagaggccgcagcgcgcgacggcgtcgggggcgccccagaggcggaggatgcggtggacgtcgaggaggtgggcgaggaaggtgccgtgcttgtgccagcactcgccggcgccggcggcgcgcagcacggcggccagcttggggagcgccgggtccacctgctcctcctcgccgcgcaggaaggggcgcgccg

SEQ ID NO: 24226 - DNA, 1501 bp, Oryza sativa
attaagaagatttatttattgtaactaattaactaactcacctgatgtgtttgacagtgattccgtggggcgggaggaggcgctggatcttgagccgccaggcctcgccgtcgtggtggaacagcccgcgccgcgcgtcctgcagtgacgcctcggaggcggcgaggtcggcgacgaggtcctggtcggcgtagtggaagagcaggtcgtcgtggatgagctggtggcgcgggacgacgcagaagaggtggacgaggcgctcggcggcggcgccgacgatggggcgcacgtggtcgcgggcgacgtcgggttcgaagatggcgaggttgacgtaggagttggagtaggcggagtggtagaggccgcagcgcgcgacggcgtcgggggcgccccagaggcggaggatgcggtggacgtcgaggaggtgggcgaggaaggtgccgtgcttgtgccagcactcgccggcgccggcggcgcgcagcacggcggccagcttggggagcgccgggtccacctgctcctcctcgccgcgcaggaaggggcgcgccgcgtccagcgcgccggcgaggtgcgaaggcgaaggcataatttggctaggtgcggcagcggcagcgagaggagtgagagtgatcgatcgcgtgaagtggcggttggcaagttgtgcttgtgcacgatgatcaacagtttggtttcgattccggtggaccggattagtgtgtgtggttcacaccaaatctggtaggagcagatcttttatttcctcatctattgggctgtgggccgcatcatccctttcctctgggccgtaatagtaccttttcttgtttgcttgtgattttcatcttcattcttcagtacattacataatccacgctgacgtcttcatttctttgtttgctccttatttctagttcatcatcgcaacatgggatttgcctgcctcacaggaacttaatttgaggcgtagctacataggagtatacagtacagtatttgtttttttccttatcatctcgtcttctcatcatatatcaatcctctacatattcttatggctcagaggtaagtagagtattgcttctttgaaaaaaaaaacagtacatcaacgtccttgttaacgtattcgttttcatctgtaagcatcagcatatccatatttaactctatccaattcaaacatgcacaacagaatatatttggaattggactgtactactactaccaagtactccctccgtttcaaaatgtttgacaccgttgaatttttagcacgtgtttgaccattcatcttatttaaaaaaaattgtgaaatatgtaaaactatatgtgtacatgaaagtatatttaacaatgaatcaaatgatatgaaaagaataaataattacttaaattttttgaataagacgaatggttaaacacgtgctaaaaagtcaacggtgccaaatattttaaaacggagggagtactaagaaattgcagaatgggtcatgactacatacat

SEQ ID NO: 24227 - DNA, 1501 bp, Oryza sativa
ttacatggaaacacatcgaagcaaaagtatgtaaaacttctttcatattctgaaacattaatactacaacgaatgatgctgtaagcacaaacaaattaatggctgtcctatacaaattaacaagaagtacattaacacatagtgtagttgtgtaaagataatttagtcatgttgcaaaaaggacggttttgttgtgagtgtgttaatttcatactccatttacactatgataaaatctatctataactgaagagaaacatatgtggatcctcctgctacaaacaggctgcggcatactactaccatggactaatccttgatgaaggaaacagtgagaaatctcataggacggcggtggcagcgctgcaatcagcggaggagttgctcaaagagagcaaagctgcatgtgaagccttccatgcggcatctcctgtttcaaggcgtgcattccattcttttcagatgtagtgttatctgcagtgagctagcttaagaatctctaagatttctgaattttggtacctgcatgcatgtgaataataatgcagaagcccgccgctgtggggatcgatgaggtatcttcaggagaagatacacaaggagtcgtcgtgcaaagttcggatcaacaaggacctctacaacaaggacaacatcatcatccatgaccatgctgacagcgcgccgccgctgccggacttcgccgtggctctcaaacccgacgagtatcgccttcctcccccactcactgacaccaattaaggatcgagtcgacaagggagaaattattaaggtccaaggcatcatgcagatgcagaggaggaagaatcaatcaaataaaatctattatgtatattcattcatattgtgccatgtatgtatgcatgggtgtcacaccgcaccacatgttgcaagaaaaatgaaagagaagctagttactactacctccatacatatatgtatgacattgactagtataaatttgaactagccaacatcatataaaaaaacctggagggagtactagctagctagctaggaaaaaaaattaaaatttttataaaagaaatctcaaataatgtgtatcttgtgtagctgctctggccgaatctcgtagttattagaattactagtctagaaatgtcatacttattattatatcatggaaaaaacaaatactccactcgaacacaggtccagatatccggtgttgtggttgagggatatgaatcagattcggccactagttaagggagacaaagtgaacttttattcgggcaggccggacttgcattgatgtgatgggccagcggcccatactgaaagtgaaggagccgccacgtctgacttttctttcttctctctctctctctctctgcgtccgtccctccctcgcttgacttctctctccgcgtcacttctcttccacctcttgtagtagctgcttctcctcccgatcgagcagaggcagtagtagcttagctagcagatatatactgtagcg

SEQ ID NO: 24228 - DNA, 1501 bp, Oryza sativa
atttcctccatcctagtttggccttcttctagcaccaccggaggctgagtatcgagtataattaagcttaagcaacaagcgtcaggttcagaatgcagattgccggcagtgagacgtgaagaagatgaagtcaggatggtaagctcgcagctgcttgagccaagaagacgctgcccagaagagatcagagctcctcgacgatgtccacagcttcccttccgctctgtacgtcgccagcccaaacggcgaaacaccaacaacgctcctcccctcctcaacattatctgcaaattagcccatgcatttccatcatcaacatcgatctaattacactgtcagtaatgcacatatcacagccacaagattaacgaattgatgttatataggagtatgtaatatgtggatggattacgtaccttggaaaactgaggagagggaatgataggttaggaaacacgtagataaccccttgaggtttccacgagctgggatatgataaatcgggtacctgaatgcatgcagattattgttgacaagattagttgagttcaagtcaagcatctcaacaagctgttcctttgtttagttttctgaatatacattagatgtaatgtgcaattatgtatgcatttgaacctctagcttcagagcaataatttaacaatcaaagaagtgaaaatgatgtgtaaattcaagtaccatgctacagacatccagctcgaaggtgaaagttgtgcactgctgagagatgtcaagcatggataatgctgagccagctctgccacctaatcaataacacaacgtatgcaacaccaaacttaattagagtactaatgtggtaagttatttgcattgatcacattgaagactgaaacaaaactagtaaccttatctgctagcgggactctctcgtagggcgagctccactcgttgtactgaaaattcaggcagccggcaccttgctttgcagaaaccgattcagagctatcatggcttgagtcgtcgtcatcagacatagcagcatcccatgatcttgataacttgtcgcctgtactatcatcactccaagaatcactctcgctccctgcgctgcctctgtatgatttcatcgaatggcattagttcgatcagatcggaaacaattaataggccaaagaggattaagggtttgcagtaaagtaaaacaatgtacaggtaggttgcatacagctacaagagacatgagattgagaggtagagagagtagcaacgaacctggagaaagcaaggagagacttggtggaggtgtatatctgaatggcagataagtagggaacaaaatgttgggtgatggtgttgccggattcaagacggacaggaacagcaaggccatacgcactgctctcagcgtaatgctcccagagatcctcaagcgcgaagtaatcgacctcgtctttcttcttgtcgagttgccaaactttgctgggatcttggaaacattcctacattattgaatattgaa

SEQ ID NO: 24229 - DNA, 399 bp, Oryza sativa
gctgcaaagcacacggactagagttttttaagtcacaaggaagtagtctgtccgttcccagtgatttgaattcatctgatttcgaagccacgagacgacatttgaaggggcaaaagaaaacagtcaacgtgatgaacggtagagggaattttttttttaaaaaaaaacaaaagggctgggagttaaacaaaggaaaaggatgctgaaataaggaatcattagttaccagggcaatttaaaagatccagcggtggcggcggtggggaagaagaagctctgtcaaaattggaggcttgggcgacttgttctggaccgcctgatgcgccttggaattggatctcgcacttgtctgacattgacgcagattcgaccttgcgagaagtgcggcgcggggtgaca

SEQ ID NO: 24230 - DNA, 294 bp, Oryza sativa
aattacacagttatgggagaaatcgcgagacgaacttttgagcctaattaatccatgattagccataagtgctacagtaatccacatgtgttaatgacggtttaattaggctcaaaagattcatctcgcggtttcctggcgagttatgaaattagtttttttattcgtgtccaaaaacccattccgacattcggtcaaatgttcgatgtaacacttaaaaattttcattatgcgaactaaacagagcctcagtcaatagagtagttcagagatataaagtactactgccaaaga

SEQ ID NO: 24231 - DNA, 1501 bp, Oryza sativa
ccgaatttagttccatattttttaaaaaaaaaaacttccaactttttcattacatcaaaacttttctacacacataaacttccaacttttccgtcacatcattccaattttaaacaaacttccaattttagcttgaactaaaacacacccttcccttcacccgattccattcatagggtgtgtttagttcacatcaaaattggaagttttgttgaaattggaacgatgtgacggaaaaattgaaagtttgtacgtggatgtgtttagttcacgccaaaattgaaagtttgattggaattagaacgatggaacggaaaaattataagttagtgtgtaagaaagttttaacataatggaaaagttagaagtttgaagaaaaagtttaaaactaaactcggccatagtataagagagagagagaggtgttgcttcgaccaatctctacaaacccagccataaaatcacacattcaaaacacatagatcacaaactccttctattgcttgcttccattgtgtacacagtatatcttcgctagttactcatttacatgtcccctccgtgataaataatcaccatggtttacagcatttttaataatcagacaaaacaagatgaaatattttcactatgcgtgtgtaccatattacgtgtatatatattgatgattgatgttactgtaaaaaaaatacaaaatgcacgtaaacagaagcaagagatatacatttttttagagggaaaagatcaagcttaaacgactgtacattttaaataaggtgaattaactgtacattgaacaaatgctttttttaggtgttaaaagagagaatgatggctatggtctagacgcggagtactctattatgcaatccactccttaaaatataatataaaaaagcacgtaccaattttacgcgggaaaatttattactatctgttatctaatcatcatactctatattaaaaatgtaacctattcaaataataacggtggatttagattgtaaccgtcgagatatcgactgatatagttatatacaaaatatggactacgtatatttcgaaacaaaagctattattgtatattcaatcaattcatacatttaaaaccttgtgtcccgctcaaaattgcgcgggaaaatccatacgttagcaaaacatcgtacatatactatgtgtttgtgcgtaagaaaaaaaaacgctcaccacctcacggagttagtcgaaagatccctgaacgtttcttcttgtgtttgtgcgtaagagcttcctaaggaaaacactagtgaaaacttgaagcttaatgaccatcatatttatatataagtaaccagttgcatttgcacggtattagtattatttggaaaattggatatgcaatgtaaagcacgggcatgcattcaaatgttgtgaaagcaaaacgaaaaaaaggaaaaacttggaggacctttttgtaactgtggttggaatattggaagcgcgggtaataaaaggaggacac

SEQ ID NO: 24232 - DNA, 1501 bp, Oryza sativa
gactactgacaaccggattgccattagtttcatcatgtatagtatgtctacatagcatagatcatcaattacacaacaaaaaagaaaagattagaaaatgtgaataacatgttctgaatataaaaatttttgagcatgtatgcttgaactagaaaatagctgacataatgcatgcagaaaaaagtggatgcagcatgggtcgtaagttcataacagcttgaaacatcagaatgcaatatgaggaaggaaatgaaaatagctaaaaaagatggcctatccagccttcagccctggaaacatggctgtttacccgagggttactgaatatcaagaataatggcccctagtgctgccaacattttttttatcaagatgcaacattaagcaatgactctgatatatgtttccagataatcttctcatttctaagttgttgaatgtactgatgatagcacatatagtatgatgatgttataaaccaaaagctctgccaagagctctagtggacttgaaagaactagtagatactctgggttatgtcccggaatcatgcctgaagtgcaattgacaacaactcaggttgaaccattgaagggaagctaagtaaaggaaaaaaaataaaatcaagcttcagaaagaatagaagacaaaagtaggttctcttgattatttgtttcctatcctttggaaaaaatggttgcattgaaaaaaaactgacagctggaggagggatacgcagattgtgagatttgcaaaataaactgacaggtggaggagagatacgcagattgtaagactgaaaacaggagcatggttctatcaagtacgaaaacaaaagaagatagcccaatcgaaaatgtgcgatgcatgtgaattgggaaacagccgatgaatcaaataatgtattatgatgacatttaggaaatgtagtgagtcatacagcagtgagggaaatcagtagcataggtggagattatacaggcataagggttcctagttgtacaaaaatattcttatcaagttgcagtaattcttgactatgtaggcagataatcttgtcagttcagttgttgattagcagtgatgagatatcacatataggcagcatgatgagtagcattggtagcaaacccagaggtgtcccaatgggtttagtggagttaaaagaagtagatgtggttatgacaaactccttgggggtaattttgtccattagattggcaatacctgaattgcaattgacaaggctgaaggagaggtaaagaaattaaagggggaaaacaaaaaatggaatgaatagtacatgaagtagaaaacagtggtaggatcccttgatcgagattcattcgcatgctgttgtaattgtgagtaggaaaggttggattgcaagaattagagacggcattcgcggaagaaattaatgaaaataaaagttagtaagagtaacaaacgtttgatggacgtaagaagtgaattgcaggaataatcaccactgaatgaa

SEQ ID NO: 24233 - DNA, 1501 bp, Oryza sativa
gaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccacctcctccaccttctccgccgccatggcggtgcggcgatggtattgatattggggcaaaacgagagagatagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttact

SEQ ID NO: 24234 - DNA, 1501 bp, Oryza sativa
aattgtttctgttccttaaatagtactacataattttatcttcatttctaggtagtttggacctctctttttctgggggtcagattcacttctattctgttagattgcttttaaattcaatccaagatgttctggcactggcaatgtagattatgttccaacttttaacccctttttttgtcactgggcaggacattaaatcatttgacatctcaggcaaattaccatgtgagttctatgcaatctgggttctgagaaattttgctagttctggagcagtggtcagtggagcttgcttagtttcccagctcatatcagtgtttcccacacatgtcagattacatccaaaatttgtatgatgtattggaaatttagttgagcctgggatttctggacttcttttctgccgttgagcctgaaattcatatttgattttgcctggtgaattctgcatgagtgacaggaatagatgcaaggatcaggcggctttgttgctgtcaggatatgcatgtcttttgagtcctttttttcccctttatgctgttgttaagctatgaatattttggaaagggatttttttaggacaatttgattaaggatcggtggatttttatgccaaattgtagactctgcttttcgctgcagtcactgtctttcagaagatttcagggctcaagatggttactaatatttactgattttctgtttcatctgaagattcacccctgcaagcctgcatttttgcttatactgaagaactctgagtcttcatgcttgcataccatatatcgcagttttttttcctttcattttggtttaattagcagatgtaattgatgccacagttgaagagaaggcagtaatttttcttgcattgacagtgacaactaatgcgggcgtgcggacgcgggcgcagcctgcccgctccagccgtgcgggcaatgcccctagtgcagtctcctttcgtcatgggtgatctgatcattggtccgatgcttctggctaaacctattcccagtggcagtgtgtgtgtgcaagaagttcaatgagtgctagtcccgatactccgacttagaaattaacaacctctcttctgctcgcacgcagttgttttattttgatgaatttctctcggacaaacttatctctaatcttacctgtgctgtgcggtatcgatctacagtccattatgcaatgaataatataatggctcgcctcagtccgccgctactgccgtgcaggccatgagggagcacaagtcgccgcgctgctcgatccgcatggcgatgacgtacgtacatgctcgcccatggcccctcctgctctgcacaagtcatagttggcgtgaatcaagtgaacttattcctagttgttgggctgtgatgtggtgggcggcaccccatctcgccttccttctttcacctcccaaaacgatcgcaccgtcgtctctttcctccgctccctctccctcttcactctccatccgcttcattcttcatca

SEQ ID NO: 24235 - DNA, 321 bp, Oryza sativa
tgtctatagagatcatttgatggtatcaacatttattgtaaacacacattttcatactctttccttaagctcaagttctaataatgttgaatttttctgcttttctttttgagactggtaatgggtgttacagactgttttagtcctaatgcagcattacagcacacatgtttatgttaagctcaaaattcagggtgttttaactattcaacccaaaatctagagtaatttatctcatatatccagctggggcctgagttatcaactcctgacatgattcacaggcaggaaaaataagtctcaccttgatttcgttggtac

SEQ ID NO: 24236 - DNA, 275 bp, Oryza sativa
tacctgcatgtttataagccatggaggtggcgcaccatcaggcataccaagagcctctttaagttctcgcgacagcatgcctggcttcatttccctaagcttgacctattaagtccacatgtacaaagcaacaaattcaaatactcaatgtacgaaaacacagataaatggattgtgcagacagttaccaattatctcgattcttttatatatatcagcatgaaagataatgtaaaagtacctcaaactctttcccttcataatacaggtcacca

SEQ ID NO: 24237 - DNA, 542 bp, Oryza sativa
tatctgaaaaatactagaaatgaagccgacaaagggagtatattacttgaattcatcaccaaaaagaaaacaacagctatgctaactatagatactagtataatagttgagtaggcacagcttcatcctcactcacgcacacacacatacactttgatgggttaattcaagagggtaagtaattaagcatttggaaaacaagcaaggggctaaattaagggtgtctaataatgatgtaaaaacatatttggcacacgaagttaaaaggcagctagtagagggagctagccaggcatcaaaatcgtccacaagtaattaagagggagccttttaacacacactctcggcgtgcccgttccttggccaccagttaacctttcttcttgtgctccatctcctatactgcctatttacaccttctaacaatagcatgcacctgtgctagctgctgtaattaaccacctaattaaactaaaccacagacacaaacacacacatattctctctctctccctaattaattctctctctctctctctaga

SEQ ID NO: 24238 - DNA, 1034 bp, Oryza sativa
ctttcagcgtgtaaatacggcattgacaagaggctaatggtcatattgaccaaagtttgccagtgagaaaaaaatctgcccgtctcaacagaatagattttcaacagcttagatgactaggcgcgtgttttgaagcaaaattgcagtgcagaagagaagttgacgtttgagagcagaatattcagattgcataaatatatgtccaggcttataatctggaactaaaagttccagttggagatgaaacaagagattaaaacatggttaatcacataaaaaaaaggaaccagcattttcgtaacagtcagcatgccttgaagcgtttgaaactagagtattacatcacaaagaagaaaaggaaccgaaatattcagaacattcagcatatattattaccacacagcgaatcacagttttgctttgcaccgagtaaaattaagaccggaagtgaattacatgaggcgacaccatcaccaatccctctgtaatttgcttcctcagcagctcctgctcctcgatggtctgcggataccatgacggagcaaccttgatcttgggatccaagtcttcgcagcactcgagcaacttcctgtcgtacagggatacatcctctaggttaacagcagcttccatgatgtgcctgatgtatccaaggaagttgtcatttggttggaaaccatagattgtgagtttagtcaggttgtaatgcctgaaaccatcaggtgcagatgactcccactccacgtttgctttttcagagtaaccctgttcttcccgttccaccttgtcggtctgcatcccacaccaatggtcccaaaccgtgacgcgcatctccttcagggagggtgctgcctcgagaaagaagcatgtccaagaaatatcacattcttctgggagttcatccagattcagaacttgcagattccgaagaacaggcgccaacagtttcgggcactctggctgaacccaaatctgcaatacataccagcaataaaggatgtagattaagttgagaatgagggacaaataacctg

SEQ ID NO: 24239 - DNA, 386 bp, Oryza sativa
cgggttatctggtgcctatgatcatttatgaaactttcttaatgcttttattttaacctggaaagtcattacctggctaatgggggatctatgacgtaattttgatgatttgtggaatttcatttctagtttttcgttacggtaacatggagcctaatagctcgatgatgctatatttctattgccaacctgtttacatgttcacgttattggtcatcctaactctgcaatacaatcgctatagaatgcatgtctgacaaaagctaggtgcaggctactgtactcgactgtgcttatgctgtttatgtgccaaatatttatgctacaatagtaatcttcttaagtcacatttcaggaggattaagactttccttttgaattaaata

SEQ ID NO: 24240 - DNA, 303 bp, Oryza sativa
ctgcatcagtacattcgacctcttggattgctctggtttgaatgatatatttgcctaccaatttatcatttatatctgttaatctagtattagcatcttgatttagctctatcggttgtttctcgctttagggtttctaccggtatcgactaaatcgccttgctagattaaattagcttagacatctaccaccctgagaaatcagtctaagggcttgatagtctagatattgtgtttctttacaaacttagtgttgcataggttaagtttgatatactaagtcgtgtttagaaccataatctc

SEQ ID NO: 24241 - DNA, 1501 bp, Oryza sativa
ggattttatttctttaataattagctaaaatacctgtgctttcgtacaactcggaaagaaattaactaggttagcttattatcttggctacatagatcgatgtacgctagcttcctgtgtagcagatcgatatacttaacatcatgtacatattgcttaaacgtgtgcctttttttctctctctcttgtagccttccgaacagtaagttatttcctccatccctaaataatatttgatacttgatactgttgacttttttaaacatgtttgtccgttcgcattattcaataacttttatgaatatgtaaaagtatatgtatacataaaagtatatttaacaatgaatcaaatgatagaaaaagaattaataattacttttttaaaaaataagacaaacggtcaaacttatttaaaaaagtcaatagtgtcaaatatttagatacggaggagcaattagcaccaaaaataaaaacgacagacagaaagggtgaaataattaacctgacatgtcgtaaggagtagtagaagattatctgtggtacgagtgatattgctatactaatcctatgtatgtatgaagagggccaaccggcaaatatatacatctatatgtatattttgcagccttgctgaaaaaatgttactagtacgtagatgtcccttgagccttgagcccttatgtattctttaaaaaaagaaagattcggaggaagagacgtcctttccaatatttataaagtaaattataagtttgttaagaatttagcacgagactttaggattagaaaccgtacaccttttatcattacattatcaaatgcatctccgaaccgaactcgctgaggaccgtactcattgagtatactaaaaaacaatcattccgattgtcttagtgtgctgatcaatctgtgtacttcagcggctgccaacttgaaaaatgaattgatgtgattttttaaacagttcgaaaaactgactaacaaaaaacgagatattttttcagctgaacctgctttgccatgctctgccaaacggagatcgtataggaatgtctccttctgtactcctatacgagtgataatagtgggctagaaggttatgtaaaggagagaaattaagaaaggaaaatatatattgttgtctctcagtctcatgtaagagttagcattacatataagttaaatacattaattaaattcttaagtaagagaaagagtgagtgctaacagaaacatggagataattttatacccaacttaaagaaagagtgagtggtaaaagaaacatggagggaaagattgagtgctagaagatacagtattatacatgttggttctgatattagttaactctactagcactactcctcgtggtaaagaactctacagttctttaaaaaaaactctactacggctgcgtttagatccaaaatttggattcaaacttcagtacttttccattgtcacgcccagaaattcccgaatagaattccaagcagaa

SEQ ID NO: 24242 - DNA, 1501 bp, Oryza sativa
ttatcttgcatctcacggatggacatggagaattcgtcattgtccaacttaatgtgttgaaaagtcgattcagaaaggataaaaacagttctcttcatgaatacatgtctccctgagtagaacattcgtagagaaaaacaaatgtaagatcaaatagatagttctcacacaatcagacggtaacataagcacaacagaaatagaagaatgaatataattacaaaagagattgtaatattaaagtaaacctggaaagttgcagatgatgaagattcagcattcttggatgaagcaaaacctaaacctttgcagagttgaaaaggtatgttggtaataggtatccatgatctattaccaaaagctgacagaagtgatcttggcattctgtttatagcctcccgattgttctcaaatagaaacatgaattctttgtactgtacaagaaccgatattgattgaagaaaaagaagaagatctttcaagtctgcactcactatccttggatcatcaaagtgtttgacgacaagagtgacctattgataggaaaatatagctcttagttgatactgcaactctgggtagtgtgaaacataaaccagaaaattgcccataattagcgaagctaacaatgagatagttttattttgttctctgcaatagggtgttgctaaaaaacacagaacactaaatgcatcaaacttcctattatgcacattcaacctcacaattttgctactaaatgtcctaggggtcctcgtctctgcctccggtcggcaccctctcctgcgaccgcgccggcggcctgctcctccccggcacctctgttgacgctcgcctcttgcttagtgaggcatcttaatttctgtctcttcagtcccaagagacatcaggagtccagcgatgcatcggtgatgccactgattgctagagttcttgccagtggtcggatttcaccctccctgtttaaggaaggatttgaggtttgcaaaatttggagcttccagcgaagaggagtcagcagacgatgaattggaggcgagaagtgccatcaggaagaaatggcgaagttctgctttgaggaactgtgatatgaggaagaaaacaatgatagatgcccttttaacttgcggttaatgactgacactctgatgggtgattttatatttttactttatgcgtattgcttcctagcgtacttcaaaacagagatggttactacttaccatgtgattaacaagctgtgctgtttcattgacatcaaatttgatgaatgtggtatctccgcgctaacagtaaatgcactcactgatgctggatatgtacaaactactggtgtgcaggaaacagcatttcctatgtgtcttgaaagcactctttttttttctttcattggaaattggaatatgcgttaccatccacaaatttatacagatcatgctacttgcttcagtagttccacacttgctacttagcaccttgtggtaccattatatctctcgat

SEQ ID NO: 24243 - DNA, 1501 bp, Oryza sativa
cccccagcttgccgcccccgagcggcgccgccccaccaccccgccgcagaacgctgccaccgccagggtgcgcaagctcgccgccccaatcgccgagcgctgccgccgccgcagctgactcgacgccactccgccccaaccgccgagcgccaccaccccgccgagtgccggcggcgccactgtgcgcccccgccgccccaactcgacggccccactgcacgatctgtggcgctgtggctacacaaacatcactgtgttagtagctttgcatgcatcgctagatgctaccatgccaatgaatcttgtcactcactcaccatgatgctgctaaagctaaaaagcttagctagctatggaacatggaaaacatggcatgttcttgtgaaggattactacgtttccatgccatgtgctgcctaatagctggggcggctggaggtgctgccgcacagtgccggcgggggtggtggggcggcgctcggtggtggcgcagggcagcgggtcggtggtgacgcgacgccgaagaagcgtgtggcggcggcggtggcgctacgcctggagggagcgaatcgatctagacccagagtatctctctttgatctgacaggtgggtccagggtaaaaatgtccacaaatcttgaaaatatatacaaataaaattaagaaaagaaaaatacagtaaaaatagataaagtgttaccaaataggctaattagcagtcctaatgacatattatagagggcatacggattaggtggtaaaaaaattaaggaacgtgaatttgatggtaaatagtctaaattctccatttagaaaaggaataaagcggtctgtctcatacattatttatttagtaataaagcacttcaagattccaccaaactggatacagcaaaggcgttgtgtcaagtgttccatccttttgaaatattagctctagaaaattctaaaatctacacaatttcataagacatttgcagggattttcataggaaaggaaacgattcgattctcgcagtaagaacatattacattttccatgctgcaaagagagtgaagtagcaacgcacattctgactagcagtagcatcacaacttgaaatgggaaacgtagagcaggtacctggccgaaggactcggagacggcgcggaggccatcgccggagcggaggtctactctgaaggcgcgaagcccggggagcgcgtgcaggagcggctgcggcggggtgtcgcggtggtgggtgaaggcgacgtcgacctcgccgccggcagcgagcgcggcgaggaggtgctggcccaggtagccgctgcccccgacgacgagcacacgcttcctctccatctctgcttctgctctccccgcgagagatctgcgagttgaggattcagttggtacccattttctgcaaaccccacgcgaaggcggaaacgtattctcagaaggcggaaacggcgacctgtcagagtcaaaaaagtcaaaaccctccctggataggggaaa

SEQ ID NO: 24244 - DNA, 1501 bp, Oryza sativa
caagggttcttggggacagttccacagactaaaaacaaggcgtttgaggtttggtagggagctgagctcaactagttctaagcccgcactagagatattaagctcaacaagccgcgggtgttcaaacttcatctgcaacacgctatcctctgtttgacacatggacaaacgcagatactctagccgtttgcatgtggcgatgatgttgagaatgtcagtttcagcaagccttaagttgcgtaggtggagacgcgtaaggccggcaaatgcatcagtacaggcaccaaaaaatgtcatgagctgcttgccattgtggcggagatcgtcgatagagcaatgttgtgcccgcttaccagtcagaatactgaattcagcgctgtcgaggttgtggctgtgggtggccattgctcgggcaacagttttgccaatggtgagacaatcatagtacttgaggtagaagcatatggtgagttggcgaaggggaatctcttggtttctgaaattgaggatgttgtctgttgcatcagacacagcagcgttcatctgaatctgaattgcgtccttggaggtggcataataaccataataatggggcacaaaggaatcaaccgaaatgtctaaatttgagagcaaatggcggaggtggatcgtcctcttggaaaggaggcaggtcctgacagcatcgggggttgacaatattactcccctagcctcacaaataaattcctaattcctttatgatacttcaacaaaacagttgcctcagctcttagctgcatgtcaagctctcttctagttgtagggcaaaggataagggaaaatatttcattgcaacaaaaaaacaaaaggaagccagaacattcaaacatattactattgtatagcatgcttacatatgccttgaaacgtttgaaactagagtatttcattgcaaaaaaaaaaggtcagcatatattattgctactcaacaaatcacatttttgtgctgaggatttaagaccggaagtgaattatatgaggtgacgccatcaccaatccctctgtaatttgcttcttcaacaactcctgctcctggatggtctccggataccctgacggagcaaccttgatcttgggatccaagtcttcacagcactcgagcaccttcctgtcgtataaagatatgtcctctaggttaactgcagcttccatgacgtgcctgatgtatcccataaaattctcatttggttggaaaccatagatggttagcttagtcaggttgtaatgcctgaaaccatcaggtgtagatgactcccactccacgtttgttttttcacagaagccctgttcttcccgttccacactatctgtctccatatcacaccaatggtcccaaactgtgatgcatacctccttcagagagggtgcagcttcgaggaagaagcatgtccaagcgatatcgcgtccttccgggagttcatccagattcagaacttgcagattctggagaacaggtgacaac

SEQ ID NO: 24245 - DNA, 1501 bp, Oryza sativa
gcaaacctaaagacgtcatcgccatgttcgcctccgcggacaggctctgatcgacgtcatcctgcggcacgtacggctcaagcgctagtgccgggatgaccaccggcgtctcaggctgcccgcgctgctggacatcctcaatgtcgacatctctacaacgacaacaaggtactcggaatcacatgctaagaaaacaaaggaaaacagctgcatacataaaagaggtccgggccaatagaagtttttatagtgtgttgattaaggggtacaagggaaacagaatcctactcttcaaaaagggggagaacagacctcctgatccagaaccctcttgatgtcgaggtcagggtatgccagcttcacgcatgcgaggacatggcacgccccggtgtagatcccgttacacgtctccacgccgattctggccgcatgcttggaggggatctcctccatcgccacagccaggtccgcgagcgaggacgtcagcgagaactcgtcaggggtcgccgggatagtggtcgtcacgccgcactccccgacgagttggtgtaggccggtgtaagacacccgcagcgagctgcggatctccgacaagttctcgagctctgacatccggtgctcgagcccttgtcgccgccattcattaccagccaccaactccctcatcttcaggaggtcctcgcgggcctccgccagaccacgcgccagctgctcggcgctgtggtttgccgacgaccccgccgccctggcttccttgatctcgcggcccacgcgcgagcaccagcctggaggatgcgctttatctcggcttggagctccccctaggtgagggcatcaacgggcgggccccgagcgggcacaaggccgccgacgggcccactcagcgtcgcctcccagtccctagtcacgaccacgacatctgtcgaggccgccacaggggacatgctggaggccgcaccggacccgtcttgcgtcgcctttgcccgcgccgccctgcgaatgatttccacgattttcataaagtcaggcggccaaggttttgcgaattaaaggacctcaaaatcatctacttactttttgctgagcgtcaccagcctttgccgtcgctaaggcgggggagacgcgtccgaggcctaagtatgataagcatggtgtgaggtcaagatcttccgactacgtgttaaaggacaagagaggcttaccgatgggttaggcgccttccagtgggtcccgggcacggaggagaacttcctccccttcttcggaacgttgctgccactcgtcgtggcagcagcagcaacgtcggacgcctctttggcgacgccctctttcaatgacgccgccgcctgatggtccgcaagcggcccgatgacatccgtcagagggagagcctgcatacatgaagtcacgacgcgatcctaggatgacagaaataaaggagtcatcaagtatactcacgttgatcacagcctcgcattcggccacccccttctggcaaagg

SEQ ID NO: 24246 - DNA, 1274 bp, Oryza sativa
acaaggtctcggttaaggcggaagccagggaaggaaggggagagatggggccggtgcttgctctacaccctcggtctcgagatggtatgtgtgcgggcaagcatgcggcaaacaaatgggacagggcagggtgttgcagaggctcgtagagggaatctcgcgaggtcctgaggcaggaggcctctctctcgtgcacactcgagtaaatgaggaggtgctgttggcagcaataaattatggtggagaaggacagatcagccaatatcgcctagggcgagtgcaatgcgactgaagcagcgtggcgtgtggtctccagggcggtctggtgggacgtggcccagccgagacgcacagtcacgcacgagggctagcctggcttgcgcaaccctgcgcaggaggaaacagctcgtgtttggctgtgctgtggcgcccgaattggaggtggggaccaacaggtcaacgaaacaagagaaaacgagaagaagagagaaaggactccaatttcggctgagcgtttgactaaatggttagatgggcagacttgcttcaatctgaatgtaacttggagtcaaggttggtagtaaggtatggaagttttaggaatttaaccataacttttggagaagtttcaaaactgaaggttggttagggcagtgggaaccgtttagagcgatggtacaaacattaatctgctcagctatgatttttcatgcacgaaataaggcatgcggtgcaatgcacatgaaaaaagtttttatgcaacaaagaactaaagtgggttgttacagagtgcattgatcagccttttctgtgtaagttgtttatgaggggatgactgtaatgttctacctcacatttatttatgatttgttaggggacgactgtattgttccgcttgaggggacgcctcactgttccacctcacgtacaacgttcagcgccacatagaggtgttaacatgaaattcatcacgacacacgaaggcctgggagatccacttatctctagtgcaggccctattaatcaggttcagggcgtgccagttagtttgatcctgcaactaacaagatgaataaattgactgtacaagatcaatgagccaatcggacaataggccgatgtgatgcagcgaggccagccaatgtcgatagagttttgatcaatcggctataggttcgacgtagattcaaataatcaaataaaaaatgaagttcattgtcagggttacggataaggtataccctctacccttggatatatgttgtataccgata

SEQ ID NO: 24247 - DNA, 1501 bp, Oryza sativa
agaggggtcgagagggagggtttactgtagtgctaccttatagcctatcgagctctccagatgtttgagtctcgttttcttttacaaaatataatatcaattattgccaaagatgctgatagtaaaactctaaataaacccatgcctcaaaaaaaagaggtgtcaccgagccaccagtatcagtcataggaaacataacccatgtgaccatgtctacagacaactagtcattgtctcctttttcttccggtcatagcttctaataactgtcactttgcacaacgattaaggtcgtaaaatatatatcgtatttttattttgcgcaatgtttaaggaagtcaaaagattgagaaactaatgttacatgacaatttttaaattatttcagtacgatgatatagacaaccataacacccccaagactctcctttttgcaaatatttggaatgctagatctaattgtaaataaattggacctagttttaatagtactactttataataaaaaaatgaaaatattagccaaaatgtagagtttagttgcgtggaagttaggatgtgaaaattaattaaactaatggtgtatgattggggtcatacggatttgcttcttaggtgcactatttaatcagttatcagagcttatagcaaaattgtcacctaaaatgatattggccttctagctaggatcaatatgtcttattttttgggctatattaattattatcattttttataacatagaatttgaagcatattattgtagtaaaattatactggatagcacaacctgaagagagcattataagaagcaaatatgtctaaaaattgatttaacacaagaaacctgatgaacttttgttcctcaggaacaaatttaccgctagatgaaccttgctcatcactaagaatctcttctttcagtgaaagcttttggagtttcgacaatcttgtgcgcagctggtttgtcccacctaactctagtcttttccataagctttcatgctgccatgtgaaacatattgtaaagcatattgtaatagcacgtggatgcagcatattgtagaaggattttattgggagtattggtagtaacatcattatagagagcaactatagttaggtttgtgtcctagatatacctttttaaagtagatgggttagaactaatacatttttcagaatatctacagatatgaacatgattgttcgatataactacactcaattgtgtgatttgttttatcgaaagtaaaacaagcatgaagtgccagaaattttgaggaacaattaccaaatgtgtgaacttttcaaaagagtacatctcatggacacttgtcttttgaacaaaggcacgtattgttactttccctgtttccacgtagagagcggctgacctcttggtatggaatacataatttttaatgggatcggtgtagtgctgcaaaagacaatgtgaaaaacccatgtacattcaaagtgaataataatgattaactgc

SEQ ID NO: 24248 - DNA, 1490 bp, Oryza sativa
  unsure (1)..(1490): unsure at all n locations
atgtggaatgctttgccaccatctcaattatcaggattgaaccccatccatttcttctagatcctacaaaagctttgctaactcccctttgcgtgcttgctgagctggtcactgtcagtaaaatctatagcatatctatatagatttttgaaaagaaaagagaaactacttgtgaaccaccagagggacgagttaacaagcatgtgaccattgtacccagtggggcactgggcggcgctgctgcacctacaagggaaatgtcaaggagtgtcgtgccacggcgagggttcacagatatataaaatctagtgttctcatcattccactcagcagcttctggcatctgcactaataaaatggattatattctgcactttaacatcatatagtcatgatgtaccatttgtgtcagcaagaagcagtagaactcaacacgaaaacaaagattgaatccatacactatgtttcagcttttcaggtttctccctgaatgacaaaaacaagaaattgaaggagatggaaggtcttcctaggccacattttcaaacctgtacactcttggaaccaaaggaaagaagaaccaaacaactgtaactaaaaaatgcaggtatttcctgttcagatcaattgagaacaactatcagaacttcattccttttacaccataatctgatctctatcgacaaaggtaattgagccaactacgacactatcatataagcaaggaaagaaaacacatgagaaatgtaaatgttaaactaaatccaaaaggaaaatcctgaaagtaatcagcatttactctttgaaactgaatccaaaaggcatggactgtgataattctaacctactagcatcgctacatgcaagcaacatcaagcacatagacgaagcatccagtacataggcgaatcttttcttttgttagaaacaaagttgtactagcacaaaaattatcttccagttatgctagaaatttagggtgtgactcaaaacgaggggaatttaggtgtgggatgaatagatggataccttccgttcttggtgatgaggaggtatcgcgcactgcagatcgaggcggcagccgaggagccggtgcagcgctgcgaagggggaggtcgtcatggtggcggccggcggcgctaggtcaggaggagcgatggacacctgcagcggcaataggtcgagacctagcaggtgttgggctttttcactttgttactattttcaaccttaccttttttttggcaaagttaccaaaaaaataactacatttagtttgttgccaaattttagtaagtacatatgaaatcttgccaaaattttnggtaaccttaccaaaatttggcactgcaaaaacttgataaggtttatcgaggagtgatcctctctatcgggagatcgtgggattcccctttcgtgagttcggccgggggcaacgggtgagatccgaggtcgtcgattatccgcggttcaagctcctgaatcttaca

SEQ ID NO: 24249 - DNA, 482 bp, Oryza sativa
gttttgtgattgtatcaaactttttactacctcaagtaaaatagtcaaggtagtcaaactaaattaattagaaacctaattggcaaaatgaagcaacttctaaatgtgcctaagttgaacagaaggatataggttttataatttattcaaatgctacagtatttatcaggagttaatataatttttcaagaattgttacccttagttttgacctcctaaaaattcaatttagttctcagcataccccttttcatctttttgtcagaattaaaatgtttcaaatttttgagtgaaactttgagaaatggaatctaggtagcataggttataaccacaaaaatcaccaaattgttaacatcattctaacttggttaatttgaacttcaaagaaagagaaacagaaaaatctctgaaaatcctgtaaactgaataaaacatgtgtttacctgtgttcctagccattctcgtcacccttacgtagc

SEQ ID NO: 24250 - DNA, 1439 bp, Oryza sativa
gttttgtgattgtatcaaactttttactacctcaagtaaaatagtcaaggtagtcaaactaaattaattagaaacctaattggcaaaatgaagcaacttctaaatgtgcctaagttgaacagaaggatataggttttataatttattcaaatgctacagtatttatcaggagttaatataatttttcaagaattgttacccttagttttgacctcctaaaaattcaatttagttctcagcataccccttttcatctttttgtcagaattaaaatgtttcaaatttttgagtgaaactttgagaaatggaatctaggtagcataggttataaccacaaaaatcaccaaattgttaacatcattctaacttggttaatttgaacttcaaagaaagagaaacagaaaaatctctgaaaatcctgtaaactgaataaaacatgtgtttacctgtgttcctagccattctcgtcacccttacgtagcctaccacgacctggacccacatggcagtgcctttggcttgctcacacttgtgttccaccattttatcgcgtgggacccaccttgaatatagagagaaataccgacacgttggaacatcgtgacagcttatccttcttcgcccccttgctctcgggtaagtctatcgcgcgaacgtgcgccagacgcgaacggattggtaggtctagtatacgagccaggaatctcgcgaattttgcgataccttttcatcttttattcctcatagctaattacatgcctaattacgtgcttaaatcatgattagtttaatggccaatgtcctggtagtttgtttcttcggttaaaataagtccacacatgctttatgttttcttgttacgacttacgaggtttgtttggattggactgtagctattttatttttaaaaaatatcctgtgatgatcaacatttatatttctattaaaattaatacactaaacttttaattccagagatataaattctatataaagtttatataaataaagtctacacatagaaagtttatatacataaaatctacatatacaatctttacatatataaaatctacacatagaaactttacatgtataaaggaaataattcatataaaaaagtttccgtcaaaagaaacaatgaaaaaggactaatgaaaaaaagaaatctgaaaaattacggcgtggaaaaatatcgcctatatttgttgcgttgtccaatgctaattactatataataatatctgacaggtactaattacacgttaattaggtggcgggatgcatgctaattctgtaattcagttgggttgccaccggctgagatccgttggaggtgttcgtgacggacgaatgctcgcgaactagactcgtcccttgctctctagctttcccagccatccctcctcactctgtagtccaccctagatccaagaaac

SEQ ID NO: 24251 - DNA, 923 bp, Oryza sativa
tttaatttgttgaatatgtgtaatcaaagtgtgtttggattattattttgtgatgattggtttttatgtttggtgataattggctgctagtgattttgtctttggacaggccggtttcactagggtgcgtgtaccagtcctcccttttatcaaattcaactgaaaattcaactgagtgattgtttctttgaacacgacctctgcttctaccatgacactactggagaattgattattaacgacccgaaatgtggtcgttaaaagcttaaatgtggtcgttaaagatcattaacaaccacaaaagtgtggtcgtcagtggtcgttaaaagctccgtcgtaatagtactaacgaccacgcaactttttttggtcactattttattaacgacggcattttttgtggacaccccgagtattatatcatccagtgtccaacacgaccaccacatactattgaaggaatgggatctatacacgcataaatagccactcgtcctcaatgtgtccatgatcgcggttgacaaccttctattataataaccggaatgtcgagtagtgagcgcaagagataaccgtaagacagcttgccagtacactccgtcatatgcccgtcaaccactcgaaggtggcgaccaaaagtataccccagtgactcgatccaaagcgctatccccgattatctcaagcgatcaaaacccgttactcatgcttagctagtccccaggaatgtgactagcctcacactttcatcgcaagcaattaataaacatagcaagtaccataatagggttaaagtgcagcgaggtacatgacacataatagggtccgaggtcccaacatacaacacctaaatatagcagcggaagtctcaaatagagttcataagcaaaagataaaaccggtggtgccacaaccccactagg

SEQ ID NO: 24252 - DNA, 427 bp, Oryza sativa
cagagtataatctattcgaatagtcgcgtcctcggttatagacaatgcttgatgtgttagttatgttagcatcaaatgtggattattatggatgggattatgtttgatggtggtgttggcatgttgtgccatgttgttatggactttggtagtccatggttgatgatgagagcgccgtttgggctcatttgcttatatatttcagaattatatacttgctgtccataaattaaaatgatgctagatttacttgtccttgcttattttactcattaattgctcaataaaatttgcttgatgcaaatgttgaacctagagacccactataggctagaaagcttgcatacttctctctcccttttgtatatataattttgggtaagacttgcgagtacaatcttgtacttaatccggtgtctgcaatttc

SEQ ID NO: 24253 - DNA, 874 bp, Oryza sativa
cagtagccgaagaacaggtaccagctagagcatgcaaggagagattaaaatcctcttctaccaattcaggagcagtgacagcatccaaaatatcatcaaacaagatcactggctcttcctgcacagcaactttaactcagcctcttgtttgacacagacttgaccagaaacatacttatcaccacatttgaaacacagaccctgagcccttctatattccttcagctgctgtgctttccacaactcaccacgagccaacttaggtttctcattgcctctaccaacagcattatctcggcattgattaaacctcttccttggttgtccaatatgagcaccctcctgagccaaagcaacaagacaatcctgggtaacagtagtaggctgagctgcctgaacgaaagacctcaagtcatccttcagtcccaacataaagtgagaaaccaaaacagaaccacacaagagcgggtcatagagacgaatctgataaacaagttcactgaattttgaacaatattctatcactgtgctagtttgtttgagtaacagtaactcatccattttcacagaccaaaggtgcacatcaaattccctagaaatagcagttttcaacatctcccaatcatgccaacccacttctaacttccatgtctgataccaatttgcggcatcacccatgagattcatagatgttgctgaaactagaaatgcttccgtgatttgatagaaagcaaaataagtctcacaattatcaatccacaccttaaccccatttccatcaaacttcggaaaatccattttaggagtccactgacgatgacccatgtcacaatgctcacaatcacccggagagtaatgaggtgaaggtacccaa

SEQ ID NO: 24254 - DNA, 1501 bp, Oryza sativa
aaattggagagacacatgcaagtgttggtttcttgtatcaggctagcctgactagcatgaggtcatgtttggttgctgtcacatcctgattttcgtttcaggatttataaattatttaataaattattcttagaatttatattaaatgttcattaatataaagtaaaatgtggtaaataaaatttcataaatataaagtatggctggatttaagtcttattaaattttccatgattaattacactctctggaattttctcagatttttcatagcttaattcctaattttaataatacgaagaacatttcagtaattattaacataataaattaatcattaaaggatctggatatagttttgctaaacacttagagtgtccaagtatttttcaggattcttcttgaaattatttgagcattggaaatatttttaacaattcaaagatcatttcaatgattaatttaaattggaaaagtaattaaaatccccttttccttttcgggttgaaactggaaaaagtcatttttccctcattagcccatccttcctctgtgccctcttctccattctcggagaaagcttatttcttgtcccttcttttcttttagccccgacagaagtctactttgctcccctgttgctacagtgttgtcttcaaccttcagccgtttctctcacgtgcccgctcacagtagcgctgcatcctccaccaaatccggccatgccgttgctcccaatctaaaattgatcgcggaaatagaaccctctcaatctcctctaccttttccccaagaaagaccccatcaaattcgtgcttaatcccatgaatttcggtcccgttcttatcctaacaaatcgggataaaccctaattttcggccaccaaatcccaccacatccgtatcgatctctacctcctccgcctatataaaggatgcactgggtctccccttcgctttcccctcctttccccgagctcccatgcccaagccactcttccccgcgagctccatctctctccgccgctgccgccaaccccagccgcaacgtgctgtcatgtcacgctagtcgctagatactctgacggacacattggcggtgacaacagaagagcaacaggggaaggcgtaaagtgtaaaggcgtgatacgaaagagaaagcgtactttgtaaaaggagtaggtgtgagtgccatgttgtgtgtggggccagtgttagctggcgtgtgaggggataaattctccatgagttgtactgagaagattatgaaaatagaaatggaaaaactaatcccacctactctgtatccttctccttcctctgttcttcctctgctattcccccaactccggcgagctccgtcgccgtgattagggccatgccaagttggtatcagtcgcttttcgatccccggctatctctcgcactctctcgactcttgatcagtaaatccggtgtttcgttcgtggtcttccttcaggttgatttgcggtaaatcaagg

SEQ ID NO: 24255 - DNA, 299 bp, Oryza sativa
tagagcgtgtttggttgcctgtatgtaggttggttcacacccacggatgcaagcaacgcgtgtttggttgcttgcacagcccatagggcctagttccactcatgtaaatttaccttccgagccagtcctgaaggaaacgcttgatttgagcttcgatccccatcctggccaagcgcgtgcaggcgcgggtgcgggtgggtgcaagtggggacacgtcaatgcatgaggctggagggggtcaagcatccattctcttccctctcccatttgctcctagaggccaccggattcgttgtcgt

SEQ ID NO: 24256 - DNA, 737 bp, Oryza sativa
tgaaaaagtcatcaacaacaaagttgtaaaactcatcaatatatataacttttattttggtcatttcttcatccgataaaacgacagtaatattgttcacaaaatgtagataccagatatctatattttgtgaacaatgttacaaatcactttgtcgcaaatgaccaaaataaaaattgtagatctagatggattatacaactttgttgttgatgacattttcagttgaagtcgttcactgataaaaaattctatttgaagtgctcaaactttgaatttcaatttcaaattattcaaatagagtcagatggagaaatgacaaaaataaaaattttgcatatcgatgagttctataacttcagttttggtgaagtttctatttgaaatcatttattaaccccattttttgttcgaagttgtcaaattttaaaaattcaaaatttgaattgttcaaatgaacttatttgtaaaaatgaccaatacaatagttgtagttctcgatgtgttctaaaattttgttgtttataatttttgcatttgaaacacaaaaatcagcctaaaattaaatttaagttctcataaatttaaggtgaaatgtccattttgtccatacaattttgtagctactacagcacaccagggacattttggtaaattcgcatagaattgctccctgtccatataatagctcaaccagtgaccaacgaaaccttatcctctccctctccaatctccct

SEQ ID NO: 24257 - DNA, 1501 bp, Oryza sativa
cctctttggatgttgatgcctcttcatctaagtcgtcttttcttgctatttttaatgccacatccgatgatcaactcgaacaaatcgaggaggaggatttggctttggttgctaacagaattgctcgagctatgaataatgccaggaacaggaaaagaggtggtccaaattgttgctttgaatgtagttcaattgatcatcttcgttcgcattgtcctaagcttgggagaggcaaaagagaagacaaggatggtgagaagaccaacaacaacaagtcgaagggttcttaccaagggaggaagatggagaatcttaggaaggcttttcaaaaagtttgtgcccccttcgagccactaagtaatgtagatggtgaaagtggagatgatgacaagggaaagaacgtctccgatgtttgcttcatggcgcgtggtgaatctgacacagagtatgaagacaatgaggtgagtgcttttgaggaagctattactattttgagtgcaaaaaataagaagtgtgagaagatgtatagaaaacaggaatttatcattgaatctcttaaatctgaaattgatagattaaaatatcttattcctaatgatgatgattgtgaaaattgtgaggttttaatgaatgagatttcaaaaattagagatgttaatgctgcacatgatttgaaaaatagatcttctcttgcttgtagttttgctttgcacacacgcactttggatgagttgtttttaactaaaaagttgttgcaaaaatatcaaattgcctttcatgctagtttgatgtttaacatgatttctgctaaaaagttaaaacaacctcatgttgttttggattgctcaacatgtaatttgaataagatgaaactaaaagatgctttaggtcgtgttgagtacatggaagatgttgtgaaaaacaatgaagtgctttcttgccccaaatgtcgtaaaaacaaaggtgttgtcacatcctgattttcgttttaggatttaaaaaattatttaataaattattattagaatttatattaaatgttcattaatttataagtgaagttaaatgtgggaaataaaatttcctaaatataaagcatggatggatttaatttttattaaattctccatggttaattatactctctggaatattctcggatttttcggaactcaattcctaattttaaccctacaaagaacatttcagtaattatccacatattaaattaatcattaaatggtctgattataatttttttaagtactttgagtgtccaagtattttcaggatttttcttgaaactatttgagcattggaagtatttttaacaattcaaagatcatttcagtgattattttaattggaaaaagtttttaaatcctctcctaagccgttgggctgatttcagcccaacatgtctctccctcgcgcgcgtgctgtgcagcccaagtcggcccagccgagctcctcctctttctttctttgctttgttttcagc

SEQ ID NO: 24258 - DNA, 1501 bp, Oryza sativa
ctcccgatcgctttttgtctctctttttttctttttctcccaatcattctgatcctcgccatcttgttccaatatcctctcttttttcctcctctcttttggtattggtaaaaatctgctgtcacaattcgtaactgatttcaatcagatctaggaccagccacctgatgggctttgcattcatacgtccgatattgtctatcacatacatctgtatcccttcgcttcttactcttttccgttttcttttcttagctccttagtcaacgctattttgatatataatcaatgaattaataatttgtagtcaacacctcatatacagtgaatattagcatgatttcaatgtaagtattaaaatcacaatgtaattcttaaaatttacaatgtatttttcataaattacaatgtagttataatgtagttaaatgatttttggtaaaattgtggcaccataaatattttctcttccgaatttatctcctcataaatattttccttttgaaattatgatcgtttaaggtgtgtatgtggtaagtttgttactttgcaaatgcattccatcaacagttaaaaaactttcactaattgaatcatcaaaacgacaatctttgattgattaggtatagcaaaatatacatgggacaacttatggaatagtcatccgatattgtgtacatgggggattctttgtgtcatgacgatgatgcgagcgcatccagattcaatgttatggctgtatttagttccctttaaacttctaaaaaattcgtcacatcaaatgtttggacacatgtatggagtattaaatatggacgaaaaaaatcaattgcacagtttgcatgtaaattgcgagacaaatcttttgagcctaattgtgtcatgatttgacaatgtggtgctacagtaaacatttgctaatgacagattaattaggattaatagattcgtctcgcagtttacaggtggaatctgtaatttgttttgtgatttgttttgtgattagtctacatttaatactttgtgtgtccatatacataaaaaagaatttgacaagaaactaaacacggcctatatatgatttctaactttgttttgcttgtattatttcggtttgtcatttaaattggcagaggtttttctcaattgtgaaaattatcttcgcatgttgcaccgtacatatacttttgctagtgatacaaagatttaagtcaggcttaaagtacatttttaatgataaaacaaatgatgcataatcttcttagtatattatatatgagagtggacatttcgtagtggcataaaataaattctcccatgacaaatacccaatcagaaagtcatacaatcatccgcaacattgctactatagaaaataaatagaataatcctgatccagcaccaacggcaggtgcacccgcccgcacacggtcgcgctgaatttagctccgccaccgtcgtcgccgcgtcgtcggaatcgataatccgatggaacctggag

SEQ ID NO: 24259 - DNA, 224 bp, Oryza sativa
ttctttagggaggagaaccaatttttatcaccggtcatgtgccgcgaacaaccaaaatccacaatccacacgttctccttccttgccaccaaagcctacacacaagcagaagtcgaagcctcagtactggggttagatgataataaaaatttaggaatccagtactgagacacacgaccagaagatccaatagacaaatatccacgtgcaaaatcaattttaga

SEQ ID NO: 24260 - DNA, 1501 bp, Oryza sativa
gtactggggttagatgataataaaaatttaggaatccagtactgagacacacgaccagaagatccaatagacaaatatccacgtgcaaaatcaattttagaattttcagaaaaattcatccgaggccggtctgaccgaggtacggtggccggtctgactaggggccggtctgaccgaggcttcaccgccggtctgaccggtggtcggtctgaccgaggctgttcaaccggtctgaccggtcgccagtctaaccgcgggacccactgcggtctgaccggtgtcctcgagggaaaaccggatttttgccactttgattttgcaaaagcaatctctctctcctttttctgttatgagctaatctgaaacaaaaatcaacaatatgtccatctttgccaaaaaaaagaacaagtatatttttcacgttgtttagacacattgttagagccagaagatttagcaacacaagcagaaacaggaggttttgcatgcacaacattggattttgaagaagatgcattcatggtagacatgataccagcagatttaaacacagttttattagtatcatgtttaatcaaaatctcaccacttctagcaccaacacctaacacaataggaggatgtctagaattatgagcataaggatcaaaacctaaaccacggttatgtgtgctaacctttgattgatccaaaatctttttaccatcagaaaatcttagcaaagaatttttcaaataagaaacctcttttttcaaattagcacaattttttcacaatctaccatgacacctgtcacgtccggaaattcactagtaatttccgaactaatttgtgcataaaaatccttgtccaggaatcagccaaggtacacaaattgacaatttaatatacaaatccatcataaaaataacgttacatacttacaaaagaaaagaaaacagcagcggaataacggtctagcgatggcttcagctccactcccacaggcagctcaactagggtataagccaaacgtcttctccttctggatcctttttcttcaactgaggttgattgattattgcaaggtgagcatatgacatactccgcaagccacacagcaaatatgcaagtgcacaaggataccaaaggatggcataatataggctcatttgcaaaaacagcatttagcaaacatttagaagtaaaacagtagagtaatcaatcatcaattttaaccaacactgcacaacaccccaatgctgcacaggcccaaccatcctgaacaaccatacccggctgtacagatctaactccaaaccaggagctaagcaaatcattatcagttataacatccataattattgtgagaggtgtgagactaattacgaaaaacattgctcaacccgcccatgaccgcgggcacggctattcgaatagttttactctggccagaggtgtaccactgtatccacaagacacatcctcaacatcatgtctaccatgcgttgcgatactggaa

SEQ ID NO: 24261 - DNA, 978 bp, Oryza sativa
  unsure (1)..(978): unsure at all n locations
ccatagaagagaaatccaagccgtccatgtgaagccagatagcgggaggtgccaggattggttcgcccaaactgncggttcgccgaaccaaaaatccgtcctcctggcctcttctttggtcggtaggttgcttattgggcccccaacatcttgcacaatgttttggcccagttctaagtagttttggctgacatatggtcctccaatccgtgtaaacgcatcctgaatgcgcggaggtccattttgtcgcatgacggatgtgttttctcctcaaaatacctgcatacacatattttaccaacactagtgaagatgattagtaatactacttaccactaagttggataccatgttttatttcattatatgcaggtattgacggttagatattatgatttaaggatcgtcaacaccatgctgaacacgtctccatttctgtagttgtgacaagacccctcgcataactcaactcagagaggcgcaactttcctggatcataatcaccccattttagccaaggtatggactccccagcgacccccatgggtttatctctggcacttcatagtttggcacaccacaatgagccttgctatacaaagtgtcaagttgttgcccatgctagcttgtggttggcacggttaatgtttcacaacagtagctcacgaaccggtccttaattgccatgagcacaactatccaaacttcaaaccatctactcacaacccaccattaatcaagttttagttggcaactaattatccaatcaagattgaccaccgtgatcgaccattaaatatctatcattaggttatagtgaagctttagttatcccaatagtttgctaatatttctaagcatagctaagaaattatatctaatatctagctgaaccaatatataaggcccagactagtcaaattataacccattggaaaataaagttgtcgatttctaggatcggtatttgttggcagt

SEQ ID NO: 24262 - DNA, 1501 bp, Oryza sativa
tcataactaattcattgtaactcagtttaatgtggttcaagttgcaaaagttgtataaaataaagatctacatattaaaattatccataaattgaattaaatttatttaattatttttaaatgggctttaattagatttaatctagtaaaattcataataaattcatttgaagtcagaatgaggccgttcaagtctcataattcatctaaaattatgatctacatgtttgtttactttttatgtattgtttattttgtttttgttagtctttttcttcgttttgcgtgttagcttgtcgtttccgttgttgcgaaggttcgtgagtgcgccggaagtattcaagaagattaattgaagaccgattattacaaggcaagtcacacagatcctaaacacaatcctttgagcatgttgatcctatatttaaattctctatttatttcaactgtgcatttattttcaaatgtcactgggtggtgtaaatctattcttttgttatggcctgtttgcattgattactttattccttgataccttgggttattataacttgactagttgagctatatatattggttcagctagatattagatatgattgcttagccatgcttagaaacattagcacattattgggataacttatgattcactattatttaatgatggtttaatgatagttcacgatggtcaatcgtgattggtaaattaattacttgccaactaaaacttcataatggtgggttgtgagcacatggttttgagagttatgctcatgacaattaaggaccggttcgcgagctactgttgtgaaacattaaccgtgccaaccacaagctagcgtgggcaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggttgtattgaggcacatggtgacatgttgtggggctgtgtcttgtgggtacagtggtacacctctggccagagtaaaattattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcataggtgtgctgtccagtgttgattaaaatttttgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagt

SEQ ID NO: 24263 - DNA, 986 bp, Oryza sativa
ggatttaaaaacatttttctatttaaattattcatgaaatgcaattccattgattaaaaatacttccttggctcaaataaatctcagaaaaatctaggaactatagaatcaagtaaagtatttaacaaaattttatctagcccaattttatattgagatttaacaaattaaaattagatcttctcttttaagatcatttctaattattccttttaaacaacaatttataatttaaggatttttaaacaagaaaagctcttaacaattataattagatcattattgatcaaataattactgaactattctttgtatcatttaggaattgagctctgaaaaatccgagaaaatttcagagagttgacttaatcatggagaatttaataaaaattaaatccatccatgctttatatttgggaaattttatttcccacatttaacttcacttgtaaattaaagatcatttaatataaattctaataataatttattaaataatttataaatcctgaaacaaaaatcaggatgtgacattagcgtagataattaaaacacataaaaagtcctctctagcctagcctacctatcatcagctattgtccttggatagtcttagccttaggtagtctacacacgttccctgagttcgatatccttttggggtcacccgaaggtgaagtgctatagcggtattccgtgcgcttgcagatttatctgtggtcataagaaataccaacaagggggagggttacaaggaaagtatctactagatctctattcaatctataaaagatatgcatgatcgccgaagtttatatcttatctcggaaatgtctttttctttatttacaagatagacacgtgagcctaggctgctggcccaccctatgccccatggcccaaaggcctctccttgatacctgggtaccatgtaacccacaaaagtcatcttcggccataatatagggaaaaggctcaccacccga

SEQ ID NO: 24264 - DNA, 1501 bp, Oryza sativa
tcgaagtaacgtttgcaacatccacaccttcattctttgcactaccctcaggcttcatagtctttccatatttcctaactagatattgaaaaaatttgagtattccttcctttttgggatcattaccattgatcttgtccagtagtttcttgattgctcgtctttcaattaagatagcctttggtgacgtcaaatttaactttgacgctgcaaacaagaaagtctggagttcatgttcttgggttgcatcagactgccgaagcatctccaaaatggctttgccagcctcatcttcttctgggtcaacaatgaatttcacatccccaagatcatcatgaacatcagccacctaagacaaatagtcaagtataaacatgttaatgtgacaatctgtgcgatatttagataatggaagaactcattaaattgcatcgagatgatacaattgtcctgagaattgatgtgtgtgtttatactcacacatctgccatgtaatctaaaaaatcttttggagaaacaacaaaaaacatagatcatgtttctggatacagtactgtctaaacctccagataaatgtttgtgaataatatcctgaaattgttaggttttgttgatgccccagaaataacagacgcaagtactgtccaaggagagcttcatctctattacagacgcaagtttgatgttgtttgtgtcatcactagcttcaaacttttaacacagcaaaccatgtggttaatgctgtgcaatgtagaaaaagtttgcctgttattatcagttcaattaagtaaactaacctgattagctaatgatgacgggaccatattctgaaccaggaacaagcttcgcctcagcgcatctcttatcctttcgcaccgcattgcagttgcctcccctgtaatagcctgagatgtgcaaatttggtatcagaaagcaattgttcagaaaccagggaaaacaatctcaaataaaacaataagataaaaacaaaggagtcattatagtttcctgaacataatgactcatttatcaatattaaagaacaacataccaagtaaagactactgcactcaatgcagttctggattatgagttttcctttgtcaactatgttgtacaggttgcatagttcctctatacccgctttacatcctggttgagcagtttcgattgagggaagaatagaagagactttatctaacatcattgtcaattcactgcacattgagctgtgaacctaagacagaaagacaaaagaataattgcattaactgtaataaaatgttgaagaatatataatggggagataatcactactgaaaactatctatgaagtaaatgataatatttatatgaaacatcaaataatgatcttattgaaatactgcagttttaactctgcctctcaacaggtacaaaggaatcacatcatatcatagataagcatgcaagaaaaaatgtttgtatcaaagatatgttctttatgccatacaaagatatg

SEQ ID NO: 24265 - DNA, 386 bp, Oryza sativa
gacactatagaatactcaagcttagatccgcggggatggaatcgtcatcggcgggatcgagtcggctagatccgcggacccgtccgcgtcgtcagtggatggccggggagggagggacgccgccgtcggctgattgaaggccgtggttgcggtcgagcatagccaggcagaggtcggactcgttgcagcactcggctccccctcctccttccatggctccatggcgagagagataggcgcttggcgaggacggcgaccaccgtcggtgcaaacgacatgagcacaaccttgcacgtccagtccagcgcgtacatcctcgactacggtggcgctcggctccccctcctccgttgccgcgagccagcacgctgtcgctgccgctgaca

SEQ ID NO: 24266 - DNA, 245 bp, Oryza sativa
tgacctggcgcacctgggagaagggtgcggccaccgcgtccacctcttgcttgggcttcaaggctgcgccaagggtgccgccgtagtacgggacgctcccttgactgtaggttggttcatggcatctcttgaccgttatgttgttgtgtttggtttatgagtaggagtgtgtgattgagctcaagaaccgatctttggcttggagagaatcattgagggaaggggagtagagacccgatctatta

SEQ ID NO: 24267 - DNA, 1501 bp, Oryza sativa
tggccgctgcctcccggcctgcctaccagaaccaggaacacatcctcgccgagaggaagcaccatggcctacggtggcagtgggaaatggcctaagggcatttttgacatttcacacgatttctcactcctcacccagaaattattattttaatgggttctgtgtccaccagcaaatattcaacttttgagagtgtcttcccccaaaagtcacttcgcgcggttgccattaaaataatatcaaatgggctcaaccactacactactgggctgagtaatcaacgaggagtgcacctgtcaagttttgggccagttgggctaggccagggttcggccgaaccctgggttcggtcgaatccccatatcggccgttgacatccaggatccctccccaatgacggttatgtggtatttccgaccattccaaccaccacaaccatcattggtagcctatataaggccatcatctcttccactccctcacacactccaacaagaagatcaagagatctctctcaattttagtttagtgttctagtgctaatagagtaggaatagaatagttctcttagtactcgagtctttaggagatttcgggtgtacggctctagtagcttttccttcttttgtaagacttttagaattaatgaaatcttcttcatatagcttcgttcttttatttattttatattatttgagcactgactttactttatacttgtcttgatataattgtgtagctagcttaccaaagatatgcattggtgtgggtttaatgttcatgcgagtgatttctctatgtcattcctagggatgtaaagtagtatttaataatataagcgtggtgcttggattattagatatcattaattagggttatatactgcgggtcagaagaggtaggccgctgattgtgacggctcagtacgggtagtcctccacgttagtatatagtcctaagacactttcctggtatgggtactcctctgtattcatttccggttggatggttatgacggattgtcgtaagtaactcgacaatcagggtggtctctcaaaacactaggagggcatagttagggggtattggctacatgattgtatactagtaagtgtaaactaaagatggctgtatactagaagtataggaatgactattttcttattctttcttcacttagcctagattatattttagtgagagtattctggttcttccttcttcgtgtcaaccttatcctatccttgaattaattaacccctgcatagactttgatgtacacaactaatatataaattattagcaaagtattctcttatcatatctttccttgggattaagtaaatacgataccttagaatacttccgggtgtaatgctccaatggtatatccgtgcgcttgcgaattatatatgtaaacataatataccgcgaatatttcggcaccattgctgggaattatatttctagtaatgtcactaagaaatatcggctatgccta

SEQ ID NO: 24268 - DNA, 183 bp, Oryza sativa
atttttaatccgaaatacagtatatctttagcctttgtaccgactgacaagtgggaccccgggtttattcctttttctaccgaattattttctaaaggaaattggatggtgctaatgacaggtggggcccacaacctattctcttctcttttctcgttctctctatcgtcttctacctccaga

SEQ ID NO: 24269 - DNA, 254 bp, Oryza sativa
gcatcgatatcggcgacgactggctactacgactacgacaacttcatctcgactacatcgactatggcacaaagggctatcatccatgttaagcactcttgccggtttcttctccagtccaagtgtccgcgctgctcacgcttggactgcggggggatgttagagtatatggtagttagagatgtattaggataggattgatttatgtggattccttccttatctgtaatccttccttatctcctccacatgta

SEQ ID NO: 24270 - DNA, 944 bp, Oryza sativa
gaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaattccttgtctttcaacccatccacttttccagcttgatagccacccccttttagtattgccgaaatcttgtttcgacagttgccgcgccaggtaggggtagcatcaagttcttcgccgactagtgcga

SEQ ID NO: 24271 - DNA, 305 bp, Oryza sativa
tttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattagg

SEQ ID NO: 24272 - DNA, 468 bp, Oryza sativa
aatcttgtgtttttcctattcctccgttttttcaatcctgcgattcaaaaggccataaaaaagagaagaaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgatagg

SEQ ID NO: 24273 - DNA, 420 bp, Oryza sativa
caagagtatcattggatttaaaacggatggcctagatgcctctttagtactgtagcaaattagtgtagcgttttttaatgaaaaaatgtgcagctctaattttactgtatctcacaatttaaaccattggatcaataaataaagggttgggattgtgtaactgcactagatctcaattccccctagaatagctgatccaacaatctagctgcatgaagaagaaaatgtacagctctaattttactgtagctcacaatttggaccattggatcaataaataaagggctgggattgatctcaattccccctagaatagctgatccaacaatctggctgcaagaagaagaaaatgattcagatgttaaacacacaagcataaaaacaataattattcaacagtgcttggtgtctgtttttagg

SEQ ID NO: 24274 - DNA, 229 bp, Oryza sativa
catgcagccagattgttgagtctgctatctccgaagtgatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagc

SEQ ID NO: 24275 - DNA, 398 bp, Oryza sativa
ccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtagg

SEQ ID NO: 24276 - DNA, 448 bp, Oryza sativa
ggtgcgttcggcaccccaagttcccaacccctctccctcgttttccgcgcacatgcttttcaaactgctaaacggtgcgttttttgtaaaagttttctatgcgaaagttgcttaaaaaaatcaaattaatccatttttgaaaaaaaaatttagctaatacttaattaatcacgtgctaatggaccgcttcgttttccgtgcacactgtttgggttgggatccggctggagtgaacacagccttaatctattttagaggcaacttaagacattatattgtcatttcataaaaatacttgcaatattccccgggtttataccacagtagtttcgaagcatgtaatatcacatggtcgtagattagactctaaacttaactgtgactacgcaactgacacaaggacatgagtggcactataacttgttatctactggtactattgggcagg

SEQ ID NO: 24277 - DNA, 372 bp, Oryza sativa
  unsure (1)..(372): unsure at all n locations
agagaccgttattagccaccattgtacatgtctaggggagcgctggaaaacacgtttattaacgctacgtaaattttaaacccatactcaantatatgtttagagaaaatatcgctgtccaaacnataaanccgtaggaagcatcatttgattgagtcgtgatggctcttgttaagaacggnagataagcactaattcgcatccatatctaaattcataaataagtggatttccctctaaacggccgtcaaatgccaccgggagtgcaaaaccacgttacatgtggcgatccgaatggcaaatttgtcgttcatttcgagcaaaatagtgaaaaaaaaatgggcttcctagagtccctactggccggaaagg

SEQ ID NO: 24278 - DNA, 439 bp, Oryza sativa
gaaactaactaccaatgcgaactttagattgcaatcactagtggataatatttgtttcatgtagatgttgtagagtttcagttatgtttaaaattgctataatatttgcattttaatgtcaggcaatctttcgtcaaagcactgaaaccttttgttaaatggctggaggaggccaaggaggaggaataaatggtgctactggaggctgtgcgaatgtattgtttgaatatttccttatatcccaagtttccagctaaagttatgtatcttttgctcccttgttactgggccgaccattttatgatcacatgctgatcctaatagtctactgaatgttaaaatcccatgcaagaagttattccaggatttgctaaattattggttgttacaacttacaagaatgttccatatgttatttctcaactgttggtacttaaga

SEQ ID NO: 24279 - DNA, 1360 bp, Oryza sativa
cgcgccttgccccgaggtcgaaactcccctcctctctccccgccgtatttgactgtgttttttttgccccccttggtggccatggagtgttcctactggcagcttgtgccatatgtgattgcgatttggcatccttgctggggtttgatcgcttgcgtttggtgaaccgcgcggcttatatgccctcggcgatttgctctgtgccaccgaatgacccccattttgatcactgagggtacccctccccttattttgtactacaaacctagaatccgggattttggagaaatgcctattaaggctatgtgcaatctgtgtgcttggacagatgcttaggggagtaaactgtgtctatttttgccacgctggtgctgcgtgaggtgcttgccgccaagtgaaacagtcgatgcttgcgagcgcctgcatgaaaaatggagtggagaagcacctgaaataactaaagcgtccgtaaaataggtgttctctattggacatcaaggctcttgaacagatgctaagggatttttttcctaagcatctgtactatttgtacatgccctttaatgcgccataaatatattttttgcttacaatagattaacctgcaacaccaaaggtgatttaggttattagattagtgtagcctccaggggttttcttgaggttgcaacacatctccgtgtcatctttatcctgacctcacgatttgtttgcaccttcagacttgtaggtatttgtatgcacttaagacaaatactggatcatttgtgacacacacagtatgcacaatgaaattgatgagaatggaagagattcactcatagtgtgcacttcaaaacaaatactgaaatcatttgtgatacgcacagtatgcataatgaaattaatgcggctggaagatatgtattcataattagctttaaatgatgccggttgagaatgaaacaatgctgtttaatctttcacataaaaaccttgatatggttttgctaatgcatcaatctttgtgcagagctataagcaagggatctgtggctctactttccactgccggtatttctcgtctaaaggtagtagacacttattccttttatgatttattatgtgcataccttaccttagatatactaaatactgcatcccatggctcagttgctatcatcttaaatcttgatattacctgtattgacacataagttacattgtgaatttgtgatgaaattgaactgcatgattttttttcttttgatttatgttttattgctgccatctactgaatcttatatttattctttttgaatcatctacttagccaaaaagaagacaaagtccagtggaactgactctggtgaagagaatc

SEQ ID NO: 24280 - DNA, 164 bp, Oryza sativa
aaaaaggaattaaaagaatgcaatcaacaaactgtcatcatctccaaatttgcttcaaagaccatctatactctccatataatacggacagccattggtactaagatatagcactaccactctcacaaaccaatcaagaaacacaatacgtcccatgacgatca

SEQ ID NO: 24281 - DNA, 550 bp, Oryza sativa
tcctgattattattaaccagccatatatatatagaagggtagaaatggaggtatcctgcttgtaaattggggcaatggtagctagagttgatgcaatgaccatgcttcatgtgatgagaactaattgtcttcctctgatcaaattaagcaggaagattaagcaaagctcaatattgtttcagaaccattcttcctcctgtatatgcagtctggactgttcttgatgtctcaatattagtgtgtatatgggctgaatcctttaaggtgcaagataggcccaagattatgcatatcatgaagttgggctggaactatactgtttcttcatcatgtagtggttaagcttggcagccaccaactgccaattagttccagcttttcttcatcaaatgagcttcctgcctccaatagccatcatgtaatggttcagctggatttcattcatgtgccacatgaaaagaatgaaacaaattaaatagcatactagcaaacaaaatttgttggttagacctgctcaattgtcttgtggagcagtacagataggggacaa

SEQ ID NO: 24282 - DNA, 549 bp, Oryza sativa
attttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaa

SEQ ID NO: 24283 - DNA, 940 bp, Oryza sativa
aaacttgttatccccgtgttcttgtgttctaatcatgcttatggttttatagtggaaatatgttgatattgctactttccctaactgtaacgcttaaacatcaggtattaacagaaaaaaagaaggaatgagtaatatcacatagaagaagtcatttgttgcagaggccgggtgtaattttatttcttattaatgagaatctccccattatctaaaaaaagaagaagtcgtataccatataccatgttgttgtacaccattagtggtgtgcatctaaattgtacaccatgttgtcgtaaaaatgcactgtacacaaattacagtaaaacacaacaaagataatagactaagctacaagatggatagaatttgcaaactactcatggtttccctatacacccttctgcgtctcattgtcatttcgggcatgtttggattgctaccataccaatttgttgttagtgccaaattttaggcaagttttggcactaccaacattttggtaaaggtttctattgatttggcaagttttggcatcaatccaaacatcacacaagtactatttagactaccaaaaatttggtagggcaagatttggcactaaaccaaaacagcctttcatgttctgtatcatggtctgtgcaggagcaatggtcaaggttacttgtcaggctaatgaccaggcactggtgggtttcggctatacccaagacaatggcaagtacagcgtgagcatcacaggcttaccactcagcagcacatatggggccgactcatgtaaggttgagctccattcagcaccaggaggatctgactgcaacgtgccaatcgagctaaacttgtctgggcttagcgtttactcgaagtccaatgaggaagtggtgctccaagccaaccaagtaatggcattcgcgtcacagaagacatttgggttttgttc

SEQ ID NO: 24284 - DNA, 467 bp, Oryza sativa
ttcctgcagcccataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccgagcagccacctagcaaggtgtcgcgtcagactactgacacatggcccaaacagccaaacgcacagtcgtctcagcccacctaacctaacga

SEQ ID NO: 24285 - DNA, 1501 bp, Oryza sativa
tctcacaaaataaactagagatgaagtagattttaggttgcttcataactttatttcaaacccaactcttgaaataaaatttaagagatcgagtctgctaacatgtccttagaactagaactaattaaatttatcaggttattttttataattgatatggaggttcaggattctcacccatcattttccaaaaaagcgagcaactagacaaaaaaagtggccacaaaacgaaggaaaatggcaaaattgggggtggctttttgtatttctctgagccgatgatgtgcttgaggctggcattgcaggagggccagaaaagaaagaaaagcaccattccctgatcaactttgagatgccaacggaatatgagtgacatattcccttctcctgccattggaggcctgaggctaagccacatccaccattccattccatccataccccaactgccatacacacacatacaatctcctcatcatcctttttgttctcttctcagctcaatccatcacttgttatccatacacttcttaatcagcatcaaagcttatctcactcccccatatactgtagtataatccaatagtacaatcaccaatgttaattactgtaattaatgaaatgtggactagtactacacactgtactagtaatatgcagtgacattgctagagagtttgagtatcccagctactgtagtagtactgaaactttgtcatacacatgtatggtcaggtgtaggagtagtgcagctatccgtatttttaaagcaggaagagaactgccactatcatcatcatcatcaatcagtgtaattaagtaatgggaccagcagacactaaatgcagaatttacctcgagatccaactcgccaccaactccaatccaagtgcagcagcagctatgatattccaaaattcatcttcaatcttcatgctacaagactgaagcagtataccactactaccaatgaacattttactgtaagttggggataaaaagattagaaattggcagaagaatctgcagtataaaattgagcagcagcttggaggcaaaggcagcacagcaataaacttgggaactgctctgctactaaccctgtattattctgcaggagagaggcagattgcccaaaaagccctcacactgtcccacactcccactgctcgccaagtccaagaaagggaaacaaaaaaaaaaggggggaggagagacgaagagagagacaagaacaagaaagggcaaaggcaggggaagaaagcagcgaaaggattcaacgcagctcgcgaaggccgcgatccgccgcctcgcctatccttcttgacagccgaccttggggcggatttaccggtacgatgctgttgctgttcgtctcccctttccgtatttgatctgattgtagtcgctaatcggcatgatttttatggttttactcatattggattgtatgctcgtagaacagaggcaaagaaccgatcaagatggggtttctttattt

SEQ ID NO: 24286 - DNA, 715 bp, Oryza sativa
gctctttctacttgttcacctggatgaaaactacctggctttgtttggctactttttttattggctagtgtgattttatatctcaggctagactcgcttgagctgtcttacattagtggggctatatgtgaatcgcagaggtctgtaaattaaggcaataggcgggcacatttgaaatgcagcagtagagagctcctatagaaaatccaaaattcaataaaaggtcataatggtcggaagctgttcactacttcagaaccatccagaaggcaagagaaaaaagcacctaaggtcaggtgtttcttaggagttcaatatgtttcatgtgtgtttttgcaaatcttttttcttcactggtcctgcacgcttgataaaaaggatctggtgattacgagacaagacccgctagggattgattcacggatgagggaccaaagcgtgtttcaactgatattaacacgcccggggtcagttcagtaaagtaataccttttttcctggtcggagactcgcaaaacaagttatcaaaaagatgtgagaaatccaaaccaatcttctcctacggctgtagaaccacaggaataagatgcttcacggcatcgatccggaccaggatgctatgatacttggttgtgggatggaccatacccagcgtagtgaaagcggatcccagataaaaaggaatgcttggctatcctgctagcagttgagtaaga

SEQ ID NO: 24287 - DNA, 1501 bp, Oryza sativa
actgctcaactagaaggtaatgcctttttttttgtgattcgagcagttcttgtcacgagatgatgggccagagaaaagtttgataggaaaggaaggcgacagttaaataaaaaaaagaaagggaagatgatactgatataagagtactgctctttgccctaagattacgatcagtcactttttatgtttcaatcagctcctcacttcttattaaggttttcgtgaccgacaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaatagaggtcaggagctgccggcagggcgctgcttttaatctgactgatggctcaagataagttggagacgtacttgagatagataatttatgtatttcgctactccacagagggactttcctgaattagtgatacgaaaaagtaaacgaataaatgctggaaaagcaagaaaacgtatgcgcaggcgcaagggaatgaatatcaaatattatcgggacccaatcgaatatgaaagaaaaaaagggttgatcgccctccgatctttcctttgaacgagcagttagcgaagcgatgaaagtgcttcgcgcgagactgcgggtgggtgtgggaactgtggcggcgttgtgcggatgggttcttttccgcctggtggaggtttcgctaaataaagaccctctaaatccctgggcgagtaccgcttcactcgtcttatcaactaatagcgctaggttaactatttaatatctctagcgtattcgctcgtgctgatgtttaatcatgcgatgccaatgatgtaagcgcgggcccgcaggtgcagacaggttcgtcgggggttatgcaagcttcagaggtggggggtacgattgtggaagatcgcgtggaggcaggggttggagatgtgatgcacggatgcggggaattgggtggaaggacagtcgttaatgtggagtcaggtttgacgggcgtgaggcaagaagtggagggaagtgggatctagattagaagagataaatacgatattcctgatctgatacttttcttttcttgagaagtagggacccaagccaagaattacgtattacaagtggactagtattcataggggccttttctttcgagaaggctttaataagaaaagaatttggtttggtagaccaaaaaaaaaccttctatcgactagagtttgatgtcgatttatccacacttccatgacttttagaggaaagctaactgcttgctggctggaagctgtatgagcgactgagaata

SEQ ID NO: 24288 - DNA, 219 bp, Oryza sativa
ctgcagcccgcgagaaacgagggggcaaggtagtgggcgcgggaagcgaggagccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtca

SEQ ID NO: 24289 - DNA, 252 bp, Oryza sativa
tacagtgatgctacagtaattagccgctaatcatggattaatatacatcattagattcgtctcacaaaatagcctaggggttatggaatcggttttatcggtaatctacgtttaatactcctaaatagcaagattccggagggctatttaatagctcggaggatccaaacaaggccattatagtgaactactggcattggtacagaatcaagatatgagcgtgcagagacagaaagagaatatgagcatacc

SEQ ID NO: 24290 - DNA, 337 bp, Oryza sativa
gctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaag

SEQ ID NO: 24291 - DNA, 537 bp, Oryza sativa
aattatttctagggctctgaaaattccactaaaaatcctgttagtaaatttcgacatgtagaactcaagaaaaaattccacatgtcagattcgattattatttgcattgatttaaaagggtttactcttgctttgcaccggttttttttttagggtcgcttataaattaaatttttggcttgggagaagaacttcggggtgtgacagtcacatcaagagatcccacataatgctcgctggcggaagatgtggccttctccttgtcttcaaaaagtcatcgtgctcgctttagtagacccaattctcctgtcgtcggcctctgcgcttgggaaacaccccgtactttagtcggagttttgtagcgtggcgagactggcgaccggccaaacagggggttgatcgaggccgaccagggttcgcccgacctaggttcggctaaactaggagcagaaaagatcggccgcatactcatggagtccaccgcgatggtgtccagggggtctatgaagatcgcatttgcttcttccatcgcccagt

SEQ ID NO: 24292 - DNA, 169 bp, Oryza sativa
  unsure (1)..(169): unsure at all n locations
tcggggtcgtccccttcctccggccgcccgctccacgtngccaccaccgccgaaactgccgccacgcccaccttcgtcttctccgggccacgacgtccatgtggccctcgcgcccgcgcctnccgcgcccactcccctctctctctcccgcccgcgcccacgcccgaga

SEQ ID NO: 24293 - DNA, 294 bp, Oryza sativa
aatcatgctaagggctaaagtttcttaatctttctattgtcatcgtggtctatttaggagttaaccaacatggcatttatggtatacatatatatttggctaatcggtggtttagtctatcaaatggctatggaaggattatgactatatatgcatctatctaaatagcacggttacataccagaggttctgttgttagatggatttattattatttaattgatggaggctttactttaattatgaacatattttacttgtcacaataaattataaaaggttaataattatcca

SEQ ID NO: 24294 - DNA, 1501 bp, Oryza sativa
aatactgaaattccttgtcagtactagtttcttttttaagaaaatactaccaggccttaccttgtagtgtgtgattttataaccaaagaaaacataatagttttatacaaatatatacttaaaaaaggaaaaacagaaggagtactacaagcgttgtaaccaatcagcacctatcttaagggatcattcatcctatacatatgcaaaagaacctcattttgaatagcagaccaccaactatcaaagaaaggaccaatattctgaaatatctttccattttgctgtttccaaatgtgctagcaagctgtgaagaaaacttctaagaaacctttctatctgaaccaaagtcttgctaagatcacaatttgaaagaaatcaagaagagaggtattccaaaagataccaagtttctaccagcacttttcactgaaacgactgagggataagaggtgtaaaatagtttctctgtgctgagaagggcagagaaaaaaacatgttaggtcagcatctggtggagcacatttcttcctatcaagcatgtctcttgtgtttagcagatcatcaaagaggagccaaataaaaactttgattttcatcgtacacttggtcttccaacttccataaccactaaggccatgtttgtttcagtttaagattattgtaatctagattattgagccagattgctgtaagcttgattataataagccgacatagaataagttgtaacatatttagagtggattaccatattatagtaatttggcttataatttgtaataatctaccataataagttatctgtttgtttcagtttacttttaataatccatattataataattttaagctgaagcaaataggccctaagtatggccgagaagcttgtaaaactgcaaagttcagtttataaaaacacttggaggtgtaattactttgattctaaatgaaactcgaaaagtccaccttctaatctgacaaaggttaaattaaggagcttagatcctcatgaattcaatgaaggcctcctcaggcctctcgtgagtactagtattcctggtgttatctctatatttacgttagtatttcaattaatttttcatttatccatcgagttgttatttgtaatttgtagttattgaatctgcaaactctataatagttgactaagacttcttgaaagcaaatgctggaatggagtttcattgttaaaaaaaaaattacatttgaaaattgctatagaaccaacatttcggcgaaagctctactaaatcaatgaaatcatattgatataataacttataaacactaaatatcagtccactaacaagaatagatatttatcttaaaaatcaaaactatatgagtcaggttctatcttcactttctctctcccaaacttttggacacgtggcttcaccacaagatgccaagtctacgcatatatcacgcctaatccacaagcttgagcagcgtaagtatatataactattaagaggga

SEQ ID NO: 24295 - DNA, 1501 bp, Oryza sativa
tttgaaaattttaaattttaggtatgttattaatttttaatagaaaattttaaattttatttgaaagtttctttcattatgttagtaaaaattctaaaaaaataaaaatcttatcttaattatcatcattatctgaaactaaacagagttagttaagttaacttttgtgactgattttggcaagaaccttttgttgcaacttttggttctaaccattgatacaaaactagaaatgaacaattttcttttcagaaagcaaggacaccaaacagtactgcaagaaacgacacagatggtgaagaaactatttttggccccatcaaacagcaaatgtctgtgtaaatcggctaaagagtaaagacaatcagtatggggcatccattatctaaaagcctaccccatgaaggcataaacaaaagctaagctaaagccaaggcttaatctaagctagatctagcatagcacctggccattactcaagctggatatttgtcatcgcctttacatcttatccgtgaatgcatctgatccgatatatcagcccatgatgaaaagttgcaagttgcaacagtaatgaatttaccatgatcgatgcagtagcaattattaatgccgtccctggtaatattttttttaacctttgctttacagaaaaaaaaaactcctttatactcctttgtttatattcaaactattttatcatgctgaaaaaaggcagtgatgcagtattgctcgaatatactattggccccagcatgactcatacgacaagatatgtctgccgttgctgtcactcaccttatgcatggtgacattaatcaacaaaaatggattgacttttcaaactcaacgagaacctgatattactataacgttttatcccttctgaattaaccatgaccatagaaaaacaaacaatatatttttgttggtgacatttgcattatgcatgattggagcatagctgacagagccagcaggttaaactaaccgatacacttatcttaaatcatactcctacctgcaccaacaagaatcacttatcttaaccttccgaataaatataagaaaacggcatttttgggggacttatcttgcaccttcgaaaataaatcaaaaattaaatccatggggcccgttttgatcgacaacaaaattatttttctggtgcgatagagagaggtttagtagcaggtgcagtgaaccgagtggtacgtgcttcattgttaggaaatgaattctgcggacactgacatgtgtccaggttcgctgcaagcagatggccgccagcaagtgcgccaataaacggtcgcagtcatgtcggcaacatacaatgcaccagcctaatcatatcaacttgataatactgtacattgtactaagtatgttgcagcacataatgtataggacagtgtcacgctgcttagtactattccttcagctgtaattactggagactacctatatttagccctaagttacattagtaacggacattttt

SEQ ID NO: 24296 - DNA, 959 bp, Oryza sativa
  unsure (1)..(959): unsure at all n locations
cccgctggccgacgtcgcccctgccgccgagctgcctcctcctccccttctctcgccgctngaaatggtgaggccttcccaccttccccgtaggctgctgctcctcatcctcctcgcgcttccgctcgtgttctggtcgctgcaaatgattaggatttttttggaggtcgcggacaagagctgttcgtccgcgccgcgagggtcgtctcgtgttttctctcatcctcttctcttctgatcttctctgagttcgtgcattgggggtggtcttggggatctcgggttaaaccgcggttccagtgtcgccgagttcttttcttcctctgatttttttttggtgtctcgcggttaaaagtaaaaaaaaaaaagaagttcagatgggggagatttcgagtggtgaaaacgatgtcgcagcccacaccttatcgtatttcccttccaatcacggaggatgctgcgttgaattcttacttagtttggggaagacttaaagcaagctgccgacgtctgcttatctgaattttttttttaaaaaaatgaggcatgatatggggtcaaatgcagcattctgggaacagtcgagtgccttggattagttcaaaagatgtgagattggtccaaattcatgggctccaggagctcgaaatcttgaattttagccgaaagataggtatcgatctgttagggagcactatttgtgtaggcttgcagcggctggtttcttcttttggcattcttatctcttctatttcgtgctcataggctggaaggctgctttgtcccgttctctaatgtccaaatctgttcaatgcattagtgctaagggaacttgtattctactatctgtttaattatctgtagtgtgagaatagctgggagcgatctgttcatctaagatggtttttttgctctcttgaatctttgtaatcagatgttggagctctggtggtaattaacca

SEQ ID NO: 24297 - DNA, 1045 bp, Oryza sativa
gcacaaaatctcagtgcaagtttctgaacatctggaaatttgatttagagaacaccatgcaaatgtgggaaagggtacaagccaacatgtgcaaaaaatgatttagctaatgtaaattatgtcatgcggtgaatgattatctcccatttgctacaccgatctgatgattacaaggctgaatgtttttcctaggtaccatttcttcatatcacgatgcaaatggtagagttaattaagcgaggggtttttaagaataaaacacaacaaggtgtcaattggttcgaggacatatgcgctattcagtgcaaatgtgaggattggttttcttcttttcttgcaaaatagccaccacgcgccattttctccaaagagcaaaaggaattccatatataaaaggagaaaattgcaacctagaaggtattagtgactgggatcccttgctgtcatacgcttcataagctattaattatatactttcgttgtgattaaatgattaaaatcccaacctaaacacctggaagtgctaaaggcaaactatgaatttatcttgataaaagagctcatatctgtatttctctttgttctttcatataaaatgtccattgttcttttttttcaattagtaaatcatttcgtgaaaatgtcgatgtatatttgatcgttgaatattatttgccttctttcaactgagatggagtttgccttgccttgcctgcagccaaaagagcaatgagaacaaggctaatcaactgtccatgtacttaaatattaaaagctatttctttactaccttattgagaattggtttgaatttaataaattttcaggccaaagtgtctgaaagttcagtttgcacaccgtatcagaggacttatttgttgtttgatgggttattagattaggcaccgtatggtgtatactcctacttaatttggtttttgtttggtattgaattatggatgctgtcatcctcatccatggttaacacaagatgagttggcaatctgatgggaaaagtagaaagaattcctaaatgattgcatga

SEQ ID NO: 24298 - DNA, 1501 bp, Oryza sativa
ttcccttcccaggccgacccgaacccgctaaaaagcagcggaggcaaagcagaagccgaagccgaagccgcaacctgcaaaaccaagtccacctccgcctccgcctccgcctccgcctccacccaccaccaccaccgccgccgccgcgccgccggagatgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggtacgttcccctccctccccggcgacgaatccgtcgatctcgccgtcgccggcgacggcgacggcgacggcaacgggtttagctttgcctttgcgtgtgccaccatattcgctactagctttttgcgtgcacttgtcgccgtccgattggttccccgctccccgcggcgactcgcgctccgccgtccgatcgatcactcgcgtctctgatacgtgatagcttgcctttgggtggctggcaaatgtcatgaagggttgctaggactaaattattttaatcaaagaaggaaacagagagtgagagagagaaaataaattatgtatcctgattagttatccgagaacctcatctcatccatattagtatcatattctactatcataattgacccactattatattcatgcgagtcccccactggcacatactccaggggcatatgtgctgttattactgtacacaagtaagcttaattaacttcaataatggtgctcgtgacagtgcaataatgcatctctggcaagaagtagaacaaaagaaatggaaaagaatcccatcctcgcacactgtatctagtgtactactcctatataagtgcatcaggtttatagttattagttcgaccgttatatttccaattgtagagcttgagtactgcctagcaagtttagtatgacttcctccgtttttccaaatacatgtaactgttaattagtattattatagcttcaatcactaataatttttaaatattttgactataaaaagtcatattgtttatatttaggatgttgatccaaaacacaacaacgacacagatttatagtaaaaaatgtccgttactaatgtaacttagggctaaatataggtagtctccagtaattacagctgaa

SEQ ID NO: 24299 - DNA, 357 bp, Oryza sativa
cagttgtgtaccctccagtatctctgcattttctctgtatacatgtgttacccggttctgaattgatattcaaaacaataatattttaaaaaaatttccccccagaaagcgagctacttttgccatttttctgaaattaggtcggcactctgcttctttgttactcatgtctcagttttaaataattaatttctccttgcaagctactacagctttctccatgaattctgaatcaaagttagtgggcaatattcttgcgccaagtttgttggtgcagaaacatccagcgctttcaaaagcaaaaaaaaaaaaaagagccataaaagataagcaaagaaaaagaaatctaagactaga

SEQ ID NO: 24300 - DNA, 1501 bp, Oryza sativa
tgagttttggagtacatacataatagttaaacctgaacttacatttttcagatgttgaaacctgaaccaaaattgtataattgggtatatcttcagacagggaactgtaatggctgttgggttctggagtacacaggatagttaagcctgaacttacatttattcagataatgaaacctgaacctgcatgattgtaaatgtttccaaactctaaatgcttgcatgctaattaaatgcaatctagctgtagctgcctaatgcaggatacaattaggcaagctatgtggacaatgaaggttgagattaattagcaaagtaatgaagggagtggggactgaagaaaggctgaaaagtggcgagtcatgtcatgggtgatgagaaaacagcgaagcaatgcacctaactctcgaggtcggaagtggccaaagaagatcgatcaccaaacaaactagttagggggcgccaaccaaccaccgtcaaccacagacactcggacagacagctccaaaagatgcagatgccagtgctgcacatttggccacatgaaagtcgcattcaatttgcttaattaaactagtaatttgcctgtcgaatagcccatgctacaccgacgaccgtcggtcctcttctagttttcagatgagtgtgtcctcttaacaggagaagatttgcagctttttcgtgctgaaaaaacggtacggacagtccggtttgtgcgctgtttgtatccaagaacatgacgaaattagttgaaaaaaaaagtggtatctgaatgaagaataaggatgtgtttgtttctgtccataacattaacattttcttgatctgaaaaaaaaacattagtattttctttcagacatatatgtattgtaagatattcatacgggaccaaatcaagtgtacatgcgattcagatttgtagcatctgtgaaacgactgctctgcaatcatattcgtttcagtgtctccttttctaactgtatccatatatgttcatgcgtgaccaaaattaaaaataaaaaccagacatgcattatatctgtttcactgtttgcctaacagcaaaacagttaggcaaacatcacatgggtagcccactgttagccttccgctgatgggctggaaagtcgaactgaattcacggcccaccccctgaggttggacggggccggaagcccgcgtgtggagatgggccaggccggttacttcctctgttccgagatcaccgcctccaagctcctcacagtcacagccacaagggaattgaagccgccgccgcctcctcgtccttccggccgtgtgctctcacgcagggcgcggcggcggcgatcttctgtgctagcgtggcggcatcgccgttgctttggaggtatgagctcctgtcctcctgtgcctcactttccccttcatatctcttggcttcttcaattttttcccgtgcaaccattcagaatttgtttttgcctaaacattcccatctgtcatagaactgctccttttt

SEQ ID NO: 24301 - DNA, 506 bp, Oryza sativa
aaaattctacaaaaagcaaggggcagccatccctagttctgcttctggtgctgttatctggtcagacatgataccaacgggatttatcagaaataactagataagtttgtgtgacatattatttcaaaaaagaaatatttattagtcttgccccttcaatcttaaacctctttttgacaagagctccttattatgtaaaaaacataaaaatcacacggttgcaatgtatacatcaatattattaagcacatgggggagtaattattgtgaatgtttgtggtccactccttgaactctttgctgcttactcattatgattatcttaaaactctatcagatgatatatgtttctttttgtgtatgccaaccatgccagactcaccaataacatttttattctttaatatctctggctaacatacaattattttgttttaggacacagaaagtttacttattacggtgatgtttaagaaacactaaaatctttttcttttttctatttt

SEQ ID NO: 24302 - DNA, 1501 bp, Oryza sativa
tgatgcctccaggctccaaggtgcagagcatgtgggacaaggacaagagccacacggacactgtgccatgctgaatttcctgaatgtatctgaatttttctgaatctctctgaatttcttgaatgtctgaatttctgaatgttgcatttgccctggtttggctgcaagaacaagcagaggccggggcctgggcatgtgtggttgtgcgtattaacgcctggatatgctgctgtgttgttggtttcatgcattgagatttggagagggctgcagccaggacaggcctgattactcatgctgctgcttcagatcagtcttctggttgtggttggtttgctactggcagtaacattttgttgatgacctatttttgtgggtctttgagaaaacattttgttaatagcattttttaagaaaacttttaaaatttgttgtcgatttcgagaatgtagccattgttaattttgctatcatgactactagaattcatccaggaagaactgagatatttagttgacgaacaggtgggagtagcaaggtagtatctttattttgtccaatgtcattagataatgcacatggcactcgaccggaggcaatgctattttgttactattgtttctatcttgtcaataaacaatactcacatgacattcattattgttgttgacttctttagaataaatgtgtcaaccaatggccgaaagacgagagagattatcacttggatggatcatggatggactaggtgagtcgtactacccccttaccttctcttctggtctcaaagattaagaaaaggaggccatcaagcttaccaactaacgaacgaaaagtagcattaatactgccacgtggaagaatgccattccttgaaacaaggccatttttgtttgagtaaattttataaaactacatgtattttgatcaaactatcgtaaagctacatatttaaggcgttgtatcactaaactacagatttagcaccatatttatcataaaactatacattcaaggttaagtatcacaaaactacatatttaatattgaagttatcacaaaaatatagcttctagagtttaaatctctagcaccattattatactggagctataaatattattgttttatgactaaattgtttctaaacccatagttttgtgacaatttagttactaaacatgtagttttataacacttcatcttaaatgtgtaattttgtgataaatttggagtaaaaaatgtagttttgtaatgtaccgagttaaatctgtagttttgtaatagtttgaccatagtacctacagttttgtgaaatttactctttattttccagtaagaaaataaacatagagcgttggacagtaccggctaagaaatgggccgtacaaacaagggcaatgcatcattctgacttccaaagcaggcctaaccttgtatcatgggcatattgcagctttgtgttcaccaaaagcattcagtcccaaaacaatcgcacagg

SEQ ID NO: 24303 - DNA, 354 bp, Oryza sativa
  unsure (1)..(354): unsure at all n locations
aacacgtgggccccacatgtgatcagcggcacgttggttttcttctcctctctttttccctctctccctctttctcttttcaagtaagaagnctgccgcgggcgaaacggcaatgcgggcgtgcttccgttacgcgccgtcgggcctggcggggccaagcctggcgacctccgtctacgagaccaacttcgacctcgccgcgctgtcatgaacgcgcacctccctcggcctctcactttgcgctgtgctccgcctctcgtccccggccatcccggaggagaccgacggggtgaggccgaagagaaggtccggcggccgacnacgtgtcggcggcggcgaagatcgtcggcgcca

SEQ ID NO: 24304 - DNA, 196 bp, Oryza sativa
tgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttgcctcccagagatggcacgttagtcatctggtcagatatatgccagg

SEQ ID NO: 24305 - DNA, 602 bp, Oryza sativa
tattaatagaaaaagatataaaaaatttactcatgtaaatttgatgtcactagttttatcatttacccaacctctcataataggcatttctttttattaaaaaatctttttttaaataaatattgtgggtcaaagtatcatctcaagactgtgtcagagtctaaaaatacttatatttgggactgatggagtaattttttcagtgaaaaactaaggcaaatcacgcgttgctacgggagcaatgcaagtgggcgtttggtttttgtgaaattagggtggccgagtcagtaagtccccacctgctccaagcaaactaattaagctgattttagctaaactactaggaggccatccaggtcttcctagtctacaattcatgtcgctctctcaaaggccgtagagatatacatcgatacattatacatgcgtgttttcagtagtgaagcagtgctgtgcatgcatgactccgccgctaaagtcaatgggggcgattaaggtaattaactaaccgggttaattttattcgttagattattggatagtttactagtaattgtgtgtataaaaaggaggttctctccctctctctgcagaatgctgtg

SEQ ID NO: 24306 - DNA, 1501 bp, Oryza sativa
attatattgttccatcggattatattttaagactagcacaacccatttctaaatcatgagagcaagtttaatagtatagcccactgctaagtgtctaggtccaattcatttatagccaatctaataaccaatttataaaatagttgtttcctatactattagtatatggttctacctgtcatacatacattacgtctcgaagtccgtgctgcagctggctacaaatatgtagcccactaatcttctctctcatattctatcttaataaaatatgtttatatagctagctaatagtctgctattgtatttgctctgagccactccgatgaccaaatcttgacacgtgtgacgatcccgtcggccgccgacgctgttgctgcgccggcctcccgcagcggatggacgcgtgcacctctgcctatctttccgcgctcgatgcagctcggtcaacttcgcggcttgccccctgaagtttcaaaatattactcctacgagttcggggggtgaaacttgaaaagctttgcctcgtggatgccgcgtggcccacggccacaccgtcttcctcgggccccggaagtttttcaaatagagggagccgttgcgcttgcgcagcagccacacggagagagaagggaagcagagctgcgtgcgatctgagtgggtaggcggtgacgtcggcgagctcgctcgggagtcgcggcggcgatggcggcggcggcggagggcgggaggcacgatcaggggatggcgctgcgcaaggccgaggaatccggtgagcagctgttcgtctcttctccctctccccgtctctcgggtgtggcatttttctcgctcgcgcgatctgcgccttgcaatgcgctcgtgctgtgcgtgtgtgtgtgtgtgtgtgctggcgtctggatcattggatggcgtttgaggcgagacgcggcggcgcgggcggtcacctcacctggtgtactgtgctgcctgctctccggcgcgcgtgccgcgtcggcggatgcgcggtggcagcgtgcgagatttgggttgagatcattggtgtgatttgtttagtgcgctacttgttgcaattaaggctcctgcatatggtaagactcttgcatgcgccatgagtgtggttgaagcattgagcattgacctgggtggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcaga

SEQ ID NO: 24307 - DNA, 1501 bp, Oryza sativa
ctgcacgatacaatagtggcagcatatgcacgctcgcttggtgattcgtccatagttgcagacttgcagatcgaacggttaggctcctatagaatatatcctacgcaccggaaaataattatatgagaccctaggttttatatgtaagaccggggtctaataagattattttctgtatggcagcatcgttctggaaaagtgttttctctcaaaataagtttttcccgttgctatgaaaaaggaagagcaaatttatattttccctaaatcttttttgttgctgggaatatattccctaaatcttaccatctccaagtataatattgtgccccccaactatatacggagaagcactatccgtgtgtgtggtgctttaaaatcgtgggtgtataattctatttatcagattcaaatcgtgatactaataaaagaaccataaatacgaacactcatattaagtcgaaaaatataaattaaggctgtgtttactttctgaaattgtgaagaagtttgaggaaagttggtagtttggaaaaaaaagttagaagtttatgaaaacagaaatatcggacgcctaccctatcgctgcatcatacatacatatctgtttcttttcatgttttcctcctctctttaaatattttttcttctaaattacttatccgatctacgaaccgatcacaccgttgtattcgttgcaattaaatctttacaacaagatatcatatgattatattatgtcaaaagaaaaacatgtgtttcaaactgttaaaataaaatgtttcatacgtgatagtgatatgtttcaatgtgcgtctttagtgtgtttcataaaattcctaaaactacctgctactactctctctccacctcatctatacacacatgcatacatgtattttagcaagcttcaaaatgatttttctcttaaattatttatccaatccatgatccgatcacaccattgtattcgttttaatgaaatctttacaacaagatatcgcatgattatattttgttaaaagaaaaacacatgtttcaatccgttaatacttgttgtttcatacgtgacaacgacatgttacaacgtgtatcttcaccatgtttcataaaatatttaaatgtttcagttgctgatttttttgtttcaccctatataacttaatgattcacttgttggtcaactgcgacatttgaccatccgatttttttggggcatcggacgtccgatgagtagcttcctctgagtttatgtgtgtagaaaagttttggatgtaatgtgatgtgatagaaagttagaagtttagaaaaagtttgctgtgaactaaacagagcctaaataagcaagttctatcacatctaaccaaaccgaatgttttaaggccaagctgacaccgaaccgttggactgaatcattattataggccagttcatatgtacagatcatccgaactacaacaaagatatacgtaactagtacttcctcttcctctgtttcatt

SEQ ID NO: 24308 - DNA, 1091 bp, Oryza sativa
ccaaaaaccaaacccatcaaatctgaatatcttggaaagcgattagtttatacaacatgtagcacaaaagtacagtagtgtactgtgagctgttgaggatcttgctgacatccttttgcgtgcgttgggtgcttgattctgtccaaaggaacaaaatcttagcatgcccaacgatggagctaaacaattcggctcgatctcctgcctcttttatatataaaatatatatatggacttcagtaataattgacagagttggattaaggtacgtactaattaggcttttcttttctgcgaggagtactaataagcttttcttttatgatatcgtgacaatcaagtatagattcagcaattgtcacattttcgaatactagctggaataaacgtttcaaccattacatctaaaatagtacgactatacatgtgtactatagtactatggtcgaccgcaaaagcaaatagtaattgttgattcgataagattttatcatgatgaatcgatgtatatcatattcgtacaactgatcaaagggttgactaacgagtctaaaaaaatacgactatacatgtgtagtatggtactatagtcgaccgtaaagataaataataatcgttggtttgataagattttctcatgacgaattaatcaacttagaccatcctcgtacaaccgatcaagaagtcactaccgagtgactagaccgtactagagaatagaggtgccataaagcaaactatttttataattaattggatgacatgtataatagatcattcacgcggatctttccttttttaaaaaacacaaaaccaccaaatgcagatcgacatactaacaattatatactccatctccacttctgaaaccagaatttgggggagttgccatggactgacaaggcaaagcatgaactgttcattcctatgtatgttaggttgtttgaccacacatgaccccactcagtacaagtgtcatagtagtagcatataccaataataaggccaaggggaccccctcaatgtttatggccatattgtgagatatgtgcaacctaggagtagtcctccatgcccttgtgccccaaagg

SEQ ID NO: 24309 - DNA, 1501 bp, Oryza sativa
tcattagcaaatgttttactgaagcaccacattgttaaattatggcgtaattatgctcaaaagattcgtctcgtaatttacatgtaaactgtgcaattgatttttttatccacatttaatgatccatatattgtccaagcatttgatgtgacagaatttttggaagtgtgaatggaactaaacacagcctatggctataaattattcagaaatcccatactagcaaccaaacatcgattcttcaaaaacttaaaaaacatcaagaaacgttaacaatataaacgaataccgcttcaaatcagcaaaccaaacactaaaaataatgttcagctacttcttgcaccgcaaaactaaacaaaacgaaatgtatggagatgaattatctttcgcacatttttcacaaactgtaacacattacacacctgcgtgtttgcattacatttcactctctctttttttttgttcagtgcataaaataaagagtgccagaaaatagattacgctctcttgaaataagtattgtgatgaatgaaaaatcaacaatcgttcaaacacagaaaatagagaatatcaaaagatgaaattacactaggtaacatgttctaaatccatgtcatattacaaacctcaacagtagacagggctgatatatagtttcgggacaaatgcacggctaaaataacacaaaacttgtaacatgacactagcaataatgaactaatcatttggtagaaccacaggcacatttttgacatctaaaggccactcaacagcagcatggcaccggctgcaaggctccaagacgttgaactcaactttggaaggaactttcaacctgatgaacgttttgacagcctccagtgctctatgagcttccacgggtacctctctgcgcaacaagaggcatttacccagcttgtccactgaacatctactaggaaaacctgacgttgtgtccagcgtaagacactcgagcgatgtcgccgattcaacaatgtgacatgttagctcaaccaaactctttgcagacgagaaattgagtatcttcacacacttgagtttgtcatgacggtgctctggcatcaatctgaagggtcctcaaaaactgaggcacgttcctttcgttctcggagtgcctaaaggtgaacaaaaaaccaaattaattagcagcaattccaccacgtttacttaactttactttataccgttcgttagagtagttcccaactcctcgtccgcgcgcacgcttttcaaactgctaaacggtgcgtttttttaaaaaaatttatatacgaaagttgttttaaaaaaatcatataatctattttttttaaaaaaatagctaaaacttaattaatcacgtgctgtttcgttttgcgtgcggagagtgagggttcgtaaccctcactcccgaacagagcattacaacttacattcaagatgaaagtcagaatgctagattttgggaggttttaccattgccaaattttaataactttgg

SEQ ID NO: 24310 - DNA, 604 bp, Oryza sativa
aaactttgctgccaaacgggctcagaagagcaaattggtgtttgttgtgcgatgatgctgaattgttcaatcaatgcggcaatctttaacattgcttcaagctgctgtgtgctgcgatgttaggccaagctgcctctgtaggttgcagccttgcagcatctggttagctcagtctttgaaggccgagtttagttctaaactttttcttcaaacttccaacttttccatcacatcaaaactttcctacacacacaaactttcaacttttccgtcacatcgttccaattttaaccaaatttctaattttggcgtgaactaaacacacccgaaatgtagtgtgacaacttgacaagtcaccatgagagtaggataccctgaattaattgacttgaatttgtttttcctaaatatcatgttaccaaaatctgaaatcgtttttaacttcaccgatattcagcaaaatggcatctattcttataggtgagagttttattagtgttattttttttactgttgctttgcagtgctgatcctgcatttttagatgcttactggtattaatgtctgaaccttgaggttactccctgttctgtttgttggcagc

SEQ ID NO: 24311 - DNA, 1501 bp, Oryza sativa
tgatatggcgactgaaatgaaaattatgtgactgcaaattgcagaggcgttgatctccttcccctgaattttgccgcgcgtccatctatgtatgttgtccacgacgttttattttatcccatccacaaaaacgcaacgcaaaaccatttgtgatcgctgttacatacttgcagtatgcgtatcatccatggatcagtcgccaaatgcctttgcgcactgatgcgtggtcctcgaattgctacagccataaaacgagaattttggcccaagttgagcaggaaaggccaaatattagtctacgtctgtcacattctatcaacttttttcttttctttttctcaaagtcagcaaagaattaaacttggccatggaaatacacgatccgataagtaaatgattagaccgttcattttggcatccacacatatttccgcataaaatgtgtgatgcaggatccacttcgaaattaagaccatatatgaagtgcagtcagtgttacataccgtaccgacattaccaaatgatattcagtcattcaccaaccgatcgatcgattgtgagcaccgaactcccttaattaggaaccaagcaatgtcttttttttcttcttcttggcaccaaggaaatgatggaatattatatggtgcaaagaattataccatcgatgctgggagaaaaaggaacaaaaactaaacaaaataatgaaatgaaatatgtatgcccagcccaggagacaggtgtgcactggagtcattttcatgctcgcaattacacatgtctcacaaagtagagatttttttttggtgactatatggccttatcaacgagatgaacactaattagcagaagaaatttgtttaaattcaacgttatttaaatccgaagaaatcattcttctcagattttattaactaacaacaaaatctatatctccacgataaagataaattaaagcagggagaggcccggagagagagggggaacacgggcactccgtcgcgacggatctaggtttccgttaagcctctcccctcctctctctctctctctctctgtgtcaatgacaggtgggccccgttcgtccatcccgaggcagcggggggcggagggagataagcacggacggcgagatcgcaaccccccggcggcgcccctaaacctacagcgccacagtgtactgagtcaccgccatgtgggtcccactccctcctcgggcccacccgcagccagtgatggaccagctgttccccgcgtgcgcgcagcaatattattatcattatatattatttttgtgacaaaagcaaaaaacgaaataggttaattagcaaccagtcgcctctccccgccgcacgcacgcacacctctcccctcctctcctcctcccgccgccgccgccgccgccgccgcaaaaacccgaggccgagaggaggagacgggcgcgggggctgatctcgtcggcgaggcgagcgggcgatccggtgcggtgcgggccgggtggaca

SEQ ID NO: 24312 - DNA, 1501 bp, Oryza sativa
agaacacatatataaaagttttatttacaaattgattttcgtttgcaaatatgccatgccaaacgatgaggctgtcaatcttttaagacgaacatgattttctggcaggttcttatccaaaaaattcaggacgcaatctaaaagaaaataacattgtatacttaactggtttagagttgacacttacacactactgctaaaaatgcaaatactcccttctcagtatcatcattgcaagctagtttgaggagattaggccctgattgaagttactaacatgtctatcactctttcaagcacacaagttagctacatgcatttgtactttcaaggaaggagccaaccaatttaaattaccaatccaattgctctacagttggatttcaagcatggtttggattgtagtaacagatagagcatgcattaagtgggggtaccttgttgttctttagggcagcagatgcatcagagttgatgaggcgccggaggaggggtccgtgctgaaaccctaccggtgaagccgtcgcacccagacccggagacggcgaggccgccaccgccgccgagaacgcgcggcgcagcgctacccgtgccgccatcgccgtccaactccaacacccgctgcttctattcttcttcctcctttttttttcctttgggaattgggacgcttccttccttcgtaaggctctccgcgtacgggccgccataccaggttcgggccttcccctcgagttcaagcccagcccgaaagtcgaggaacaaaaaggatggcagaattcaatccaaactctgaaggaataagtctatttttcctccctccctctgttgccctcggtcaaactgtatccctccttcaacttcaatttgaaccctaataaattttagtaggataacaaacaacatgatcttaccaataacaacctatcaacatttgatagtttcagaactttcctcataaaaacactaccattttttttagattacacggcagacgcacacgcgcacacacaccactacacatgcaacaccactcaacacctccacgaatgcgtcacctaacacattctctaagagatggaaaccagcggcacatccctgatctcactaaatacatccaaagttattaaaatttggcaatggtaaaacctcccaaaatctagcattctgactttcatcttgaatgtaagttgtaatgctctgttcgggagtgagggttacgaaccctcactctccgcacgcaaaacgaaacagcacgtgattaattaagttttagctatttttttaaaaaaaatagattatatgatttttttaaaacaactttcgtatataaatttttttaaaaaaacgcaccgtttagcagtttgaaaagcgtgcgcgcggacgaggagttgggaactactctaacgaacggtataaagtaaagttaagtaaacgtggtggaattgctgctaattaatttggttttttgttcacctttaggcactccgagaacgaaagg

SEQ ID NO: 24313 - DNA, 176 bp, Oryza sativa
agaagcagtaccttggacaccctttaccaggcattaatcaagaacagtcattagctatcctctttatgtctcggtaactcactcagcagctatcctagtcattccagtcattcctagtctctgtcagagcttgcctggtgtcagccagagatatctgtggtactgaacatgtgcaa

SEQ ID NO: 24314 - DNA, 290 bp, Oryza sativa
tgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaggaggaagaagatgggggtgatgtcgcggcgggtgctgcctgcctgcagcagcctctgctacttctgcccctcgctgcgggc

SEQ ID NO: 24315 - DNA, 231 bp, Oryza sativa
atattgatggggcgcctctgaacgaacgatcggcagcaagggtcgtgccgtacgacgagcgtggcggcaggtcggaaagatctgcgttgtcgagctgctcagggcacgccgcgtcagggaggaggaggggcgcgctcgccactgtcgcttcatccagggatgcggtacgtcaatttctttcaccgagcggatcgcagcagtcgtctctatctgcatggtacgcacgcatca

SEQ ID NO: 24316 - DNA, 552 bp, Oryza sativa
gctacgagccgatccgagccacgaatttcgagctttttgtccacccttaggcggctcctcacggggtcggcgcaggtgacggcggcaggaggcggcgacgccctaggcggtttctgaggcaggaggcggtgtttcttgcggggccggtggcgcagagcggcggcatgaggagcaggaggtggcggcgcatcgggagaaggggagcgagagagggccgaaggaaggagagaaatcgatctgattcctttgaccgctcggtttgactggttttttcaaccaaaaataaaaccgaaccggtttttttggagaaaaaaggggttggttttgtccggctggtgactgtgcaagtttagtcagtgggtcaattaaatcagggtagatcaatttaatcagggcgacagctgatcaagttgattatcgttgatggcggcgacggtggtttccaaatttgaggtggtgaagttcgatggcactaggaatttcgttctctcgcagatgaggctgaaggatctgttggctcagcaggggatatccaaggctcttgaggagcga

SEQ ID NO: 24317 - DNA, 1501 bp, Oryza sativa
acgggggaattagtgatatttactcccagttggtatcatcaaccgggataaagatctatctttactcctagttggattaaagctcattaggggcctagcaagtattgaaccggttactcctggttggtatgatcaaccgtctatctttactcccggttggtaacatcaactagaattaaagctcattaggggctcattagggcaagttttatagtggaggtggatgccacatctaatttagatcatgtcatcttctcattaattaagaggcaacacatacaatatatcacatctaatacacaaaccccaatattagtccactctcacatcatcttgcacttttcttggagattgtgtagaggttgccccttgcatgaggggtggctcattctctctctcctaacttctctcctccacctcatcatctaatcttatgtggcaaatttagagacaatgtgtagaggctcatagtacttgcccttaggggcctagcaattattgaaccatctttacccataggctttaaaaccgggagtaaagatatttttactcccggttcctactcgaaccgggacattgtgatttttgcctgacccagcaaagaaaccgggagtgaagatatttttactcccggttcctactcgaaccgggactattgtgatttttgcctgacccagcaaagaaaccgggagtgaagatatttttactcccggttcgactattcgaaccgggactattgtgatttttgcctgacccagcaaagatcacttctctagtagtgcctgctcctatgaggatcttcgaagattaggctggtaaatccttgagattgacgaagtcaccacaggcgcttgcctgaaccagcaaagatcacttctctagtagtgcatgcttctatgagcatcttcaaagattgggctggcaaatccttaagattgacaaagtcaccacagacatctcgctactgacagcactgtgccgttaaatcctggaaagttcactctcatggggagtcgaactcaggacctaaagtactattaaggttcttataactagtagactatatgtttttggcgtgtatatatatatatatatatatatatatatatatatatatatatatatatatatatatatatatatatatatatatatataatatgtgcgttcacaactcacaactttttttgaaaaataataaaagttttttgaacgaaatatttagaaaaatacgtgctgagaacgcacgtgcgctaattaaaatagcaatcaccccaaagtcaagtacgatttgctagttaacaagaggaatgcatatggagaatacagatggaagccgatagtaaactgttagtccaagccagtgatctctagaaggatggctctagatgaacaaagttttgtgttgcgggctgcatgctagctaattattaagctagtctgttcggttctcccatgacaatttcctcgacccccctcgttctgtatatatggcacgcat

SEQ ID NO: 24318 - DNA, 1501 bp, Oryza sativa
ataaacatctaaaatcatctacaaatttacatctcaaaatcatcaacaaattcacaaaaacatctaaaaatcattcacaaatttacatcacaaaatcatccccaaaattatcaaaaaaaatcatcaatcccctcccatccaggcacgcccaccaccggctgcctccctaaggcgggcccgccgctcgccgcctccctccggcgcgcccgccacctactgctgccccccacgcgcccccgggcgtctaccattgactgcgccgacgaagagaagatagtaagaaagaagataaggaaagaagaaagagaggagtggataagagaggaggaggcggagtggaggagtagaaagaagttaaagaggaggctgagtgcgcacgatacgaggagataaggcgagagagagagcgagagagggggatgacgggggaattagtgatatttactcccagttggtatcatcaaccgggataaagatctatctttactcctagttggattaaagctcattaggggcctagcaagtattgaaccggttactcctggttggtatgatcaaccgtctatctttactcccggttggtaacatcaactagaattaaagctcattaggggctcattagggcaagttttatagtggaggtggatgccacatctaatttagatcatgtcatcttctcattaattaagaggcaacacatacaatatatcacatctaatacacaaaccccaatattagtccactctcacatcatcttgcacttttcttggagattgtgtagaggttgccccttgcatgaggggtggctcattctctctctcctaacttctctcctccacctcatcatctaatcttatgtggcaaatttagagacaatgtgtagaggctcatagtacttgcccttaggggcctagcaattattgaaccatctttacccataggctttaaaaccgggagtaaagatatttttactcccggttcctactcgaaccgggacattgtgatttttgcctgacccagcaaagaaaccgggagtgaagatatttttactcccggttcctactcgaaccgggactattgtgatttttgcctgacccagcaaagaaaccgggagtgaagatatttttactcccggttcgactattcgaaccgggactattgtgatttttgcctgacccagcaaagatcacttctctagtagtgcctgctcctatgaggatcttcgaagattaggctggtaaatccttgagattgacgaagtcaccacaggcgcttgcctgaaccagcaaagatcacttctctagtagtgcatgcttctatgagcatcttcaaagattgggctggcaaatccttaagattgacaaagtcaccacagacatctcgctactgacagcactgtgccgttaaatcctggaaagttcactctcatggggagtcgaactcaggacctaaagtactattaaggttcttataactagtagactatatgtttttggcgtgt

SEQ ID NO: 24319 - DNA, 382 bp, Oryza sativa
tgttggcatgcatgatgccatcatttccatagtttgttcaaccgtggatttagataacttgcattactagcacacaaacccaatggggccggaataggcagcgttagtcaagactatcactgctggttgctcaatcgaccgtgatgtccctcatagagaacaaaaaccaaaaagtaaaaggaaaaaaaaaaaggcttggcgacgatcgttgagcctttgccactgtcattgttgttgcaaagccacaactgcggtcatggttgtcgaagcgcggtcattatcgtcattgtgctacccaccaccgagacaataaacccttacgatagggagtccgggcatgctatatctaatattggggtggcaatggcacgtgttccctagt

SEQ ID NO: 24320 - DNA, 607 bp, Oryza sativa
cataattaaatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttggacggagtcaaacggatttacggttgggaagatattgaatttctaagattattggatttttggtctaaaggaaaaaggatttaattaaatcctttttggaaaagaaaagaaaagaaaagaaaagagggagggaatatagacttctcctcggtggctagggcgcggcccgagagaattggggcggtctggccgagctaaatgggccggccggcccaaggcgcgcgcgcgggagggaggagagagagccggtggaccgggctcacggcgcgcggtcccgggtgggacccgcttgtcggtgactcggttcaccgtgcggagcgagcacgcggcgcacgcgcgcgggcagggctgggacgcggtgcacgcgcgtggttcgcggaggaacgga

SEQ ID NO: 24321 - DNA, 1043 bp, Oryza sativa
gcaccaccagtacgccaacaacgacccggacagctgcgccatcatgtagctgcaccagctagtgtacgatcgatgctgcttctgctcgcgcgcgagcatgccggccgtcgtcgtctcgatcgtcacgatgatcggatgatcggaggacatattgcgaccgaatctagtagctgattgtcccaatcgataactggcccaaagtacgtagatataccttgaattttctgtgtgatgatgaggccgatttgattccgtgtgattactgaacaacagacaggtacgtacctgttgtctgaaactctgaagtctgaacgttatatgtgcagtagtatatgtgtagtagctgctcccggcctccaagtgtatacggtgtgcaagtgtaaattaggtgtactagggagatatatataaggtgcaagcgactttatagttcatcaaagtgtgctcatttgtacatgcaaattaaatctgtacatgcgactttatagttcatcaaagtgagtaattctgtagtacggagagcttgctgttcttccctctttggccagagagcttgctgtattctgtaccgtacattttcttttttcctactccctccgtcccctaaaataagagatttttacatttgcttgcactgttggaccattcgtcttattaaaaaaaatttaaaattatctattatattattaaaggaatagaaaaaaaaacctctacgttcgctctcatggcctagaaattctcacattaatcggagaaaaagaaaaaatagagttcatatagaaatacaatttagaaataactgaaattcggaattaaaaaaataagaaatactaaaagaggagactagagttcatatagaaatacaatttaaaatagttgaaattcagaattaaaaaataaggaatattagaagaggagactagagtctatatagaaatatgattagaaaataactgaaattcggaattaaaaataaggaatattagaagaggagactagagtccatatagaaatacatttagaaaataactgaaattcgaaat

SEQ ID NO: 24322 - DNA, 1501 bp, Oryza sativa
cctcactcgtgtgcacccgggaagaatttcccggtcggtcacccatcccaaattgctccaggccaagcacgcttaaccctggagttctttggagattggcttccggaaaaaaagttgcaatttgttgatatgagtattctattaatcctattaagccctagagcgggatgttacaccctcacccccttaagagagatcgacgcccccgtcgatcaaccctaggccaggaacgatcgacgcccccgtcgatcaaccctaggccttggccacgtccatgtgtccagtgccagcgcatgtgccatactgtgtaaccactcccggtctacaccagccatgcgcaccatgcctgcgcaactgcgacaaacgcgcccgtgaaaccgcgagagtcggctctgataccattttgtaacgtcccgccttccctcaggccgggcccgcggtcggtcacccatcccaaattgctccaagccgagcacgcttaaccctggagttctttggagattggcttccggaaaagaagttgcaatttgttgatatgagtattctattaatcctattaagccctaggccgggatgttacaccctcacccccttaagagagatcgatgcccccgtcgatcaactctaggccaggaacgatcgacgcccccgtcgatcaaccctaggccaggaacgtcctctcttggccacgtccatgtgtccagtgccagcgcatgtgccatactatgtaaccactcccggtctacaccagccatgcgcaccatgcctgcgcaattgcgacaaacgcgcccgtgaaactgcgagagtcggctctgataccattttgtaacgtcccgccttccctcaggccgggcccgcttacatctgatagctttcataggtcatttttgtaacgtcccgccttccctcaggccgggcccgcttacatctgatagctttcataggtcatagactgccctcacagaccaacacatatcttttccgccttccctcaggccgggcccgcttacatctgatagctttcataggtcatagactgccctcacagaccaacacatatcttttctgcatactttgtcctcactcgtgtgcacccgggaagaatttcccggtcggtcacccatcccaaattgctccaggccaagcacgcttaatcctggagttctttggagattggcttccggaaaagaagttgcaacttgttgatatgagtattctattaatcctattaagccctaggccgggatgttacagattatggtgaataagagcaataccggcttcagccaacaggatgtagggttattacctgacaattcaggggcccgaacctgtataaaaatcctcgtctccatctcttttacctcagtctcgcatatatcctagtaccgacgatccccataccatgtaaataccggaatcgcgacatcaaacgtcgacagtggcgcgctaggtaggggattttggtgcttcaggatttcgacgatatggttttaagaga

SEQ ID NO: 24323 - DNA, 500 bp, Oryza sativa
aacagctaatctaaattgaggatattcttatgactcaaaaaatgtgaatgaaggattctaattgctgacaatcatttcactcaagaacatatagtagttaggcattataatattctaagcacatgcttgtgcatacaccaatcatgcctgggttggggccctgtacacaccatcagcatcatgattctgcaaaatgggcacatctgtcttacaccatcctacatattaagatccagaacttggttgcagtgagcaatggtggcaaagacagaatcattgaaacctaagaaacaccttccagtagccaactccagcatactgaacactatgcccacaaacctccaatgatgcatccattcagttcaatcctagttacatcacagcatctgccattagccatgaaaatcccacagcccaagttccaagtggttagggacattacagagaaagttaagcacctccatgtgtttatctccatgaggcttcgttccctctccaaa

SEQ ID NO: 24324 - DNA, 755 bp, Oryza sativa
taaggagttagtgaggataactttatagtagtaagataggatttcttgtcagggctcctttgaacctgctcatgatgttgttgttttccctaaaaaagaacccagctgtaatgcacgcaatattactggataatttgtaataatcagccgtgatcagagctagcatatattgttttcttgttccagataaggtatcctcttgatttgttttttctgagcttcctgaactaaaggcaagaggctaacagtgtatattaccataagtctagaagagctctgtgctcatatagtcatatatacatttatttgttctatgccatgactgcaacatctgctgcataaacttgcaatactaacaagatagaacttttgcatttcgctcttaattgaaacagtgtaaaacccaggccaccccaaaccccttcctctctcgttttcgctcgcctcacacccgtcgcgccattgttgacgccttgccgccgctcccacctcttgtcttcgtctcttcgcccgtcgcacgcgtcggaggccggtgcatgcgtgaatgcgagacgaggactccgggcgccctcgatctccttcctcttccccggcctgaggccgacgccccgtgccgtcggccatcttccggcgcctcttcccgacacggtagtccctccgttcccatcccttgacctctcctagctcgctagatagctcggcattgtcgccccgatcgcgtaggagctaattcctagcggcgccaccgatcggca

SEQ ID NO: 24325 - DNA, 291 bp, Oryza sativa
tcttatcactaagtttttaaaagtataatttatatcttttacatatttctatataatattttaaataagtcgaatggtcaaatgtgtataaaaaaatcaataggaacatctattaaaaagcatagggagtaattagtttaagtaaaagcctaaggcaagaatgaataggatccaatcatacagaccaagtcgatctgttaactctcggccgtaggtcttaaaattttttaaaaagataaaatcctcaaaaacataggaaatttgtaggctaggttaaccacaaagctctga

SEQ ID NO: 24326 - DNA, 332 bp, Oryza sativa
tcatcgccatggatgagctcaaactttggatacggctggggcggtagaggctgtgagagggtgggcaagatcaatttgagtggcgggaggccacgttcgaatacttaccggcgaaggattggcttgaccgcggttgaaattggctggcgacgtgttggcgccaatccaggcgcgacgcgcggcggcggcgagggtgaaaatggctggctcaggggtgaatggtttgaattgtgagaggggaaaccaccgtctatcttcaattcaaccgtgcggcaaaaattggcgcgattcaccccggatagaaacaaaatcgcactcggcggcggcttgga

SEQ ID NO: 24327 - DNA, 1501 bp, Oryza sativa
tggggtgagagccaccgcgcgccgcctccctctcgatctctctctccgatctcgatctctatctctccctctcggttgccgccggccgccgagtttcagacgccgacgccgacctcgtcacgacacgacgccgcgccacgagacaccgcgacgccgcacgccgccgccgcgccacgccgatgccgcgcgcggcgccacgccgccgccgctccgctgccaccacaccgccgtcccgctgccgccacaccgagaacgtgaacgagcgaatgagcgaacgaacatgaacgagaacaaggtgaatgaacgtgaacgagaacgagcgaacgaacgtgaacgagccaacgaacatgaatgagaacgagcgaacgaacgtgaatgagaacaaggtgaatgaacgtgaacgagaacgagcgaacgaacgtgaacgagccaacgaacgtgaatgagaacgagagaacgaacgtgaacaagaacaaggtgaatgaacgtgaacaagaacaaggtgaatgaacgtgaacaagaacgttgtcggacgaacgtgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttataattagacttaattaacatataagattgtgtagtgttctaatatacgacagttacacttagaatacatgactaattgagttttagtataagattattggagttttaatataagattattatatttgtaattagacttagtatataattattgactagctagggtcctataatatacgtcacctagacttagcatatatatcactatttgagttttagtatatgattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacctagatttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatgtttcctgtatgaaaga

SEQ ID NO: 24328 - DNA, 302 bp, Oryza sativa
ttcctgcagcccaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaggaattattaattcccttgaaaaagataatggaggagggaccggaatcagacttttaggccaagcgtgaggcgcagcccaaggaatttgcgtgcgcggtcgaggcgagtggg

SEQ ID NO: 24329 - DNA, 275 bp, Oryza sativa
tgagtaggctaaccctaaaaaaattccccaaattgaacaatagcaaaaatcagccgtacaacctgaccatgtgagtggttccttggatcggtataatcctctgcctgacaggcgacatttggatcagtcaacaaagtgcatcattgcactgggaaaacgctgcattattggacgcaactagtggagaggaaccaatcagctgctcgaattctcgtcctataattcatttttaagataatggattaagaaactcggcctctacattcatgagagaa

SEQ ID NO: 24330 - DNA, 177 bp, Oryza sativa
agaggagtgaacctatgattcctgcaccctgccccttagctcttcttgttgctgcggctcatcccgatcgagaggtaacccacttgcctacacccccataaaaacgttcgttagccggttggtcaaatggaaacttttgcacgactgtcatatgaagcttagaggtaggagaagaca

SEQ ID NO: 24331 - DNA, 236 bp, Oryza sativa
ctgcagccccagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagg

SEQ ID NO: 24332 - DNA, 238 bp, Oryza sativa
gagagagaaaggccggggagagagataagatggagagagagctacacactgatatgtgggtcccaccacgctgagtcagcctgtcaaccgggtcaacaacgccacgtggacgaaaccgccagcaaaaccacctagggaggtgatttgctctggttttcagagaagaaggaggcattatacccggttttccgattaagggaagttattcacgcaagcgcaagagatgagggaggcaaaa

SEQ ID NO: 24333 - DNA, 298 bp, Oryza sativa
tactacctaagagatcagtatcatactgcgaatacagcggtgcatgcatcgtcacacatcatcttcaacctggcttgccgcagccgcgtcatcccgccatgccgctgccgtgtcgtccatcatgcgcttggcttgccgccgccgcgttgtccctccatgcccccggcgtgtaatagaatatcttacagtatgaagtgcctcagtccgaatactgcatcgccgcctcgacggccttgctccccttgcggcctctgcaacggcgggcgagagtggtggtgaaacaccggcggcgacgcgt

SEQ ID NO: 24334 - DNA, 1501 bp, Oryza sativa
tcagtgaacaaacgcaatcaaagaatcaacgatttcatcttggtctagcgaaaagccaacacgctttctacggtgtagagatcagcgtgcaacaaaagcaagcttttcggaaaggcaagtcctaaacaaagaattaccctgcagtctagtgaagtctgggttgtttaattggctctcaaactactcagaaccttcttgttagatgaagtcttatccttaattggtacacaaagtacatcccttcggcctaaggcaagtgatcgcatagtacatatacttcctccctttgatatattataatacgtttttaccttcctttttcgtctagatttactaatatctatataaatttgaacacgtatataaaacacatacatataaccatatatgaaatctatttaaaacccaaaatgtcttataatataaatcagagaaagtagtatttaagtaggatcagcagggcctgctgctaaattcatcagccaatgcaacaatctgtcggcttcatatcacagttacagcggtaagaaaaagacgaagacgtaaacatttccattatgcaagaattataggatttcaaattatcactttgccacagtttagttcgtaaacgtcagattaatggacagataatgcaccgcggcattctacaaaaccaccaatgcgtttgtctatttgtagctaccatttgggctggaagccagtagaggcgaggtggtccactggtctgctcctccttattgggccgggcccaaaccgaccactcgggctggacaaggcaaggtggcccactggtcttctcctgcctattgggccgtgcgttctaggccaatattagcctccgtgggagtggaaagaagggtgggaaatttcgctatggcagagtagccgccgccatcgcctccttcccgcgctaagctaccaccgccgccgccgcctcctctccgcgccgaactgccgccatcaccagccgagcagccgccgccgtcgcctcctccccgcatcgggtcgtcgccacggtcgtttgctccgcccgctagcgaagctgccgccaccgcctcgctagggagggaggtggctgttttgccaccactcacgaaaaacggagcggttcattagcgcgtaattaattaagtatttgttttttttaaaaaaaaataatcaatatgatttttttaaataactttcgtatagaaattttttacaaaaaatatacaccgtttagtagtttgaaaagtatgtgcgcggaaaacgagggaacatagagtcaccgccgctgcttggagctcccttcctttggcttattcacagtatggggctgtggtccgactgggaatggggtaatggtgtcggagcctggctcccttcctttcttctctgcctagggtacaaaaggtcaacagaaaaatacaaaatcagtattccttctttttcttgttttatagctctataattcaaggtccactaaattccgtcaaaaacaagagtagatgtctccttc

SEQ ID NO: 24335 - DNA, 1501 bp, Oryza sativa
ttaatttgtatacggcctgtatattttactattaaagcaaaccaaacaagattacgaagcacatgctgccagcaagaccatattatagggtaatgtttttactgccaacgtactgttgtacgtgttcggtggggatattcctagcagtagtatctatatcattattggttgagcataatcgtgtgataggagtatgacatatgccaattaattgacaacaactgatcttttattgtgcttttcacataggcaggtcggctgcaacagctacagctgtggctgcgcatagtgagtgcggcactgtttatgtcggctgtggcgcagctgcgaaggcagtagctgaaggcccataaagcttcaagtgcaatatcgatgacatattttatatgatataaagtgttttctacatagttgtgtaatactataacatatgtcaattgatatggaaaaatatgtagtgcaaataatgtatatagtataactctagaaactaccattgtataaaaaaaatgaacgcctgagatttgttcacgtcaacagttttactaataatgacgtgaaaaaatctcagacgtttatagtcatctttatgatagcttctagatttactctatatatgcgatttgcgctatatatttttctccgatgcactcttttattaggggtacttgtgttcctagctgctgttggtttagggcagtcctggcagtagtatctatcgttgccaaatcagatggaaaatttagtagtagaaagtttagctctaatggaaaattgtttatcctctagttcttataccgatatcatccaaatcattattaaaaaattgaaaaaaatatatgagttagattaatataacataaaccactctacaaaatatgctattattttaaagacatgcacaagttataaaacaacaacaatatataattgtgaatacatgtatactagtttcactcttaatttcagatcaatttgttctttttgttacagattgtagaacttgaatttaaccttgtctccgtgcgttgggttctatatcttatattaatctatcttattgatttttaaaaaatttaaataactatttagataacatgtaaaatacgagggtgtcccttgagaggatgaaaatccagtatctgtatatctctggtaggaataataataacggtatcggtaaatctgcaaagcttgtggcttgtgctagctcgccgttaaactgagctgctgctgcagctagccatgcacgctactggaagcgggctcagatctggatcgatatatcgacgtcaaccaaagaaccaagtcaagtcgtcgcgtctacctatacagcgtcgtcccagctcgatgattagctagcgcgcaccctccgatcggacactcaccccccatgacccatctgattagctagctagtttcagatgattatacgttttccgtcagatcgagttagttagttaggtcgcatatatactcgtatatttgtttagttgggcga

SEQ ID NO: 24336 - DNA, 1323 bp, Oryza sativa
tattagacgacattattcgataattaaagtttcaggtatttcaaatctgatacccgcatccacgtgacatataccagacattttcgtttttgataccacggttttcttatagaaaaaatgaaattaagcagtagagtatcaactaagatcctattcgagattctaaagaaacagattgtgagtagccaactagtcgtaatctaaaaatatagatttgttactccctccatttcataatgtaagtcattttaccatttcccacattcatatcgatgcctatctagattcattaacatcaatatgaatgtgggaaatgctaaagtaatttacattataaaacggagaaagtacattctaaccttttaatttattttctggattatatacaattacatagttttggaatctagctagatgatttaggaaaaaggctatagagctgctagaagttcctgtttaaacaggacataggagtgttggactaaacggcacttcagcagtcctggcagtcgtactccatacgttttaaaataaattaacatctttgtacgagatatgtcacgtttcggtttatttttttaaaaaaatagtatgctcgtagcagtagcacaactgaactctgctgtcagctcaggcgtgtgctagctagcaagctcgagcttgccgttaaactgaatggccgctgcacagccacgactggggcaattaattaatagaatttcgctcgcgcagctcatcagatctggatcctcgacgacgacgtcaaccaacaagattacaagaaccaagtcaagtcgtcgtacgtccacctgtacacaatcacacacacagtctctcagtgcctgattaattagcaactccaatcgggaataacccgtcggccaagagatggatgattagtttcagacattaatttgatcctgacacagccaacgcgttccgtcagaggagttagtgcgcgtttgtttaattgggagattagctgcgtggaatgttcttaattacgtcgtcgccaaacctctctgctagctagtacggtggcgagcagtgttagctgccgcgcggcacggcttgccagcgcgtgttcccgcgctatataaggagctccccggcgtcgctttctcctccacagctttagctacgatcgcgacgcacgcagctagcttcagctgatcgcgaacgagctcacattggtcgatcggcgtttgcatctgcattgtgcattgcaaaacgatcgaattagaaagacgtgcaatcgtattgcgcgttcgcgaaaaaggatcgaattcgacggagcctctttaattcacgcagaacgcgatg

SEQ ID NO: 24337 - DNA, 1235 bp, Oryza sativa
tagaatttatatatagcatgtattcgcaatgtgctaagtttatgcatctctgctccttgattaattagtcaacgtacgagccagggagcataattaacctagctatagctagctagatggcgagccagggagtatggtgcagaagccagaagtcaatcgcgagcatgcagcggacgagctaatcaagtcatgcccagttccctcgacgtcgtatttctccataaaaaaaaacttaaggatgtgatacgttaatgaatttgaataggggttatccagattcattatagtaaaatatgtcctacttccttcgtttcacaatgcaagtcattctaacatttcccacatttatattgatgctaatgaatccatacatatatatctatttagattcattagcatcaatatgaatgtgaaaaatgctagaatgacttacattgtgaaacggagggagtatctttaactaggttgagtttttttggatggatagagtagacgcctactccggtgttagtacggtggagtaggggacaggttttacttatcgcacgataatcgcgcgattatcgtggttatcgcgcttatcgtggggtacggtaggggaaaccggcgatatagtttggatgaattttgaccgaattcaaaattccggaaaaaaattgaaaaaaactgaaaaaattcatggatgtagttcttgatttgtaattgccaattgtgaagaatttttttgaaatagagtaagctaaattcaaatttgagggtaaaaccaaaaatggtttacaaattgaaaaaggaagagaatattaggccttaagtatcctacatattcttccaattattctcaatttctagttttctacacatattcaaccgtatttttgatttttttaccctatttattttacatttacatctttcagctatacagcccgcgataaccgtgcgaatatcatggttatcgcggtaaaccgtgcgattatcgcggtgaaaccacgaaaccgctgagttttgaattcgaatttttggatgtgatttttgtgcgattttagacgattatcacgcgattatcacggttatcgcgctaccgcggggtggtgataaccccggcccaagcgataaggtaaaccctggtaggggcacgatcgactgaattgaaagctctgtacatgacgtttgctgctccgcgagctgaatcttgcacgctgccacgcgcaagttgatctgtgttcgtgcttagc

SEQ ID NO: 24338 - DNA, 1501 bp, Oryza sativa
  unsure (1)..(1501): unsure at all n locations
aactagatcacatgatggctgctgagtagtgctcccattatgcgagcttgtgtagtcccctcggcgacggcgatgaagacggtggcggccgcggcgacgacgacagcgacggcgatggtggcggacgnggcnnnaacagtggcgatggcggacgcggtagccacggcgacgacggcagcggggctcgcggcagcgccggggcgcccaaccttgtgttgcgctagttttctctcaagcagaggaggctggcgctagttttatacgcatcgtgtatcggcggctccatatgattcttccgtgaactgagtccaccagcctgctgctcacgtggattgggctgaagatgacgtggtggcccaaattagtgcagcttgatccaaagtgcaacggaagataatattacctggtgttatgtaaaaatatgggcgtaggcctggtccatagtgaaactttggctattaaaactagcccaaagtgaaatttactctgtaaaaagtcaacaactttaaatatttagggacgaagggagtactatttaagtaccttgacagtgtttagagtactagtttccaaaatcaccgtaatttgataaagttaaaatatttcaagacaacggatcaaacaagctccaaattcagttacgaatctattactatttgtaacaaaaaaaaagaccagttgcacgacgaaaaccatgggcccaaattttccaccccagactaataaatattagtcattttgaataagggtaaagtcaaactttaaaatatttgactataaataatttttaaaatagttatcttaaaaatatggaaatcatatgcgtgattagtcttgaaaagtactttaataaaatcatatatttgttgatatttctatatacattataatagaaaatagttgtcttttagagaccatgctcttatctaaaacgacaagtattatcaacctggaggaagtagtagacgaaatacaacgcatttggagaaccattagtgagtcaataaaaacacaagctccacggtggttgttaaatattctccctccgtttcaaaatgtttgacaccgttgactttttagtacgtgtttgaacattcatcttattcaaaaaatttaagtaattatttattcttttcatatcatttgatttattgttaaatatactttcatgtacacatatagttttacatatttcacaaattttttaataagacaaacggtcaaacatatgctaaaaagttaacggtgtcaaacattttaaaacggagggagtatgtgcgttttaattttccaaagcaagctgatgtggcgcccctagtattccaacgatcgatagattaatattcccaccaacaataatgcgatgctcttaagtcaacttcagctaacaatagaaaatgagcagcaggggatcacctaatcacaaactaatcacacagctcggattgctcaatcatggacgcagctgtgttctgctgcttgctagctcttcttcctcttc

SEQ ID NO: 24339 - DNA, 1501 bp, Oryza sativa
tgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtgggcggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagtta

SEQ ID NO: 24340 - DNA, 1501 bp, Oryza sativa
caaagctttaggtggatccgtttcgtgttggtggcgtgtcaaaaaaagaacaatagtttcatcttctaattttgtgattacgtaccccttcatgtcgagcctccaactgttcgtctttcacttgataccggtcccctttgctgctttaatgactatgttaattgtcaacgtcaatctgcacgggccaactccatgccatgcacggcccaagggcatgcggccgtgccatgtatcagcatgcgttgtgttcggttatctttgttgagcatctccgttctatttttatcatagagctgcttgtggcacaaaatactactccctccatttctaaatatttgatgccattaacttttttaaatatatttaaccgttcgtcttattcaaaattttgtgatatttaagtagtagtagtatatttaacaatgaatcaaatgataggaaaaatattaataattacttaaattttttttgaataagacgaacggtcaaacatactcttcaagagtaaatttcactttgagccagatttaatagccaaagtttcactatggaccaggccgaggcccatattttcacataacaccgggtaatattaccttccattgcactttgaaccgggtttcacagatttgggccaccacgtcgtcttcagcccaaaccacgtgagcagcggctggtggactctgtttacggtgagaagaaccgcgcgggaagtcacgcgctagggcgcgaagctgacgccacgagggttctagcgccaccacccactcagtagatggcagccctccctccccctggctacagcactgccctgatttggatatggtcggcctaatcaggatttcacctgtgttgctcagtgtggccgctcggctgctctcctctagtaaggatttggtcatctgttgtagccattagagcaaggataatagtagagctcacttcctactagggatgaaaacagatcggaaacagacggaaactagctttatcatattcgttttcatattttttttggaattggaatcagaatcgaaaactcggatacggaaatgaaatcgaatattatcgaatacagatacagggcgaatacgagacggaacgaatacggtagcgaatatttaccggtatataaaaaccccctcaaattgagtttcttgatcaaggaagagatatcgcttattattttagttcaacatctccaacatttgtatcgtcaatgtagacggtcctacaaccatatgtgaaaatctattttcatggatgttcctctaagagattcatatgcaaatatgattatcattttctattcccaagaccttttactagatgtataacttacttaccattgtatgaattggagatgttatttattttatttcacatcttcgaaatttgtaatgtttgttttatactttaaatgctttcaaatacaaatattataaactacaaagtggtagatcccgttgagctctacaactttgatatggaacacatctct

SEQ ID NO: 24341 - DNA, 1393 bp, Oryza sativa
tactgttaaacttgctcttaaaaatataatgcccattcacataacggttcatcatttatcttattaaaatactatataaatattatttattttattataacttattttatcataaaagaaattatattcttaacttatacttgcatatatttatgctaaatatttaaataaatcgaataatcgaacgttatgtgctgacagctgcattttaaagcgcaaggagtatatcgatcgagatccgcatggcttgtctacctttaggcgccagatagaataatcaggatttaggagcagctattagctagctagctttttgttgcttgtggagggcaaatgaacacaatgtgatttttaattagtttaggtatacaatcatactaactgattggttttttttttgttttaaaaatgtcacacaatcacatatgtgagtggaaaagtcaaatcaattgagagctttctttcaagtgttgtgaatgggtaaccaattaattagttttagtactactagtgtgaacttactactttattaggaaaaacctagagttcaccatgattaagcaaagttttttgtcatatctacgaatacataatcttcagactttttctcgcaatcttaaagaacaatgttaactttttctaagataatgggaatggattaattaaataccagtactccattatatgaataccacacgtatacgattttatcattcatgatagctgaagagagactgatagctgtcatgaccaatacttagtactgcctccattttatattataggtcattttatttttttaaaagtttaatcaaacttatataaaaatagtaatatttataacatcaaattagttttaataaatctaacatcgaatatattttaatagtttttttctatgttgaaaatattattatattatttttataaatttgatcaatgttaaaaaaaggtttgttaaaaaatcaaaaacgaaactactagtggctaagtggctattaggctgtgtttagatctaaagtttggatccaaacttcagtcctttttcatcacatcaacatgtcatacacatacaatttttcagtcacatcatctccaatttcaaccaaaatctaaactttgtgttgaactaaacacagccataattggggactcagttgatgaaacacaggcataacctcaagtccaacaaatcaccagttaaccaccactcaacagattttgcagaataccaccggacccttgtaaaatttcagccacacaagaagagagagacagcaggtgacaactgacaaggtgggacccacatgaaagtgggagaggcgatgacccaccctaaccaggaagcttccgccattacgcgcacgtgcatatttttctcctccccgcgtga

SEQ ID NO: 24342 - DNA, 151 bp, Oryza sativa
cctatcaaaccatacacgtggagactgcttcacattactacaaatccgggcttcagtgacgggtcatctgtgacgggccaacgcaactcgtcaaagataagtcatctctgacgggccgaaaaaatatcctcttcaatatatggctaccagg

SEQ ID NO: 24343 - DNA, 998 bp, Oryza sativa
tactgttaaacttgctcttaaaaatataatgcccattcacataacggttcatcatttatcttattaaaatactatataaatattatttattttattataacttattttatcataaaagaaattatattcttaacttatacttgcatatatttatgctaaatatttaaataaatcgaataatcgaacgttatgtgctgacagctgcattttaaagcgcaaggagtatatcgatcgagatccgcatggcttgtctacctttaggcgccagatagaataatcaggatttaggagcagctattagctagctagctttttgttgcttgtggagggcaaatgaacacaatgtgatttttaattagtttaggtatacaatcatactaactgattggttttttttttgttttaaaaatgtcacacaatcacatatgtgagtggaaaagtcaaatcaattgagagctttctttcaagtgttgtgaatgggtaaccaattaattagttttagtactactagtgtgaacttactactttattaggaaaaacctagagttcaccatgattaagcaaagttttttgtcatatctacgaatacataatcttcagactttttctcgcaatcttaaagaacaatgttaactttttctaagataatgggaatggattaattaaataccagtactccattatatgaataccacacgtatacgattttatcattcatgatagctgaagagagactgatagctgtcatgaccaatacttagtactgcctccattttatattataggtcattttatttttttaaaagtttaatcaaacttatataaaaatagtaatatttataacatcaaattagttttaataaatctaacatcgaatatattttaatagtttttttctatgttgaaaatattattatattatttttataaatttgatcaatgttaaaaaaaggtttgttaaaaaatcaaaaacgaaactactagtggctaagtggcta

SEQ ID NO: 24344 - DNA, 1501 bp, Oryza sativa
tttgtttgctctaacctaatgccgactcctcgcaaagatcgacaaagtgaggttaaatatagttttgatgtggccaagtgtgataagattttttattatcttttgcaagagaaacaaattagattacctaaaggccatgtcataccatctcaagaagagttgaaacgtcgagcatattgtaaatggcatgattctcattctcattctactaatgattgcaatgtgtttcgacgataggttcaatcggccatagatgaaggacgattgaagttcaccgatagctccaagataaagcttgatcatgatccttttccggtgaatacaattaatttcaatgataagaaggtgttgattcggccggagcaagccgaatctactaagggaaaggaactggtcattggttaaccgaggcctaagatggtagtgccaaagaagccggaggttggcgtttggaaggagaataaaagtggagcttcaacttctaaggcccctaggaagaccaaagtaacttttgatatgcttttggagaagtatgagaagcaaggtagtgagagaggtcgcaacaaagggaaaagaccaagatcacctcctagggagcaatttggtcattcatcaagacggtcgtattcaccttcatatcatcatccacaagacatgtcatggggttcttatccaatgccgccgccgggttatccttatccttacttcatgccatggggggcaacgccgccaatgtttaatcatatgcctccaatgcaattcaaccaagggtggggaggaccaaggaggccgattcatgagcgtttgtcttcaccaaacaatagccggttttatggtaagaatcaggctaatgaagaaaagagggaaggaaagcgcgtcaaggtggagacgaggacttcggaggtaattactatcaaagtggggtttcatgatgtgccaatacctactggagatggagttggagtgtccccgaacaaaaaatccgaagccggtaccagctcctcgcagtcagccggtcaatccaggccttctagccggtctgaccgcagtcatgcgaccggtctgaccgagccatcaggccggtctgaccgtgctccggatgtcggtctgaccggcgcgtctggccggtctgaccagtggtctatggctggcctgaccgggctccagcgccggtttgacaggaggattgcaaagggcgatgtggaagcttcatcgtcttcaaacaaagttaatacagggcattatttacctcctggaacagagccgaatcctaggtggatgcctaaggatttgatggcaactcaaaagagaaggttgcaacgtcttcgggcccaagagctaagagagaaaaaggccgaagagcaaagggataaaaggtttaataagttgcgaccaccaccggtatggaggcctaaatccatagagaaggcaaaaccgattgatgtagaggagaaggaagaacaatcggtagataaaggtgaatcatctccaaaagaagaca

SEQ ID NO: 24345 - DNA, 902 bp, Oryza sativa
cctatcaaaccatacacgtggagactgcttcacattactacaaatccgggcttcagtgacgggtcatctgtgacgggccaacgcaactcgtcaaagataagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacagatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagttatttagggtgttaaatatatgttaaatgattcagacaagcatagacaaaataataacattgggttagtagtcaatatgtgttaag

SEQ ID NO: 24346 - DNA, 1218 bp, Oryza sativa
caactactgcttttaaatgctagctttatgcaaaagaacctctagcctcctttggttatatcctgcatcatacctcctcttccggtatgactgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctccgaacccctttttcatctgcatatgcctttttgcacctggaattgttttgggaaaatttggagttttgcctctttggtttgcgggaaaaatcttggtcgttcattcggatcggatttttttttttttaaaaaaaatgagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgctccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctaccccctcaga

SEQ ID NO: 24347 - DNA, 489 bp, Oryza sativa
agagtgaagctgattctacaattgaattcctgcagcccagaataaggcggggtgaaactgggcaaggcatagcaggtgaattagcctggactgatcaccagttgcgtcagatcttattgccatagcagcacatcgcgaccgcatgggttggaaagtaagaccgactgttgtttttgcacacgggacctagcaacgcaccgtcctaagaattctgacgtaacagagcattatattaaacgaacttgatatgcatgcatacgcgatcagacattgacctcttgctatctccatccacgttctggatgatatgatccatccatgtcttcatgctgtgtagccacatattcccctgccatggatcgatctgtttcctgctccgaaatccatccttctgtgtttgcatgttttgctacttggaatatgagtgaatgctatatatcggacaaacacatatgcaattgatcagcaactacaaataatggagtgtga

SEQ ID NO: 24348 - DNA, 238 bp, Oryza sativa
ttcatgcttggatctatcgccaaatgctgcaggttcatgcttggatctatcattttatatataaaaagagtttttatctatttaaacaagatttggaattggagattaaacacgagacattggggttgacaccatatacctcttgccaccgcaacatcaagtgcatctcaaaagcttttatctatggtatgttccttaaaaatgttttaaaaatacagtcaattgcaagatgtagtga

SEQ ID NO: 24349 - DNA, 1501 bp, Oryza sativa
ttcgtggcctctaaatagctaggattcggtcatcatataattattaataaacagaaaaatgaaggacgacatgacaacaagtttcatgccgcaacgagcttcttcttcattcaccactacagcaacactttggactgcgagaatagacctccaaaggcaatgcctccataagaaaatggaacacgcacgcgccatccttgccatgatccaactagcaaaggccatactattggtttttacctagaataattttatcatccttgagaagatatcgagaggtaccatattaaaagtgagaacactagcatctgtagagacctcagcaactaaaatattttgttgattgcaaatctcaaagatccttgggaagcaagttttctgagggcaagtgccataccacgcatcatgccaaaaccaaatgtggtctccccttcccaaagacctttctgaacctaatcttatccatttcctgatattcataatccccttctagaactaggatccagaatctggacattgaaaaaccccagaattcctcacatactttttcctcaaaagctcaacacacaaactcttatccagggactctatttttatcaaccatttagcaatcaaggcaatgtttaaagctcttgtttcagtgagactcaaaccaccaaaatcctttggaaaggctagatcagtccacttaatcatatgatatttcctagaatgtttgtcaccagcccagtagtatctacctcttatactgtcaaaactctgatgaatcccttcagggagctgatgcatcgccggtagtgagaggagggttggcatgcgagggttttggtatagtctgcatatcgcctcctggaccccttgtcagagggatcgattctcatatattgccatctttggttgctgttttttttgtttgaacatgatttattatcatcatattattgtgatgggagcagttttggagatgggctgcatttgagcaaacttaaattgagatagctcaatttgggcacatgttttcattgtggatgttgacggttgttatcgatcagtttcgaccatcaatattactaaaacaggagagaattggtgatgcttgcaatgcatatgtttgttaaaataataatattccactagtattaggtctactaacctttttacagagaatgacaacaaagtggaggagaatcgacatcaacacaaacgataaatcaatcggacgatgtcgacaaccaaacttatgtatgaatgggccaagaacttagaattgacacgatgaattgggccaaagttcacaagtctgcagagtggagcaatagaggaagtcgctagccgaagatgggctggtttgggccagcccatggttcggccgaaccagggggttcggccgaacccccatctccaccgttgaggccagggtttggcatggacgtccaagatttcaccccaatgacggttggagggtacttcggacaattccccttccataaccgtcatacct

SEQ ID NO: 24350 - DNA, 779 bp, Oryza sativa
caatgaggctgatggagtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttaga

SEQ ID NO: 24351 - DNA, 304 bp, Oryza sativa
attacttaaattttttgaataagacgaacggtcaaacatatgataaaaagtcaacggcgtcaaacatttcgaaacggagggagtatatatttccatcaagaagaagaaaacacgtatagtttcatttttgtttagatgaaaagaacagtaatttgctgaaagtactaaaacccatggaaaatcaaaatagtagtggtggcctcgtctctctgtgggccacggcctcattactgagcgccaagcccagaaagcccagttggagcacttccaggcctcatcacaagcccagtaacccacttccagg

SEQ ID NO: 24352 - DNA, 454 bp, Oryza sativa
attcctgcagcccggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagc

SEQ ID NO: 24353 - DNA, 418 bp, Oryza sativa
  unsure (1)..(418): unsure at all n locations
taatataattaaaatgttctttatagtaattgatgtgaacttaaaatttttacccttatatctttcnattgttccatcttcttatttttctcattctnatttatttttttgataataatattgctacagccagcactattctttgcacatgaatactactccttccatccctaaatataagggattttggttggatgtgacacattctaatataatgaatctagatatagagcctgtccaaattcgctgtgctaggatgtatcacatccaacgaaaatcccttatatttagggacggagggagtagcgggtagctcacgtgtgtgtgctccgtaatatatattatctatatttttacacgaggaaacaataactattatctttgttaatcagccccaaatgtagctccaaaccctagc

SEQ ID NO: 24354 - DNA, 334 bp, Oryza sativa
ccatttatcattcacacaaaaaaagaattgtgggacccacggacatgtgtgtcccacatgtcaccctctcctatcccttcttcctcctccccctcctcccttctctatctctccctctttctcttcgtgcgtggggagcggcggcggcggcgacggcgacggcaggcaatggacggagcggcagccgacagtcttcgcgcctcctctatcgccgccgttgcagcagcagtagggattcggggatggtggcggggcgagggcatggcggcgagggcaccttgagcgcccgctcagcgagggcatggcggtgagagcacaacagcgacgagcagga

SEQ ID NO: 24355 - DNA, 299 bp, Oryza sativa
atttcctcgcaaaaagaaaaaaaagaagtcctcatgctatccacttgtcgatcagtttgactgtatgtgccgttcccgtaaagcagttgtggcttaggctgtgtttagttcctgaaaaaggttaaaagtttgagaaaagttactagtttgaaaaagaaagttgggggtttatatgtgtagcaaagttttggatgtgatgtgatgtgatggaaagttgaaaagttaagggttaactaaacacggccttaatccggcaaccaattaataacacgcgtgaatgtcgtagtacggtacataga

SEQ ID NO: 24356 - DNA, 181 bp, Oryza sativa
ctcagctctgcctcccttaattatttgtaatatgcatttatctcaaccaaatttaaatagcaaatctgagtaggtttctctgttatctagacatactcatggttcatattgctttctatctttgtttcagttttacttcttatattatacatcaagtttttatgcttttgcttggcagatg

SEQ ID NO: 24357 - DNA, 427 bp, Oryza sativa
tggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaaga

SEQ ID NO: 24358 - DNA, 1501 bp, Oryza sativa
ggataaacaaacacaagtttcaaatttcatatctacaacaaactcgggaggcttcgttcaatttttggatctactgtagaagataaacgaccttctgttgaccaccgagaaaaataaaaacggacgggagtattcgattcattagacccggtaacagtcattggcattggcattagtagcgatcgaattgagggcgcatagggagggactcccggtagtaccatataaatttcacatatatgtatatgtacatattatatatacatatatatatataagtaatgggctcgcaagtcgcaaagagtatttgcaagctgcacgcttgcggcaacgcgcaattccggcgtgcccgtctgctcccaccatttctccgctactttaaaaagtcgtcctcctatccctcttcttctcacttcctcctaaaaacagatttatcaaaaaaaatggaataataataatatagaaaaccaataaacctaccattcactaaacgaataaaaaaaaaattgcaaggcatgagcatataactagctagtctttaaaaattacaacttccttccgtttaaattactcctctttctttttgtttttcaattacactgtagacgtatacgcacaaacaccgctaacatgtcgcaccacactaacggtcctttaaatatgcccactcacacacgttcaactagagcatcacatccttcatcttactaaatttccgttgaaaacgtatttgtgggcgtaaagatttgaatctaagcactagaatttaaatcctcgtgagtagaaccatacacccataaatccacaactaaaccactgctttgtaatatgacttagacatctatctttaaccaccaattttaaaaattcatgtagtttaacaacatatattatgaaaatatttctcatggtcataaaaacataaaacctataatgttaacctatatgaatatatagaaatttaacgattaaactgtaaatgtttggtttaggataaaagtagaacaacaagtagttttcaatggagggaatagcaaaatgcacatggcatgatttgggttaaaagaaaatatattataatatgttacaacaaaaaaaaattatattagtcagaactactattaggagcacagctattccaagagccaaacatgcatcagcccaggcccaccccaccccacgtcccgtcatcccactcccaccgttatcgaagtaaacgatttactcctatcgtacgcctcaaccacccgcctttattcgagtaaacgatttacttcgataataaaaacaactcccctgctttcgatcccaccccacgttctgcatcgtgctcccaccattattggagtaaatgatttacttcgataaaaacaacttctctccttgcgatatatattcatttttttccgtacccaaccaaccactctcgcccccacttccttttttccttttttgcggatctaaatcgatcaaccattccagcccacagatcgtcgacaca

SEQ ID NO: 24359 - DNA, 366 bp, Oryza sativa
cctgcagcccttgtttaaaataataaacagctaaatttctggaaccaataacaaaaaattacaagctcattcttatagttcagttatcttacactgctatagcactcaataatagacaaattacttatgtggtagactctaacccatgatatccttctacacctttgcagactgatgctgattactggcttctcaccgatgatgatatcagcattactcatatgtggacaacagcatgtatccttgatgaaatatagtcattggggttgtcgttggtgatgtactaccagaccttcctcgatgaactggtgatctacctgtgtgccactgccagctagatactcatcttatagctaagagatcaga

SEQ ID NO: 24360 - DNA, 1501 bp, Oryza sativa
gtaataccctactcctgtgttttgggagatctgtgtatgaaggagctacaaagtatcagccagcctctcccttgttttgggtttctaatctggaaaagtccagtcccccatctaagtgggcaaggtcctccttttatatcttaaggggataccacatgcaccatttctctcttttttgtggggacttaccccaccttttcataaatggacggagatttgtatagttgtcgtccgagtcaccatctgatgagacggctcacaactacctccactttcgccgggagctggtgcgacgtggaatcgtggctgtctgctgacgacatgaccggtatcagaccagtcacgtcggtcattcttgtccaccacgtgtcagcttagcattctacatgctcccccttcttcacacaacatcttgcctgtaatggttaggatgaagcctggcatatatctgaccagatgactaacgtgccatctctgggaggcaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgcgttacatgcggcgtgacacgctcagtcaaaccgcaataaatgtagttaggtgagccccactgtgctcacctaacccatacacgcggagcaaaaacccacgaggggtcggggcgcctcggccctcggggccgaggggggtgcggcccgaccccctcggggggactaagaggagggcgaacgcatcaccctcaggcccaacgtccctcgggggtaccaggccacgtgtgcgattgtgtctgcctcaaacctctagtcatgatactcctgatcccatgtcaccgacagtagcccccggcgttatgccagggcgatcgccttctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcacgcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 24361 - DNA, 991 bp, Oryza sativa
aagacgctgtattagagctcggtacccgagtaaacatttgttctttactcctggttgttaataccaaccgagactaaagatatctttagtcccggttgaagccacgaaccaggacgaaagatgaccgggtttaaatatccactgcatcggcttccccgcgccacacttagacttctccacgatcgatcttcttcctcgcgcgccatcaccgccctagacgccgccaccgtctccgccgtcgtcgtcgtcgtgctcgccgagctcagccaccctccccaacgccaccggcagcgcgtcgcctccctcaaggtgagggcgcaaatcttgcgcctctgatctcgcattctctctctgtctctctcaaacttgacacgcgccggccgaccggacctcgccgccatcatcgttgccggcaccatcgtactttgccatcgccgtcgctgactccaccgccgccacctcgcgcggaataatccaccgctgcgcgcggactccaccgccgccacctcgcgccgaatccaccgctgccgccgccaccgccgcgcgccgactccaccgctgccaaccgcgtcggcctgcacagccgccgctgcgcgccgtcgacgccaacaacgccgccgccgtcaccgccgccaacaccgacgccgcccactgccgccgccgacacagcttgaacgaaaacactcacggtcgaacgtttgaacgagaacgttttagtgaacgatgacttagcgacttaacgagatggacgacttagcgacttagcgagaacgacgtcttagcgacttagcgacttagcgacttagcgactttcacgaacgacgacttagcgactttgacgaacgacgacttagcgacttagcgagaacaacgtcttagcgacttaacgacttaacgagaacaacgacttagtgaattatacatgtataattgtagggtttagacgtatgacctgtacatgtcgatgtgcatgacctcactgtcttttttt

SEQ ID NO: 24362 - DNA, 675 bp, Oryza sativa
ttgatctatatcacaaaatagtcgtatgaatgaaaaaattataggctcaatcacacacaagtgataaaattactcacaggtgaatcaaactagaaaagaaaaaaaatgattcagccaaaaatctatctgttggctttgctagatcttgttataaggatgaagagaacggtctgtgtcttgtgactagtagtggagagagcaaccgagtggcaagcagtagccgacgatggaatcatggaaggatgtagtggtgtggtatagagatgagctcgacgttgcgcagtaacagccatccatcatctagcaagcacgaaaaaaaagcaaaaacattctcgttcatgtcaatagagataacgagcaaaagaaaaatagtaaacaacctccatcaccggcgtactctaccctatcctctgcggccagcaacatggagcatgatgtgcaaatgtaggacctgtacaacccatcaattgagattaggtaatattggagattgcacgtcaatttgatttgcaaaaaaaaaaaaaattgggccttcatgcgtgaagtagaaggagagtatgcagatacaaatcagagtgtcatttccttacttgcttgttctattaatatcgccgacgtggagtagccgctagttcttgctattggcccaggtgaacaccttcttgctggttaagg

SEQ ID NO: 24363 - DNA, 1501 bp, Oryza sativa
aagtcggaggcagagatcgagttcgataccagagcagaaatcggctggagtccagatcggctacgataagatcggctgagtctgagtcgggctaggtaagccgatgtagccgatcccgacaatacaacttgatgtgtgatgtcgggttggatcgtggtgctccaaggtgattgccgcacatggatagagtcctgaggaggcaattgtatctattaattaggatgttttatgtaatttccttagagatacgtttgggcaaaagtctgccgcaaagacttatggtatcttagagtttgttagagatagtagtcgtgtccgttatggacgtatattttaattcttgggtataaatagacccgagtcctatgtaacttttaacacacatgttcaatacaatttcggcgcatcgccacccttttgctttagttttgtttcgacgagttcttgctttcgggttgagctgcatcggtttcgatcttcaacaagaggtaaaacttgttatgacgacttgtattctcgggattagtgcttccatctttatgacactctaatcttgtttatgtaattcgtcgagttataatatatcttacataatctctggcaatatcgctatctaacctacaatcggctaacacctatcgaagagggcagccgattaggttagattttgacgttgattcagattatgtaagatatctaccactctatgagacttccagcggcttgattgtctagatattgttcttcttttcatacttaatgctacatcagttgagtttgatatgttaagtcgtgcttagaatatcaatctctagcctgctttctagttgccgattagggtagcatcggagtttcagccgatcttatctgatttaactatatttgctgtgtatgcttcattgacatgttaaatctgcccttcatgtcaagatattgctgtatctaagtatattaggcctttgtttgatatattatacttgttttaatatcctgatacagagtagtatcggagtattagccgagacatgttagatctatctgatcggctatgctataaacatatatagtcctgttattgatatatattttgatctaagtgatttatactgtctcgacatggcgaccgatctatcccaatcacttgatttaagtatatatcgatataaggagtatatattgttaatatctacagccgatcgagtagatttaattccttcttacttattcatgactgccgatcgatacacatatgacatcggctcaaagataaatgatatgtcttcggcacctagccgatcggctatcatttatatatttaaccgcggtttctttgcttctatttatttcttgttgattacaggatcaaatcaactggcacgctcatacattcgaaggcgagctttggacctacattggagttaagcagatctcccaggccacgtgttttctgttaacagctgtgcaaaatgaaaaaggtagcgtgtgttgaggttctggataa

SEQ ID NO: 24364 - DNA, 1182 bp, Oryza sativa
ttgttgagaaatatttcctcactaggcaggaaatgtttagatgggcattacttattaaaaaactattttaacaaaaattatttcagatattcattacttgttgaaaaatatttcatcaataggtagaaaatatttcatgatcttagatagtagggtataatggcatcataggttgttattttgttttgagacaatagaagaaatttacatgcttggattttttttaaaaaaaatatcgaaaagaaacaaaagaaatagaatggatatacatgatgccgggatgaactgaaaaaaattaatagaatgagggaacaagaaataccattagcaattcctatgcccagatcgttgatacagaccaggatgaaagtggggaaaatatttttatccctcgaagagatgtccccttgtttgcttaaaaccatttaaatggttatgaaaaattctagaaaattttggcaacacttataaaatagatctatctatcttgagtccaaactcaactcacacaaatcgagatataaaaaaagacaaattcggcgtatgaatagtagtgtattttgtttatatctgaatttgtcttttttgtttctcgatgtgtagatcgaatttgaactttgatttttgtggcctagaagatattacgatactctacattgttattttttttcaaaatttttcatgactattcacatcgaatataaaagaaaaatttgcacgaggggacatcccctcgagggattagaatccactcccatgtgtacgggggtaccaaggacatcagcttggatggaaatggtgccatatggctgatacctacataaccctctactactggagccttgtccattaccccctccgttgcatattcatattttttaaaaactttatcaaacttaaaagaagtttgattgaaaaatcaaaacgacttataaaatgaaacggaggaagtatcatcttggaattctgcctgcattagtttatgcccctctccagtacctcaattcttgaatgcgccacccttgcatgtctgccatcgtttactgatggggttcaatgatcgagccgaaaagaaagtagggcggcaattcccggtgcctccctctcctacctcatgacctcttagagttcctgcgacaaactaatatctgacttttattttctgttgctgtctctcctaga

SEQ ID NO: 24365 - DNA, 1501 bp, Oryza sativa
tgctcaattttaattggtcaaaattatttctagggctctgaaaattccactaaaaatcctgttagtgaacttcgacatgtagaactcaagaaaaattccacatgtcagattcgattattatttgtattacttccttagggttttctcttgatttgcaccggcattttcttagggtcatttataaattaaattttaggcttgggaggagaacttcggggtgtgacaattttcctcctctcaggtggttgcagcttctagatccatcaccgtcatcttctactttctcatcgaacctccgacacataaccgtcttccacctctccaacaactatattgttgccaaatttatctaaccactaagaattccctaacgttgaatccccacctcctccccatctccaccataacctcttttctcatgatatccctcaaaaccaaggaaatatcactaatcctccttgcagcctcaccatactagcttgaaacaaatcgagtatcgtcgcggatgcaatcaccatgttacgagagaagatgaaaatgttatcaatgcacggatctttatgtttatctaataaataggagtagttgcatgtggttgatgaagaaagatgatgcctacaagttagtgaattccttttatagaaaactatcatatatggaaatgaatttcaagatctaaagggcatgtgattttatttcttatgaaatattgtaggacagttcccttcaggggacgacatacttaaagacccacgcccaatgcactctctgccaacgccacatatccaatgccctcctcctcctcctcgtgtcttccccatcctcctcctattcctagcccatatgccagccaaaaatggctcgccactcctcctcctgcccttcgctggccctagctcatcttcctactctctacttcctgttgtggctccatgttcctgacgtagccccccgcttcccatcggtgaggtacctggtacctaggtacggacacggcgagagagggggtgtggtttcatggatttggtcgaggatctggaggtggaggtactatcaaccccaccgtcgtatggatgtggagatggtggtggtggaagttgggattcctgatggccatgggtggcgatcaagttctcggagcccatggggacgggatgtggtgttctcccccacgatgatggtagacaagggcctcaccccttccttcttcgaaatgaccatatctggagctttgattggctatcaatgtggtggtatagccatcatgctccttgccaacccgttttgctgcttgtcagtgttgtgtgcaggtatgtcgtatgacacattattcttggttagcacccatgagtatcaagtatgatacccacatgtatcaggcttagcaccagtgggtctggtacctgcatatatgaggtatggaacttaggtactagccggtacccaaaggtgctaggtacgatacctacgggtatcaggtttgctacccttggtatctagg

SEQ ID NO: 24366 - DNA, 533 bp, Oryza sativa
ctgctaacatgttaaaacaaacaaagaaccacggtagaaattcttattagtgaaaaaaatatgtggaggcacttctagttttttcttttgcttaagttgcattgattctgtaagaccaggacatcagcaacaagctcccataataaactacactgtaaattatccatgttggtttgttcagtgatgaacgcttggtcgcctaatacatcatgaactaccatttaggtcattacttactcaaactttgttactgaccttgccacaactagataccttaccaacttacgaagtaaatagagtagaagcttgagcacatgctaactaacaagtgaagaaatcactatcagcaaaatcgattttggggataaatggcatctaaaattgctattctccaatcaaccctaacaaaaaaataaagaaaaaacgaaaagaaataagagagagaagagaaggtcgagattttacagcatcagaacagcagcgtcgtacaaaatctcagtcctgggctaattttaattttgaccagaaaacca

SEQ ID NO: 24367 - DNA, 1501 bp, Oryza sativa
ccttggaaaacctcctaactttcatttcccccctcttaagtgcctatcatgaacatattgccacaatcggctttcctcgggaaccatcacattcctttgccaacacatcactgttatatttgccacgaccttctacatttctactttcttagcaaacaaccttgtgcatttttgtcacgcccagaaattcccgaatagaattccaagcagaatgtgcattaaaatccccgtccaggaccggccggggtacacaaacgataatgttgacattcagatccacgtcttacaaacatcataaaagtcttacataaatgcagcggaaaaaggaagacaacaggagctaagccttgactagaactgcagcgggaacaccactccacaggcaccctcgatggcacggatgaagcctactcctcggagaaacctccatctgacacatacccgaactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaaccgttgtaataattaattattattaactatccactgtccaacgctatcccacgttgcgacaggcccaaccatccacctaaactatccaaattcaaaagattacactagggtgagactaatcacggtgaatctggttgaccgcccataaccgcgggcacggctactcgaatagttttactctgatcagaggtgtacaactatacccacaagacacagccccacgacacgtttccgtgcgccgacatgccaccacgacataccggaaagaggccgtaacaggacccttcgcataaccccttctaactaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaataggattctccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaaggaaaacaatagagcatttgcaatataggatcaacatgttcaagt

SEQ ID NO: 24368 - DNA, 887 bp, Oryza sativa
ataaataggtagaaccagaaacggtagaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaaga

SEQ ID NO: 24369 - DNA, 1501 bp, Oryza sativa
tttctaaagttttaaactaattttaatgtgttttacatcttttaattttcattttagtttgttttctagtattcaagattaactttgactatagttttccttgtcaactattttataaaaccttctttagcaaatcaactaaatttctatatattctttcttccctacacaaattttctacctcatcaacttacaactaaattttggagacaaaaaagtgtgcaaaacatagctgcaaatgtaatatgacaaaaaaaacattggaggatgaagttgcaaaccttttaggcacctccgatttgtatgacctcccctcttttttgaagaaattttgaagcttgctcgggcagctggaggaggaagaagacatatatataggggtgggaatttagtcaccaaccggggctaaagatccccgagatctttagtcccggttggtaaagttacgatctttagtcccggttggtgttaccaaccgggactaaagatcctggggggcctgacaggccctgacagcatttgaaccgggactaaagatgatgatctttagtcctggttggtgttaccaaccgggactaaagatcaaatatgcccgttaccctttttaaccgggactaaagatcatctttagccccggtttttattgcatccgggactattgtgaaattcggccgaccgacgaaagatggtttctccaccagtgaattatcgcaacagtacctgtttgtctgcaatgtgtgagacctaatcgtgtgatgatcactcaacctttgaactaatggaagttatcaatgtgacaatgtggactgctaaaagttttagagtcttggcaaatcttattttatcaaactctgtgctagaatatttttattccaatcattaccacataaacgaattttctgcacgagaatcctataggttacagacggactgtaactggtcgtgcctgtaaaaatagaccgttattttcgcataggaataagttcactttggatcactcagggcctgtttagttcgcgaaatgaaaatttttgggtgtcacatcggatgtttgactggatgttggaaggggtttactgtagcacttatggctaatcatggactaattaggctcaaaagattcgtctcgcgatttcctccttaattgtgcaattatttttcttttaatctatatttaatgctccatgcatgcgtccaaagattcgatgtgatgtttttggaaaaaaacttttgaggaactaaacggggccttaatttatcaccgagttcaaaatttatcccttgaccataaaaccggatacaatgcatcctgcaacttacaaaaccgtgcaaacgaggtccttcggcagtattatcccccggttttggcttacgtggaacctacgtagctcctttgactaagtcttcggcccctgtggcattgatgtggcacttacgtgataatttgatctagaaaaaataataaaaccctatgaaaccaacatgtcaatttcacacacaa

SEQ ID NO: 24370 - DNA, 923 bp, Oryza sativa
atttaagactatcattttaaataagaaaaaaaagtgggtgggtttatctaatttaagatcatttaaaaaatgatattgaacattttcttaatcgactttgttgttcaattcctcttgttaaatatggacagcctgattgtaatgaataaatgggtcattttcggtttctctaccctcttcctggtattatccaggttagtgctagggttaaaaatagtatctgaaatgtaacaattaggaactaaacttagtccctgtcacattcgatgttgggacactaatttggagtattaaatatagaatacttacaaaactaattggataaataagagctaatctgcgagacaaatttttaagcctaattaatccataattagcacatgtttactgtagcatcacataggataatcatggattagttaggctcaatagattcgtctcgcgaattagtccaaggttatggaatgggttttgtcattagtctacgtttaatacttctaattatatggattagttagggataatcatggattagttatgctcagtagattcgtctcgcgaattagttagtccagggttatggaatgggttttgtcattagtctatgtttaatacttctaattagtgtgcaaacatccaatgtaatatgcactaaaactttgtagcctcatccaaacccttaagacaaatatacctaaatctaaatgcaaagaacgtggaggattggttgtctcatataaggaatgatcccataaaaatgagctattagaggattggttgtctcatataaggaatgatccataaagctattgatccaactatcacacatcagaagcgatttaaatatattgaagcagtagtgagaaaaaaaatagagcagagattatgaaagaaatgccagtacaaccaaagaagaaataaaa

SEQ ID NO: 24371 - DNA, 1501 bp, Oryza sativa
ggagaacaccacatcccgtccccatgggctccgagaacttgatcgccacccatggccatcaggaatcccaacttccaccaccaccatctccacatccatacgacggtggggttgatagtacctccacctccagatcctcgaccaaatccatgaaaccacaccccctctctcgccgtgtccgtacctaggtaccaggtacctcaccgatgggaagcggggggctacgtcaggaacatggagccacaacaggaagtagagagtaggaagatgagctagggccagcgaagggcaggaggaggagtggcgagccatttttggctggcatatgggctaggaataggaggaggatggggaagacacgaggaggaggaggagggcattggatatgtggcgttggcagagagtgcattgggcgtgggtctttaagtatgtcgtcccctgaagggaactgtcctacaatatttcataagaaataaaatcacatgccctttagatcttgaaattcatttccatatatgatagttttctataaaaggaattcactaacttgtaggcatcatctttcttcatcaaccacatgcaactactcctatttattagataaacataaagatccgtgcattgataacattttcatcttctctcgtaacatggtgattgcatccgcgacgatactcgatttgtttcaagctagtatggtgaggctgcaaggaggattagtgatatttccttggttttgagggatatcatgagaaaagaggttatggtggagatggggaggaggtggggattcaacgttagggaattcttagtggttagataaatttggcaacaatatagttgttggagaggtggaagacggttatgtgtcggaggttcgatgagaaagtagaagatgacggtgatggatctagaagctgcaaccacctgagaggaggaaaattgtcacaccccgaagttctcctcccaagcctaaaatttaatttataaatgaccctaagaaaatgccggtgcaaatcaagagaaaaccctaaggaagtaatacaaataataatcgaatctgacatgtggaatttttcttgagttctacatgtcgaagttcactaacaggatttttagtggaattttcagagccctagaaataattttgaccaattaaaattgagcacaagcaatatttaaatccctggaaattcctttcttcctttttcttttttttctttttccttttcccttagtgggccgccggcccacttcctctcctctctcctcgcgccttgctgggccggccggaggccacgccccagctcagcccgcgccccctcctctctcccggggtcaccgacaggtggggcccacctgtcggacccgtctcccacctcgcgccgcgccgctgcgcccatgcctccgcctcctccgggccacgtcggccacgcccgcgcgtgcgccgcgtccctcgcgcccactcccctctctctcccgcccgcgcccgcgcccgaga

SEQ ID NO: 24372 - DNA, 344 bp, Oryza sativa
aagtttagttccaaaatttttcttcaaactttcaactttttcatcgtatccaaacttttctacacacacaaacttttaacttttctgtcacatcgttttaatttcaactaaacttctaattttaacgtgaactaaacacacccaaagacacaccacatcaaatcttgtgctagtcattggccaatagaccattcaatggcggtattcaattcctctactgaaaccctctccaaccctctcgtaaatgtgctgcaacctcctctttctcttctccctctctataaaacacaagcgaaaataaacgccacgccacgccaccgcctccgtcaaacacggcggcgcaa

SEQ ID NO: 24373 - DNA, 841 bp, Oryza sativa
tcaaaaccgtattgtttcgtgcgtcctatccaaattcattaaattttctgtctatgtttcgccactgcgaaccatcggcggggtgtctcagcatcccgtcctgttgacgctcttcagcgtgccatcgcatcagtctagcattccccttgttcctgaacaaacgccttatccgtggtattatagggaaataccacatcaccttagcaggaattctcttcattgttagctgcccgtcaacttctcctggatcgtctcgtctaatcttgtatcgtagtgctttgcaaacagggcatgcttctaggttctcatactcctcatcgcaatataggatacaatcattcggacatgcgtgaatcttctgaacttccagtcctagctggcagactatcttcttagcctcgtacgttgtctcgggcaatttgtttccctctggaagaatgttcttgacgagtttcaataaatcgccaaatgccttgtcactaactccattatttgccttctattgcaagaacttcagagtggtatccaactttttgtgcccctgctcgcaacctgggtacaacgaagttctgtggtcctgtaacatcttgtccaatttatgggctcccttttcactttcgcagtcctccttggcgtcctgcaacatctgaccaagatcatccgcaacgtcgttaccatcaacatcccttttctcctcgcccgtttgatttccttcaaatccaacgtactgagcaaagtccggaatattgtcgtctttcacttcatcttcttccattttaacaccgtgctctccatgggatgtccaacaattatagcttggcatgaacccctactcaaacaa

SEQ ID NO: 24374 - DNA, 245 bp, Oryza sativa
ttttatctcattaaaatatgtttatagctagctaatagtccgccattgtacctgctctaagctagataatcattgcgggtgccctaggacaaaatgagatgcagacgtcgctgcgccgcgcgacaggagcagcagcaccgaagacagcggtcgcttcgacatgtccgatgatcaccaagattcccaaatcccaagacgctgcacaatctggaaacctaccgggttgccttgcctctctctttaga

SEQ ID NO: 24375 - DNA, 1501 bp, Oryza sativa
acggttttgtaagttgcaggatgcattgtatccggttttatggtcaagggataaattttgaactcggtgataaattaaggccccgtttagttcctcaaaagtttttttccaaaaacatcacatcgaatctttggacgcatgcatggagcattaaatatagattaaaagaaaaataattgcacaattaaggaggaaatcgcgagacgaatcttttgagcctaattagtccatgattagccataagtgctacagtaaaccccttccaacatccagtcaaacatccgatgtgacacccaaaaattttcatttcgcgaactaaacaggccctgagtgatccaaagtgaacttattcctatgcgaaaataacggtctatttttacaggcacgaccagttacagtccgtctgtaacctataggattctcgtgcagaaaattcgtttatgtggtaatgattggaataaaaatattctagcacagagtttgataaaataagatttgccaagactctaaaacttttagcagtccacattgtcacattgataacttccattagttcaaaggttgagtgatcatcacacgattaggtctcacacattgcagacaaacaggtactgttgcgataattcactggtggagaaaccatctttcgtcggtcggccgaatttcacaatagtcccggatgcaataaaaaccggggctaaagatgatctttagtcccggttaaaaagggtaacgggcatatttgatctttagtcccggttggtaacaccaaccaggactaaagatcatcatctttagtcccggttcaaatgctgtcagggcctgtcaggccccccaggatctttagtcccggttggtaacaccaaccgggactaaagatcgtaactttaccaaccgggactaaagatctcggggatctttagccccggttggtgactaaattcccacccctatatatatgtcttcttcctcctccagctgcccgagcaagcttcaaaatttcttcaaaaaagaggggaggtcatacaaatcggaggtgcctaaaaggtttgcaacttcatcctccaatgttttttttgtcatattacatttgcagctatgttttgcacacttttttgtctccaaaatttagttgtaagttgatgaggtagaaaatttgtgtagggaagaaagaatatatagaaatttagttgatttgctaaagaaggttttataaaatagttgacaaggaaaactatagtcaaagttaatcttgaatactagaaaacaaactaaaatgaaaattaaaagatgtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtatgattttttttcgactcatgtagatgga

SEQ ID NO: 24376 - DNA, 828 bp, Oryza sativa
cacagaccggtcagatcacgggttaggtggcggctgggggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggttgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgctgagcagcggcccgaacctgtatagatcgccgacgtgtctcgcgtttcttccgagcaagcgatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcatactcttccgtgtgcgccaagtttttcttgatcagcctaa

SEQ ID NO: 24377 - DNA, 1501 bp, Oryza sativa
aaaaagaagcttaggggtttccacgtgcacatgatttgtgagatcagtttaaactttagctatttgccaaaaaaatacataaaacctgaaaactctaaaaacggtaggggtttgctctcacctgcgtatacccgcgcgcgacgatgccgtcaacgatcttgttgagatcaaagccaccacgggtggtcttgagcacggtgccgcccttcttgtgccagtcgtcgacggcggccaggtccaggcgggcgtggtcggcgtcggggccgtagaacccgcggtagccggcggcgacgccgaagacgtcgcggacgccgtagagctcccggaggccgacgacgagctccctgaggacggtgttgaggcccgggcagagccccccgcaggtgacgaccgcggcgcgcgcgcgggcggggtccacggcgacccccgcgcgcggccccgcgcggcggtaggcgacgagcggggacggcgacgcggaggcgaggtcgaagaaggcgtggcggagggagacgtcacccggggagatgtagaaggtggccggcgggtggaagtaggggtggcgggagatcgggttggggatcgtgtcggtcgccgccgccgccgacgggagcaggggcacgtctcggagggtgagcggcgggagggtgacggtggtgttggacggggcggtggcgtcggcggccgcgccgccgttggcgtcgccggagttggaaacggtggggtccatgtgtcggccagagagagagggagaggggtttatgagcgacgggtggcgcgtttgtagattgtgcggggaagcgaagggaagggaagcgcttcgagaaaatgaagggggaggaggcggcgtgtcaaagggcaagtcatatactcgtcggcgtcatctgttgcgaccaaaaagatggccacgtaaacagtattaaggagaaaactaatggattagttcgataacaacaatggcaaatcgccacgcgacgtgagcaaaccactcaaaactacatgatcaaatagtaatcatctactccctccgttcatgaaaacaaaccaattcagatttatagtactggaagatgtcccgtttcgtactattttcatattttatgaaacgaacaaaatattacgtattcctcttatcccaaaatataaaaattttagtctggtgtaaatattcgtagtagtaagatgtgttatatccaactaaaatataagaaatttagctgtataatttggaatgaagggagtagtagagtgtttgtcattgtttgatgggcctcattcccggccaatagacgtcgataggccgggatttagtaaaaggaaaaagtacaccaaaggtccctcaacttgttaacgagttacaaaatcatccacaaaatcgcaaaaccagatatctgatgtctcttaactaatcaaaatcggtcacattggttctttggtggttttgaccctggttttgtccaacgtggcaactgagtcagcgtgggacccacatgtcaggctgaat

SEQ ID NO: 24378 - DNA, 321 bp, Oryza sativa
cacctatcaagagagcttatctggagccttgaaagaatcttctttaaagggtgttctctaactaattgctacctttaattagtgagcgcccaactatgacataattactcgcaactattctggtgtcttcagatgccaaacaagctccctgtggctgcaatgccttttgtgcatggtcctaaccatgattcctctcattcaaagccagcattcttggctttgcttccttttcttagtttctgtgatgaagctaatggtctgattcatgtgtgttcctaatctgattgatgcaacagggtgcaagccaagggacaagcaaga

SEQ ID NO: 24379 - DNA, 1501 bp, Oryza sativa
cgcgatgttgactgctgtttgattcctgaggttgatttctatcttgaaggaaaggggggcctgtttgagttcttgtatgaaaggataaaacagaagggacatgctgttgtcgttgttgctgaaggtgctggtcaggaattgattccaaggactgacgatcaaaagcgggagcaggacgagtccggcaacattgtgttccttgatgtgggtccctggttaaaatctgagctgggtaaatggtggaagagagaacacccaagcgagttgttcactgtgaagtatatcgatcccacttacatgatacgagctgttccagcaaatgccactgacaatctgtactgtacattgttggcacattcggcgatccatgggatcatggctgggtacactggcttcgtccctggcccgattaatggaaactatagctacataccgctggaagatgttgctgtggcgaagaacccggtggatgtgaatgatcacaaatgggcatgggttagatcagtcacaaaccaaccagatttcatgaagccaaaatactaagaccaaaagtgctgttactggacatggttgtatgactttttctccctggagccttgacacgttaagcttgatttctttctatccagtttcttctcttgttatgccgatctatctataagatgttaggtattctgatctccctggtttgtgtttgtgtgcacttgaaatcgtgttagcaggtattgctgtaaatctgtagtacataaataaatgaagtggcaggaaatgttgttctccattggcgaatgagttatatgtcgtgtcatgtaaatattgcttatcttgaagacttaattggcgattctgcgctaatctctcgcttaaagaatcagaacattataacgtgaaatattatagcagacatatccaaataaattggcctattagctcagctggttagagcgtcgtgctaataacgcgaaggtcgcaggttcgagacctgcatgggccattattttttttttctttttccttgcaatcgtgattcttttttttttccctttttttgcctgaacaatgttatgttattgtgtgtacgtgccaagatcaaattgcgattcctgagtcctgaacaagtgataaaattgtgtttgtgtatgtgtgtctactgtcaagatcaaattcctgatgatcaaaattgcaatcctgagtcctgaacaatgtgatacaattttgtatgtgcgtatgtttttcaagatcaaatccccgaagatcaaaattgcagtcctcattcctgaacaatgcgatgctatgttccacataatcccaagttccgacaaactttatgccctatacaaattacacaggaatataggcgcaaaaaagaaaacacagcaacacgactgcaaaaactgaggattactccaccaaacatagaaaattttggtaaaaaataaacatagaaaattctggtaaaaaataaacatagaaaattctggtaaaaaataaacatcgaaaa

SEQ ID NO: 24380 - DNA, 430 bp, Oryza sativa
gaatgattaatcttccccagctcatgaactcagattctcattctgtcatgcatctacatggagattgctgtactgatatttgtgaggagataggttgatcttgcatgcaaactgccaacacactgcaggtagggttaagttactgccagcttcagttgtgaaattataatatcatcacttcaaaagttcagagaaatggactgcaatttccctgatttttagcacatctgcgtggacattggagaccactgactgaatggattggtccagctgtcctatttttgcgctgtcctcatttggaggagaatctatcatgctgtttcatcggaactcatcgaataggaatggagttgaatatgttgtgcatgattcattgtcctgacacctaatagataaaaagtgctctctgtgttgaaattaattggataga

SEQ ID NO: 24381 - DNA, 180 bp, Oryza sativa
aggtggttttacaactctagactttgggaatattctcatcacctggacactgtgaaatggttggattattgtggaattggattcacacctccctctctattcaaaatcctcaaaagggttttaggctgggctcggggtgcatggttttgatagtagcacctcggccatataaggaccggt

SEQ ID NO: 24382 - DNA, 751 bp, Oryza sativa
tttcagtggcatataagagattctgcctagttgtatatagcagcgcggcagtattatctgttcagtaggcccgaactacaaaaaccacattgaatctagtcccatgaaagttttcatatttttttcaaaacttctcaagttgttgaattttccaggccccaaaaattttcaatacaacttttttctaaaaaagataatttctactacctccatattttaatgtatgacgccgttgactttttatctaatgtttgactattcgtcttatttaaaaaatttatgtaattattatttattttattatgatttgattcgtcatcaaatgttctttaagcatgacataaatattcatatttacacaaaatttttaaataaaacgaatggtcaaacattgatcgaaaagttaacggcttgatacattaaaaaatattgagggagtactatatctaaacggcgacgtggcagcgggtcgcgtgagcgtgaccaaagtgttttgttttaaaaataatttaatttttggaatgtttttcttaagaaaagttatcgatcgaagagttcgattttaaatcttaatggcataaaatttccaagatgttatcaccaatcatcccatggcataacggatctgaattaaggaatctactactaaaaaaaaaacttggccattagttaaccagtcgggtataaataggagcaagaaagcaaagagaagaggaaacagagcagagaagcagagcaaccatggccgcgc

SEQ ID NO: 24383 - DNA, 1501 bp, Oryza sativa
accctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcactgtactgcgttgcatgcagcgtgacacgcttgaccagactgcaattaatgctgttaggtgagcacagctgtgctcacttatcccatatatgtggcgcagacttccttaaagggtcggggtgcctcggccctcggggccggggcaagcgcaacccgaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaacccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcaccgagaaaaggatttgctcccttcctttcgccattgttcctcttgccttcgccgcctgagctctaactctttctctgctacgccctactttcgccacacgcgctcgttctcaatcatctcttcctccaccgcca

SEQ ID NO: 24384 - DNA, 400 bp, Oryza sativa
aaaagatgtattatgataaccgcgaagtaccatatattgcatttgacgttcacgtttcgttcacgatatcgttcacgttcgcgttctcgttaaggtcacgtttcattcacctacgtttgttcgttcacgttcattaaccggggtataatggcatttcacgttcacgttcgttggctcgttcacgttcgtccgacaacgttctcgttcacgttcattcaccttgttctcgttcatgttcgttcgctcgttctcattcacgttcgttggctcgttcacgtttgttcgctcgttctcgttcacgttcattcaccttgttctcgttcacgttcgttcgctcgttctcattcacgttcgttggctcgttcacgttcgttcgctcgttctcgttcacgctcattca

SEQ ID NO: 24385 - DNA, 339 bp, Oryza sativa
agctagttagatatgatacactgttagcgcaaatcaaagctagtgtgtggtcgatctgccagcttaactgaacgagcggatgcttatgtaacttgcaggctgtgcgttgcacatctttgtcgtttgttaactgacacgcccgggcaacgacgtcagttattctgttcctacatagtagtgctacttaaataggttgtttcgagagtatggattacttctaattaggtaacttcgagcgtgaaattctgcatgcatgaaatctcatgtcgagaaaactactgtatcgaaatagtatgcatatacagggaacaggatatctcctctgttcatacctacagc

SEQ ID NO: 24386 - DNA, 571 bp, Oryza sativa
ccgtaaaaacactggacattttgcaagcgtacgtcgcgcgaccgagcgagcggtggcaacaggcgttggcgccgcatgccccgcatgtgatgtgtcgcgccgcgcgcgtcgtgtgtgaccgatcgatcgatcgatcgcgatgcccacgacgggaaaacgatcgatggatcagcgagctactcactccatccctaaatataaaaaattttaattgaatgtgttatattttaatacaataaatctaaacaagaattctctatcaaatttattgtaataagatatgtcacatctaaccaaattctctgacggagggagtagctaggaaaaggccggtagtgtatggctgctgctgtacgcggaacaaaacctagccgaaattatcctagctctcagctctacgacggcgacctttgcccatgccctatgcggagctagctaggccggccgacatgtatatgagcattttggacgactcgttgttataacagaaatgatcgatctagcttgtcatgcatgttcgatcgttgctgcagaggacgacggggacactcgtgctagctagctgtaagca

SEQ ID NO: 24387 - DNA, 538 bp, Oryza sativa
  unsure (1)..(538): unsure at all n locations
agagcgatagtatctgtgaagatatagacgaacaaataggattgagttcngggtgacagagagaggattgtgatatatcagacaggttgagctagtataacatgcctacgaacgagagtatgagagattacgacgagaattcgtatatgtgggtgtgaagcgacattagagagagagtattgtgatgtctgaccagaaaagaagagagaaattatttttgttgagtagatcctcggggcgagaggattctatccaattgaagtcgtaggaagaaaagataggtgggagatatcgcataaagaatactatacaacgcctcttttgagttggggagaggaggtaggctcctctcgaaggtggggaggtagagcagaaacctaggtggactctcgggccgccaaaaaatatgtacagcacacctgttcttaaagacccgcccaacaaaaaaaaagccgtaatttgaattatattagcgcgtggagggacggccttaagaagaagaaagaaacccgccggcggccggtggaggcgccccaaa

SEQ ID NO: 24388 - DNA, 292 bp, Oryza sativa
gccgctcaccagcgccactgtttcttgatgctgattacggatttgtaattccatcgatcacgcatgcgcgcgctcttcttgtaattatctagagagattaattgctcgtcttgatcggtgtctgattgatcggtcgtgtgattcgtttggctgaggattccctggagcgctcacgcttcaattccgttttctgcgtgcagtgtgcgcggttttgtcgcgtcgtcgtacgtcgagaatccgtgagccagacagacaagccagtggtttggtgattcttgcggcggcgcggcga

SEQ ID NO: 24389 - DNA, 1501 bp, Oryza sativa
gttttttttattttatgtatttttcatataaaaaaagtggatgctgctagcagctaggtgatgcttccgtcacctgcaaattgctcgttgaaaccggctttattcaagtgaattatttgcccattatgtgcaggggattagaataatgctaggggatggtagtacaacgcttggtcggctcttacctctttgagagcagcagggttcagtttgacacttgcaattttatatgtaaacccccaagaaaaaaaggtttagtggaacagatgggaaatagctgaactgaggcagctaggcctgcactggaacatccctgatgaactatttaatttcttttaaatccagcaactacacagatacaatcatgtcttgtagataatacttctatcgaacggtacgcaggtgccatttgggcgaaaataagatagtacttctagagccggccattgtaaattgaacaggaacaacaaatttagcgttagttcatattaaagccaaattttatcacatggatactttgtaagagcgagtttaatagtatagcccactattagctccaattcatctctggccaatctaatagtcaattcgtcatataataattgcttactatactattagtatatggctccacccatcatacatacattttgtcttagattccgtactgcagctgactacatatatgtagcccgtagctcttatctctcatattttattttattaaaatatgtttgtagctggataatagtctgctattatacctgctctaagtcttaaaatatttcgatttagtcttctacagatatgagtgtacgcgcgtgtttatatgggtaggtgtacgttcatactgtgtttgtaatttaatccaccatcgagatcagctagcttcgttcgtccgtgagccgcacgatccacatccatcggacggtccagcttgtaaaatgaatctcactactctactcactccaggcacaacacggacggttccccacggagttaaaaaaccacacacacactgtacacacccaaagcccgaaaacccgttatctctcccgtgatgcggcgtggggcccaccaccacacaccaccccaagtggctgacatccacagctccgtgggcccgggtcccacagcctccctttcccctccccctccaagagtcaaatctccacctcccccctacgcccacggcccaccgacacgtgggccccacgacccagccagccagagtcccagaagttaacgggggcacgcgaacagagaggggggccccgcgcggcgaggtggggcccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagcca

SEQ ID NO: 24390 - DNA, 1501 bp, Oryza sativa
tgtcttatttgaaaaatttttataattagtatttttattgttatgggatgataaagtatgaatagtactttactcgtgacttatatttttatttttttaaaaaaaattaaataagatggacgatcaaagttagacacgtaaagccatagctgcacttaagatgggacggagggagcagtacctttcgatactttcataagaacagtaaagctattgtgacccaagtatggatggaagaaatggcagcagcagcaatctgcaggcagcttgttttgcatgagcaattcaggatatatgtgtaggattggaggaccatttttcctcttgccctttttttctgctgtgatgccggattggttggtgtgccatgttagagtaacatgccccctaattaggtggttgtccagtccagacacgccattaactgattaacagaaatctcagcgaatcgtccacatcctgcaaccgtacacacacacctcctagctcttgtctgaattccaattcgttagcatcatccttcccctcatggtccatctgtaccaaacatggccaattaggggatcaaatcgtgcaaaaacttgaattaaactgtggttagatatttcagagtagaccctctgatgattatccgggctaaccaatggattacggccatgtaagacagtgacatgtacgtactaattattaatttttcttcttcaatggcgacttgcgtgaggatgacagaatttgttcaagggtttggcagtctgcacaagcaacagttacagctacgtagtccttagtctcgagctgggaaaaaagtgcatacagtttcagaggaataagcaacagcttagcccacgatatatattcgaacaaaagtcactccacaatgatagtctgatctctgatgctactcatttcttttgaaagtagagatgctactactcatttggatgctgctgctgtagaacaccatgcgtgtgtttgagctagtaatgcaatgaaggttcagacttcagaaaactgtgtgtttacagtagtgtacgtactagtgttcgttctgcatgattgatgaatggattccattatctaaaaaaaatattcatgtccagtcatgaaatatattgtatcttaaaagaataagttctgaaatatatacaacatttttagataatagaaatggattacatctccggcttttgtcataagacatacaaccataagtttaatagatgattatattaagtttacatattttgaaatatgtacaacatgattatattgtgctgtaaaagtatcatttcaaaagatgtatacatcacagtctcacgtgtagtacttcacgttaaaaatgtcttattacctctacaattattatagattatctccattctttcttttttattaaagaaggtaggagacgttaaaaaaaggtacaatggaaagtatagttacattaacaacatgttttttagatagttttttttaaagtaagataattatatctgcataa

SEQ ID NO: 24391 - DNA, 1501 bp, Oryza sativa
gctcatatttgaaataaataattagagcgttacttataaatgtttcaaacaacaataaaaagttttctgcgccattattctggttgacgggcctgcaagtgcgcctcctgcaggcctaagaaggagtgccttcaagtccttctcttgcaatatccactactagttgtgcatacacatgtatagttacttggtggcaaataggagttagcaagtatttctctttgtgcaccgatctattatgggtgttgttgcaaaatccaacatgcatggcaagggcctccctccaaagggagggagctcaagctagatctcgtgaggagaatataagtggatgagagaggatgagaaagagtggaatgggggagagatccccctattgcctttggagagctccttttattcgtaagtaacgggaaattacatctttgcccttaattggctacatatatacaacaccctcttatgagtattttagtccttttatacaatagtttatacaacactctaagtatggggttattctccaataatgggcattgtaaacgaaactgaaataatcatatcttgaatccaagaataaaaactagctgaaacagaaaacgtaagataagaattttgtcttggaaactctttatccatgatggctggcggttgaaactctcgcattgtgagcttggagagggaggcatcaggaattcctaccctaccttcctttccaattgatctttgcacgccatcagcccacaatggacgaaaagcaagagtgatgccttcatggaatgagatactagaaagtcccattgtctcagcgcggtgactgacaagcgagggacgctgagtagtggatatggcactatattccagcgaatcatgtgacagttgcattctcatatgtattgctccctccgaaaaaaaaaaagatttctagtatcccaaggtaaatttagttagaagtaaaagtgaccaaaatgactatcattaataaaaaagatagtaatggtggtaggtaggtaaagggcattcaaggaataaaacttcttgttttctgtgctgaaagtactccctctgtctcataatataagggattttgagtttttgattgtactatttaaccactcgtcttattcaaaaaattttggaattattattattatttttttgagttattttattatccaaagcactttaagcacaactttttgtttttatatttgcaaaaaaatttaaataagacgagtggtcaaacaatacaaacaaaaactcaaaatctcttatattataagacggagggagtatgatgatagaagttggtttttttttaatgacagaattcaaactctagttatgtttttttgggacatagggagtaagtctatgtgatcgatcggacatacactgtaaaatcaaatgtgtttttgattattattctgtgatgaacaattgggtattggagattattagttttattatttggaatttattcacgaagtggttttggaga

SEQ ID NO: 24392 - DNA, 1501 bp, Oryza sativa
tttgcatgccatttggttggcttcctcgccttaaattctgccatcacatcaactcttctcgtcgtttctctaatctaactaccgccctagaagcaggatcaaaggtgagagtatgtgatatagagtggacacaacaatgctaacttgtacttcttgactatacagcattgtcaaccactagtgtcatagcatatccgctcctcaccattcgattgatcggttcggttggttaacttgtataagaacttattagagccagcacgaggcaaatatagatgcctactatcattattatttctttaaaacactgtataaaagcaagcgaacatcttttttttttagacgacgaatcacatcctcattaactgcgtgttcgctcgacaggtctaattccgtgtgatgtcccctcctggctgagttgccctctctccccctcgtggtagctggctccaggattagtggtcatcctccagggcctgtttacctgagcacctccgcatcggtttcgactccttggttctcctagtctcctggcagctgtagaaggaacgaaactccagggttttcgactctgcgctcgcttcggtcctggtggttctggagtccatccgctcagagggccagctgtgttctttagccggtgttgctgtttttagggatttcttgggagtgtagcgtggctctaccccctcccacgtgtttggagttgtgtttttagccgtcatagtagttcctagctcgggttattttatttttctttttctccctccccccttgggcataagctgtttggattcgatgcgacgtacaatccttttacgcgtttgaaaaaaaaaatgaacatcttcttattatcgagatctgctagatagcccgaacaactgtcaagcatcgccagatactttcttacttccatttatcaaatagagcatcacagctctacatactttcttacttccataaaaacctcttatattcggaacggagaaaaaaatagacgctgtactaaagctcttgtagctgtcacatcgcaggaaaaaaatatttgtttaagttggtacgaaattgaaagcaatagcaaaaatattaatggcatgttttcaactttctttagtaggcttataattattttaaaaaaacgaaaaagtcttttcatctagcaatttttgcatcacaagatggatcatccaggacggcagcagatgctgaaaagagatcccagtgcagggttcagacaaaggcagctttctcctcttctgctggggcaaaaaaaaaaagtttttaatcaggcgagaaaggcaacaacaagcgcaaagcacgtcaagatcacgccgctcgcctcctccgttgcaaaagacagcgactttataaaaaacagcagaaaaaggcgagacttttagcccccgcaacaactcgtcttcctcccctctccagcagcgtaggccagcgagcggcagcggcagcagcagcagttgttgttgggggtaggtgcgcctcctcc

SEQ ID NO: 24393 - DNA, 381 bp, Oryza sativa
cccctacccgcagcaacttgctggataccacccaacaaacatataaaaaaatcacgccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagca

SEQ ID NO: 24394 - DNA, 646 bp, Oryza sativa
atttgtaattagacttagcatgtaagattgtgtagggttctaatatacgacagttacacttagcatacatggctatttttgtcttagcatataatattattagagttttaatataagattattatatttgtaattagacttagtatataattattgactagctagggtcctataatatacgtcacctagtcttagcacatatcatcactatttgagttttagtataagattattagatttgtaattagacttagcttctaagattgtgtagggttctaatatacgacagttacacttagcatatatggctatttttgtcttagcatataagattatttgagttttaatataagattattatatttgtaattagacttagtatataattattgactagctagggtcctataatatacgtcacctagtcttagcatatatcatcactatttgagttttagtataagattattagatttgtaattagacttagcttctaagattgtgtacggttctaatatacgacagttacacttagcatacatgactgttcgtttagtcttagcatataagattatttgagttttaatataagattgttaaaacataaatgtctcatgacttagcagatgtttcctgtatgaacaga

SEQ ID NO: 24395 - DNA, 500 bp, Oryza sativa
aagatcatttcccctctattgatttccccggaaatgaaaaggggcgtctgtatttgaaaggagacgacggcaacgcggcgctagggttcgggcggcccacggcgcgagaaatacgacggccctgacaggtgggccccacctatcagcgggcgaacgcgcgcgcgcgagcggcgggctcatcttcgggccggactgggccagaagagagagaaggttttgggccgactttaggcccaaagccaaaagagacttttaaaaccttttccaatttaaattactcatgaaatgcaattccatttattaaaaatacctccttggctcaaataaatcccagaaaaatctaggaattatagagttaagcaaagtatttaatgaaattttatctggccccattttatattggaatttattaattaaaattagatcttctcttctaggcttttaaaataaattctaataattccaattaaacaacaatttatatatttaggatttttagg

SEQ ID NO: 24396 - DNA, 289 bp, Oryza sativa
taagcataaagataactgtgagatctatacaagatgatgaaaacctctaagagatggtagatacacgatataatctagattaataacgagatctaactctatcggcaacttcctaacaaaagaaacagccgatgacaagttatatagcgtaactaacagagattataaagtatatatgataactcaacgaattacatagacaagattagagtgtcataaagatggaagcactattcccgagaacgcaaaccgccatgacaagtttacctctagttgaagatcgaatcga

SEQ ID NO: 24397 - DNA, 1501 bp, Oryza sativa
tagtaatagaatatgtaaagataaggactcaggtattatgttaacttgtatatcaaggaaatatcttgtagttttactcggtgacaattgtaaaatatctatagaacttagatcgtaagggataaggtttctatcttgtaatcacgactcctctacctatataaggagaggtcggggggctccttgagggtataaccacccttcagattgtcaaatcaataacacaatcagcagaatatttccccggacaggagtagggtattacttctcatcgagagggcctgaaccagtataaatcctttgtctcataacccatccatttttacagcttgttcgctaccccctttagtattgccgaaatctagtttcgacaaagagctagccatacttcttaaagcttgcaaaaataaagaaggaggaggtatatcaaaaaggagtaaagtttagttttatatttatccactaaataggtcttggtaccaccatatattccacacacacatcttgcatgatcttgatcagaagtaataaatgtgaatagaagtatgactcacttgatccctaccaaactccacatatatgaccttagaatagggaccaatgcaataccttggtgaggaatacaattatataccgctgagggactgagagaatcatttgagcaacttgttttttttatttgcacaaatcatttgagaaaatctcctgaataaaagttagacaaggaatgggtgagtagtgctttactaaccgttctgtctctcaaacacccaagacaaggtgaagcatgatgcctcacagtttaggcgtatggttaagccaccgtgctggctgacttgattctggtaagggtacccatactatgcattttgtacattctagatatacagcattgcaacagctcctgatcaataaccaagtctttgtttcctttcatcctttactcgagacgagcaaagattcaagcttgaggggattgttgacggtcgttatcgactaatttcgaccgtcaatattacccaattaatgaagactagctatgcttgcaatgcataatttccaaataaaatatctacttccactatgtgctatgctactaacatatatgcaggagaagcattcataaatggaggagaatcgacgaaacataactgaacaattaatcaaaatccgtcgagaggtagatttacgggtggatgggcctctaaacccattaaaataatatcaattgggcccaactaatgcacttctgagctgaggaatcaacgaggagttcatctgtcgatttgtgggctaaatgggccagtctagggttctatcgaacccaaaacagcccagatggcccagaaattccacaggccggtagttatcgacatcccatggcagttgtgaccgtttctacctgaagcaaccgtcatggacacttggcacaaagaggtgaagcaagagggaatatgctcattggatgctttgagcatttccacactcccaaggcacctca

SEQ ID NO: 24398 - DNA, 215 bp, Oryza sativa
cccgatcggctatcgtttatggatttaaccgcggcttctcttgtctttattcttgttgattgtaggatcaaatcaactggcacgctcatgaacctaaaggcgagattttggacctgtacaggatttaagcagatcttccaggctagtgtgtgttttttcacatcaacacgcttttggcacgtccggtgggatcgagttgtgacaactttttctca

SEQ ID NO: 24399 - DNA, 1501 bp, Oryza sativa
ctgcatgcagcagtgcagtagtaggcagtagccaactggcaaaatgtgcgtacgctggcttcttcaattcggttcatccgcccgtccgccgcccaatcgccgatgcgtgtacgtgcgacgaggcggacgcgcgcgcgcacgcacgcacgcccgcccgaccggcgccgtcgcgcgtggctgggcgcgcggtgcattgcgtttgcgtcggtgtgtcgcgcgcgtgcatgcggtgctcgggatcggttgcgtcttgcgtggttgcctcgcaatgtcatcgagagcttcgatgcaagcgtggtttcttttctgaattccatgcacgcgatggtcgcactgctgcgcttgttgccacggctgttcgcctcagttgtaaaaagggagaaaaaaagggactatccgaaaaaccactacaagttttttaaggaagaactttcaactctaactacagtataattgtaatataattccactatagctaattataactataatactatctccgttttatattataagactttttacctttgtctacatttatatagatattaatgaatttagatataatatttatgtctagatatattaacatccctgtgaatgtgtgcaatgctagaaagtcttataatatgaaacaaatgaagtataagttatatataagtattaaaataatactacctccgttttttaatagatgatgctgttgactttttctcacatgtttgactattcgtcttattcaaaaattttatgcaaatgtataagatataaatcacacttaaagtactatgagtgataaaagaactcataacaaaataaattataattacgtaaactttttgaataagacgaatggtcaaacatgtgagaaaaagtcaacggcgtcatctattaaaaaatggagggagtatatgtacagtgcggttacactgtagttacaatgtaactacttcctccatttcataatgtaagtctttttagcattatccacattcatatagatgttaatgaatatagacatatattatgtgagcaatgctaaaaagagttttacattatgagtatagtataattatacaactatactatactatagttacttttgaaagtttttttcctaaaaaacttgcgagaaaaaaaagcaaccaggaaaaaaatatgactaaaatttttgtctatatgttattagtgctttaaaagttaaaaggctagaaaataggctacgataaaagaaaaatcctagagcaactaagtttcataattcagttacaggcttacagctttaatctaaaataatgtttcagaattcagttatggctgacaagccaacaagcagatgatatgagcctgcgcattggcaactgcccaggtcggttatttagatctaaggtatcttctgcatttgctagttcaatagatttcccattggcacaggatagcagcacaagtgcacaacacggcaattaagccccaaaaatgacagcaaccaaagcagaacagg

SEQ ID NO: 24400 - DNA, 208 bp, Oryza sativa
tgtcggcaattcttccttttgcatacatacatattatctgtcccatgcatttgtttcttcaacttgctttccaattcatttttttggtcaaaagcccatggtagttctttttcggctatgcgtgatttgagctcaacgcatgcagacagcgagtccgttccatgcggcacgagccagactttccgaacgtctctgttatgtttttagg

SEQ ID NO: 24401 - DNA, 658 bp, Oryza sativa
  unsure (1)..(658): unsure at all n locations
agggggagaggcagattgatccggaatagagagtaaacgagatggaatagcgagcttggaggaggatgagtagagcnaagataagagagacggttggaggaaggagaatagcacaaaacgaaacggagggttataaaggggagggcagacgtagaattatttagtgtcctgatcggaatagtgtgatataagacccatataagaagagaatacaagtataaaacattcaggagcaacccggcagtgtgatgtatggcctaaattcgtggtaaacacagaaaaagtgaagggcgagagaatgacatttccgcaaataaagaggacaggcgaattttccggtgtgcggttttgaaaaattattttgtgggaggtttattgctttaatttaaggaaaataaaatagtcgtaaaatataaaagaaagtgtcaacggaatggagaaagtcgctattttgcagaccctttcgggcaagaggacggttccaaccccatgaaaaaataggttttggcccccaagaaaaaataagtttttctagtggtgcatctaatcaaaatagcattccaaaatatgatttactgtgtatccgctaccaagccgggtgttgtcctctcggctcccggtatcgccggttgatgcatccgcttatggaacacaaaca

SEQ ID NO: 24402 - DNA, 1501 bp, Oryza sativa
gcttctcctcggcctgcaatccaaatcccctttattcctttcccgctctcttgcgcttggcgtcagctgttcttaaccttgaacaaattagggtgtcattctagttgcacgtgttcttatccagatgttgggagtgcggtgaactgctgatattctactaaaccgatatcaattatatggatgttcaatttggttcacgtcactaggtaaatgatttcccaccttagaccaaacttaacggataggaaagaacttttggcaagtggcagatccaggtagtttttttccttccctttttctgtaattggcagttacttgttctccaaatacttggaactgctgtgaaaagtttccaattgagccttggaatcaggagcaatggggaactcttctaagttacttgcatttcttctttaaagactcagaaataataagcaagaaacacacatagatctggtgaaacttgagttagcgtgcagtttttaacacctccatgtaccaaggggattcaatggtaaaggcctcatccccttgtcttatctttacttcaagactaaatctgtagctggggaccaagtaccatagtttcgcaactcttatataatccactaggctgctgtgaaaacaatagatgcagtgtttgttttgaagtaagtaaggtgaaagtaaaaatacctggtaatggctaatatgaatcgtggctattattaaatgtttcagcattttctgaataggtaaaccacatatatgtaactatgtaagatgtttttaaatctagatgttctattgagcctgtaacctggtcttttagactagattatgctgagactttgaagaaaaaaatttcagtacattccgtccatcttggacaacctttggacagattattaactctgaatcagtcccatcatgctgcacatgttggatatttcagagtggaccataaagttgcaggcctagtttgctatttttagattttagatcttgtgagttttaatcttgatcatgctattagactcagaatgtgtgtaccaaaaacattgataatggtatctatcctgacttgggtataacttgtgttactggcagctgtgggagggctatgttggcgtagcgtactgaccaagagataatcctctcatcaagtagaatatagagagtagaataattatttatgaaggagatgggcctttatctggctgcagacaaggtgcatagtaaagctcattaaacctctaaaaaaggctggaaatacggcctacggtgtaattgcacattatacatcagttagctaggttggcctccaattttatatggcactttacccttggatgcccatcttatgtattgccatgtactcatgtatgcaattagtcaagaacggcccacttatgccaatatctgtgtaactatgcaatctgttattaccttcttgcacatttactaatttcgctttgtcataatcaggcccaaagtatttccaatgtcgagccctccacct

SEQ ID NO: 24403 - DNA, 716 bp, Oryza sativa
  unsure (1)..(716): unsure at all n locations
tggggccgnnttttgaatgcgttcgctngccctnaagaatctntaattttacgacacccgaacactaactggagtagaaactaaagaatctggggttttttcaatagcccatttggatttaaggccccgggtggtttctatgaaaaggggggaaactttgtagaattttaatcttataaaaaataattcctatgggggccttcgaagtaaatgattgaatcatatcatatgctttaaaattcctatggaatggataatccccatagagattttggagaaagttagcaagaggtccaacctcattgaaaaattcccttgagtctatctctctcatccgatttctacgtttttcatatgggctaatcaaatagtcatccctatgtttttttctgtatttttcaatcctctgttttacacatgcattcatgttagaatcacgtgtttttcctattcctctatttttccattcatgcgattcaaaggggcccttaagaaagattcataatgcgatctatgtttgtgcttattgatccaactaaccggcggcaaggtttttaattaacatggaattcccgggaatgctcaataattagtacatgcacaattgatccaatatgttgcttaaatattagatattagagcaagtgctatgggcatctaaacacaaacctcaagatgacaaatatgactaaatggtaaggtggaggagagaagaa

SEQ ID NO: 24404 - DNA, 1501 bp, Oryza sativa
gaggacgcagggaatgtagcggttcagcaccggcccccgcggctggaagtagcagccaccaaccaccgacggcggcgacaccggctgtgcggtgaagaaccaccggaacagccgaagggatgggcgcaccccgatgaacatctcgcacaggtgcgcgaagatggccaatgtcattaccgcgttgggggtgaggtgcgccatctggagattgtaaaactccagaacatccatgaagaaagaagaaaatggcggaaccagccctgccatagcaaaagggaggaagaagacggaccgccccgagtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcaaaggtagggcacaggaaacaaggagttagggcacaagcggcgaagacaaggggaataatggcgagaggaaggaagcaaatctcttcctcggcgactttatacccttgccaacgctaagcccggctcctcgtttcttgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccagctcgtcccgattcgcgtgttactcgagtaatgtggcagtcttgaagagactgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtattatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgtt

SEQ ID NO: 24405 - DNA, 1501 bp, Oryza sativa
ccgccaccgccaccgccacctccaccacctccacaggcggggccaccgcaagcactacctccacagacggcgccaacgccaacagtaccgcctcctggattggtgagccgcttccgtccaccggagctatccatgccatcggcgcagttaaacacgacgaacgccacgatcgctacggtcgccacgaagaccagcgcaatgccgacaacactcctgctcatgtcgggcacggagccgccgccgccgccgccggcgaagcctcggccaaggccggcgtccacggcgagcctaaccattgtgatatatcgatcgatcgagctgccgcttgttggctgtgatatatcgatcgagctgccggccgcttgttggcgagatcgttcgggtggtaattatagggttggagagagctagctagctggctatactagcttatcttcactgacacggaacagcggaactggccggttgaaatgtcttccatcgagtggtgcgaactactccctccgtctcaaaatataacaactatatacataatataacaactatatactagatgtgatacattctaccctgtccagattcgttgtactaagatgtgtcacatctagtacattgctatctatattttaggacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcaga

SEQ ID NO: 24406 - DNA, 1501 bp, Oryza sativa
cacgtataacaataataaatgtagttgtattagacttggagaattaacatggatgcatagattatacatcaaagtgttggagaaatgaagctgacatgcaaagaaatacactttcggcgaatcacgtgcgagtacacggattgaggggcccacaagttagctcaaaccgattcaaagtggggccaaccacccggccgggaaccgactaagtgccccacctggcggtgaagagaggcggtgccaagggttcggctgaactgacattgcggtgcctcatctccacccattggctcctaataacagttgtggatgcttaatcaccattgaaccttcataagctgcctatttaaaagctcacttcctcactttcagcgcacacctcaaggagaaattctctctatttcatattgtattctctatattttagtagaaataaagcatatgagttttggcgctatagttttctctgagagtcgggtatgtctttagtactatactcttcttgtaagactatagttgaattaaatgaattatcttacttatttgattatgctcatagtctatgtatttctttattgaatatatgttctatgagtagtatatactttgtgatgaaggcgatgcaatgagtggcaaggagacatcgcgatgacgagcgatgagatggcgctaagtggtgatgagtggctttacggcgcagaggagcaacaatagccgccgtctttgccatgaacggccgctgtgcgcctgggatagggtgtgggagattagggaatctgggtttactatatacatgatctgcttacttaactcaatgggctagttgggcctatattattgtaatgtactatttttagggaggtaactaccaccccaaggccccgacgggtctcccacatggtgaaattctcccccattcctaaccccatattgacggttccccggtcccaatggagaaattaccacccctaggcatccgaatgtagttgtccttaataagagtatgttttctggtagaggtggatactacttgtaatttcatgcataccatatactaataaatttagagctaacatgtattagattgtctctaacacacaatctccaataactctaacactctcacatttttattggagtttgtgtatgggttaccccttgcatgaggggtggctctttctgtctctccattcttctctcctccaccttaccatttagtcatatttgtcatcttgaggtttgtgtttagatgcccatagcacttgctctaatatctaatatttaagcaacatattggatcaattgtgcatgtactaattattgagcattcccgggaattccatgttaattaaaaaccttgccgccggttagttggatcaataagcacaaacatagatcgcattatgaatctttcttaagggcccctttgaatcgcatgaatggaaaaatagaggaataggaaaaacacgtgattctaacatgaatgcatgtgtaaaacaga

SEQ ID NO: 24407 - DNA, 342 bp, Oryza sativa
tatatacccaattcaaaagagtatgaaactttttcaattacttaggtattaacattaactactttactaactaatttaaagcaagtttgaactgaatttgaacttgtttttgttagagtttgattctaggtctatagcatccatacatataattagataggtatgtaatcatggattgtgaaagaaagagaaatttgagttgttttgctgataagtatatgtatgaatcaaattattataattaggtatatactcacaatttaaaaattttgaaaaatgtgagtgattgtgtgcatgagataccatggtgcccgggcaccctggcgccccatatgagtggca

SEQ ID NO: 24408 - DNA, 1501 bp, Oryza sativa
tgcatctcccgttctccctcctcgctccctctcctctccttagctctgggtagtagtgcgagtagccttccaatagcaagctggcaccgtcccgaccgccgccgctgctcgccgtaggctcgccgccatcgccgcccaaactcggtagtagccgctcgtcgccggccttcctcggtatagctccacccaatccgactctagaaatgaactcaggaggtcgcgtagatgctcaagtccctaggaatcgagctctcgtcgcatcgtcatcgtttccctcttttgccgccgccggcaagcgccgccgggattcgtcgtcgccggcctccctccggcgaatccgatccggtggctcactccctctcgtccgtcccattgttcagatgtactccctctctctcgaatcgtcgcgacgagctccggtgaactccgccgccatccgccgtccatcccgggcgcctcctcctccttccctttcgcccctgcccgcgtggccgaccacgtggcagcaacctcagccccgggcccgcttgatcgggtcaagcacctagtcagccgcccccaccgccctttcttctgtgcgcgcggtccacggagagcccttaggcttcgcatgggccctccacctcttggtccacccgcgtgccacgccgtgagccgcgaccgcaaaaccctagcaccccgcgccgcatgaacccttcccccgtgcgccgagtcgctgactcgtgggcccgtcccgggacccggcacgatggatccggtccacccggacccatccccctctctcctcccgcgcgcccacccgcttgggccgcgcgcccacccgcttgggccgcgccttgcccggccatgggccgcttcctcgcgcccgcgcccggcccattagctcggccgcgccgcgcttattccttgggccgtacccgagccgccaaaggaagtctaaatcccatccctccttccttttcttatccaaagggattaataaatccttttccctttttcataaatcaattccttattcccaaaattccataaatcatttccttggtcccgcacgtcagtgacggtcaataatattcttgagaatattatttctataaatttcataaatcaatttccccttttccacaaatatcttcctttgcccagaaattccaattaaacttccaaaattcatatctctcaatccgtagctcagattgactccgttcaacttccagtatttccataaaattgagatctatttaatggcagtactaattagtctaaataggatctttcttttggtcttttgtttaggtttttgattgtttgcgtatagttacggttaccagattttcgtcgatcgcgagttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcg

SEQ ID NO: 24409 - DNA, 864 bp, Oryza sativa
tagtgtgaagttgtaccacatatccgtttacatccccctctcctggcctgtttttgctcttctagcgagggtccctttgaaatacaaggaaaaacaaaggaaccatttaggaatcactaggaatgagcaaaggacaaatgtgggatattcttctttccctgcgattatagaggaaaatgggtaggaaatttaacgtccactccaacatcatggtgaaggcaaatcatctagttgttacagacttgttcgttgatttattgtagacatctgacacaatttacaccaataatataatctagaggaatttacatgttttttctacaaccaaataaatgcatagttctacaaaattcccatgttttttcaatagtttatttcacatatctgttcctatcttattcctttgtttttcctaattttatataaaagtcttgtgtttcaaatgagccaaattatgtaattttgtacatattaatagtttctctctacatataaactttccgaaacatgtatagtgatgcgccgaacgcatatagcactatagaaaaaggcttttcccaggcggccaaatcatattttcgcaggcggacaagccatccgcctacacctcaacgcctgcgaaaatagttgatttttgcaggcgggcaacacatccgactgcgaaaatagcttcgagtgctaaaagaaaaatgggcagccaccgccggacggcggtagcttcccgttcccaatccattcccgaatcaccgaatcaattgtggcaaagaaagcaaataaagacattcaaaaaaatcacggccgccgcctagccgtcgtccgtcgccgccgctgcatgtccgcgccacgccgtcgtccgccgctgca

SEQ ID NO: 24410 - DNA, 313 bp, Oryza sativa
  unsure (1)..(313): unsure at all n locations
cagcgtttgatatgtagattcccattcnaanangccngcaggncgactttagaggatccccaccaaaaaaatgaattggaaagcaagttgaataaacaaatgcatgggacagataatatttatttatgcaaaatgaagaattgccgccacataatccccatgcctttaatttctacatagatttgtctacacatattccgtaggcaaatcttggtcttccccaactgactactattaggaaaagtgggccatcgtgcagtgtgtaattggagcgctaaacattcttcagttcacctatttatattttggggaa

SEQ ID NO: 24411 - DNA, 1501 bp, Oryza sativa
tacaattatagcacttcatcttcggtgaccccaaaaggatatcgaactcagcgaacgtgtgtaatctacttaaggctaagactatccaaggacaacaactataggtaggctggctaggctagagaggactttctatgtgttttaattatctaagctaagcaaaggtaatttcctatctgttgcttcgggcaccgacccctgctggtctgccagcctggttccggctatagttctatgatgtatccgaatgtggaggattactaggacgggatttagggctatcaccacctgtcgcctacctctgacaaatccgtgggatacacaacaaacaaaggtaatctctaacctaaacactacgtctaagttattaattactactctaatatttgtgcaggaacttcattcattatccagagtcctagtactagagcacttagtatgaatactaaccaatgaacccgcaaagatgaaaatctatcttacttagacaaagtaattaaataacataagaaaagaacacgaatgcttactttattgaagaagtttttctgaacccagagcagagtgtaccgacagctcaggtactcctcccgaattccttctaggaagctattctcgtcgaggtagaagtcggatgagcgccaaacttccgagcactcctccagagcttcccctcactctatacctaattctaatgtacaaaagatacaataaagcctcttgtaattcagctcaaagttgtgtgtgcttgaagtgagatggagacctccttatataagctctaaatgacggttaggggcatgggaaatgaccaaaccaccctgtaaacgccataggggagaaatccaagccgtccacatgaaaacagatggcggaaagcgccaggatgggttcggctgaacccaaaaacactcctcccggcctctccttcggccgggaggttgcttaatggccccccaacaacctatgctatgttttggcccaattctaaatggttttcactgacttattaggcctccaatccgtgtaaacgtgtcctgaatgcactgaggtgcattttgtcgcatgacggatgtgttttctcctcaaattacatgcatacacatatttcaccaacactggtggaaatgattagtaataatccctaccactaagttggataccatgttttatttcattatatgcaggtattgacggtcaaatattatgatttaaggaccgttaacaaggatcataaataacatccaaatccatcatatatgcaaggcaacaggaaaatgctacaaaaaacaagaaaaaattttaatcactctattggtttagtcaatagagtcccacaatggtgttatctactggtagtattactgatattatgatactactagtagaatcgatctgaactctcggttcataagggcgtattagtactttacaaactcaatgtgtcagggttacggataaggtataccctctacccttggatatacgctatgcgtcgata

SEQ ID NO: 24412 - DNA, 304 bp, Oryza sativa
cggggattgatagcatctggaccattacaggtatcgtatttctttaatcccagggaagattgtaagagataactatgctaataatgtatacatgccacttgtataatcaaaatctaggcatggggttaagatatttatttgggtagagtgacatgaagcaaagcacttatatatctcattcaatctttcctaaactaagtggaagagaaatagaagaacaatcaatccctataattctagtatacactcaactttactttacacctactagtatacaaccatatagccaataccccctaacagt

SEQ ID NO: 24413 - DNA, 1501 bp, Oryza sativa
ctacagagggtaagagagcggaacgaaccaggccacatggggctaatctcggagaaccatccagggatgacggcagagatacccgcctgctcgccggcaccggccgccgccgcgtcaccgctctcccgcgccctcttcgccgccgcctcggcctccatccgagaacctatccacgcacaagaggcacatagagcatcgccatgtaagcactaccaccttaaagaaaaaaaaaagatgccgcggcgagccgcccctggaggctaaacacgacggctttagacggagaagaggagggatgaaggggagcaggcatccagacctagagcacggcgaggcaacggagacggtggcgagctcggtggctggcggcgggttgggggagagacgggaggagcgctcacagccgcggccttgagattagggttttctcccctgtctctcttctgtggctttttgggggttttgggctgcaagtcgcatcaataatacgagaggtcggccgagcgacatattcccaagcaggggaacacttggtagccaggcaagaggcgtccatgacatgtggggacattttggcgtgggtcccacttgtcaggctatgggtggagggcgtttggctctatctgcgcgctggcgactgggctggaatttttttgagaattaatattatttttatggaaaatcgcaaaagtagtggccaaccggggaaaatcacgaaagtaggtccctgtcgaacgggtgcaattcgatagggcacctatcgaacgacgggcagtcgacaaagccctgtcgaacggctggcgttcgacacgctcacctatcgaacggagggagttcgacagggcccaccacccggcgccgcgaggcctgtcgaaccgggggcgttcgacagggccctccaccgaccctgtcgaacaatgggcgttcgacaggccggtttaaagccccgtccacctaggccgcgagttcgatttgttttgaggaccacatcgccagccgccgccgagagtcgccacatcgtcgccgtgagcgccggagggagcgaggagaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggtaatatagtataagttgtaatagggtaattatcgaatgattaaatgattaaacgtgagactatttgtcatgttttatcagga

SEQ ID NO: 24414 - DNA, 1501 bp, Oryza sativa
aggaatcggcccaaaggcagccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagttgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcaacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataagaaactcgacgcaacccctacctggcgcgccaactgtcgaaacatgatttcggcaataataaaagggggtagcgcacgagaactaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacaagatagaaaccttaaccaatacggtatcggtttcctaaatctggactttaggctgttccgtaatatacaaggaaacgt

SEQ ID NO: 24415 - DNA, 1501 bp, Oryza sativa
ctcctttcaatttaggcttacaaacctttatcccaagccgctagggactttttgtttgaattcaaatctgaatccactttttgttgctccggtgcaatatatgattaggaaatggtcagaaaatgtgaagtgcactgctccaactgaatgcacttctttgattactcgcatagcaaaggggcttggggttctttctcatgatcagatagcttacatttcagcccatcgtacctatgttgatgaatcttacttagtgcaaggtcacatacttaagcatggagtagatggctctctcatattctttttcccaggttgtacaaatgaaatcccattacccaatccagggtatcatttgtacaactgtcttgagctaaccattcccctatagacgttagaggaatttcgtctaggtacgatgcatagggagccatgtaacatggcaagagaagagcatgaaggatcaacgtcctcaccaccagtgcagatgtacgaggctgactgggaatagggatgcaaggggggcaggcaagcgggtttttttagcccacttatctcacttctagttcattttttcttctaaattttgtactactatgtggaaaatgaactagcaagcgggtttttatgcgggtagcaggactacccacttgtatccctaactgggaaccaaccggagacgctcccggatggacccaagtaccacactacaatgccggaggttcagcctggtagagtgctagtgaacaccggtggcaagtgtctcaagacacatcgtatgggaactcccgttcttccagcaccagtggcatgctgcgaatctccaagatgtggcgcttcaattcctctcgaggggtcttgggagagctcactaggagaatggacgcactggagttgcaggcgggagaaatctagcacaacctcgaaggacacatggcccaaacgcaagaatggcagcgaaatgctgatgttcaattcgccaacatcaacaatttgatgcagcgacagcaagttgacctgcaggcatactttcgcttccaaggattcaacccctattagggaccctaagcgaaaagcaagcttgggggagatgcctctcccccactgaggtaacttgtatcacattgtatatttctttcatgcactgcatttataaacttgaaaacaatataaaaatttgcaaaatagaaaataccgaaaagataggctagatttgtatgctaggtaagacaacctagttctgcatgttgatatgatgaatagttgctctgttctatatctcttatgtatatgctaatagttaagtattctctcaagtttaagtaaggaaagccaaatattattcgggaacctgagagaagtaagttgcacattgcatgatctaagtctaggttgttgtgagatatgagatagtgaaatagagttactatagccttactccaaagtttgacttaaattccagataatttgtttttcaaaatgataaaattctaaagttactcat

SEQ ID NO: 24416 - DNA, 1501 bp, Oryza sativa
cccttaattagattagaaaatatataactgagatctagtgcttcaaatggaagaaagaaaaccaagcaagattgaattgccacccatttaataaatttgcatctacctacagctgacgttgcacggaaattatatggaacaaatgaacaatcaacttccaagcgagaccagcatggaaggatgcgcggtgcaatacaattatgatgaatggatgattttttttttcaaataagaattgataaaaatcgtaaaattcaaaattgcctctaatcattgtgccgacgggggatacccgtagaccgaatatagagggtattagggtatgctggtacgaggatctacgtagtacgacatcaaggaaacaaaaaacatgaattatactggttcaggcctcttgataggtaatagccctaatccagttgatatgggattatatagtggaaaccacagattacaaagggaatagtagaattcgatgataccgacgagaccgtagtcgagttggttcaactagatcacccgacaacttggctcctgtaggctccgacttcgtaggctgtggcggttgtattggcaatgagatttgatgcctttgatcctccccgggggtcccttttataccgcaggtcagtcggtttccaagtaggactcggagacatcggaccctacacgatacagtgacgacccagttctatccgagtaggaatctttccatctgtggactccatgatggatttccttgcgtgtacgaagaacgtccgtatacgcgcagatataccatatcgacgcatagcgtatatccaagggtagagggtataccttatccgtaaccctgacacattgagtttgtaaagtactaatacgcccttatgaaccgagagttcagatcgattctactagtagtatcataatatcagtaatactaccagtagataacaccattgtgggactctattgactaaaccaatagagtgattaaaattttttcttgttttttgtagcattttcctgttgccttgcatatatgatggatttggatgttatttatgatccttgttaacggtccttaaatcataatatttgaccgtcaatacctgcatataatgaaataaaacatggtatccaacttagtggtagggattattactaatcatttccaccagtgttggtgaaatatgtgtatgcatgtaatttgaggagaaaacacatccgtcatgcgacaaaatgcacctcagtgcattcaggacacgtttacacggattggaggcctaataagtcagtgaaaaccatttagaattgggccaaaacatagcataggttgttggggggccattaagcaacctcccggccgaaggagaggccgggaggagtgtttttgggttcagccgaacccatcctggcgctttccgccatctgttttcatgtggacggcttggatttctcccctatggcgtttacagggtggtttggtcatttcccatgcccctaaccgtcatttaga

SEQ ID NO: 24417 - DNA, 1501 bp, Oryza sativa
ccattccacttgattaatcggttcccagagcctttttcattttctcggactcccagagtccagctgcccagtagcacaacaatccgcttccactcgggaagcctaatctatgatgcccatagacatcccgaattacacagattcgtttcttgaccactcaggtcgtccatctgccacataggctgattctggtaacgattcccacaccacaacaacttttcacaaagcataggcaaacaaatctacgctacaggaaacacctcacatccgcccatgaccgcgggcacggctgttcgaacagttagttaacctatgcagagggggtacactttacccacacgacattactaacccggatcacccagcccgtgagatcagccacgtcgggagaccttaaggctttcatgacaaggcatttggaaagccgacacaggttcaccatatgccaacgagaggggtcccagaccaacactagattaggtcccagaccatactgtgccaggaagcccgagggttctccccgacaccaccccgttgaatccacatgtctcttggcatcatggctcccccgattaactaattactcagccaggggcgtcccattgcacccgtgtggtcgcacttgttatatgctcggatgaatttcccacaggaatcggtacttatatgcgaatacgggacagtgccacacaagcacaacccccgcatcgcgagttttcacaatccattttattttccaacacaccgacgccacatgtcgggttttcaaggcttctcaaacccatttcccaagttttcgacaaacaacggtgtatgtgggatatttggtatatgcgctcagagagcacggataccgaggtaccacaaaggtggagcgacaaggaaatcagggtagtacaacctacaggaattagtgcgactactgggtaggtccgtcggtttggcacgcaaaccgaggccaagcaagttaagtgtgtgattctaataatgcaagttgcaaacaaaataataatgattttccaattataggagcaattggtcaaagggtgacttgccttgctcaaggtcttcacgaagcttcacgaatcttcgagaaaactcgcgatcgacgaaaatctggtaaccgtaactatacgcaaacaatcaaaaacctaaacaaaagaccaaaagaaagatcctatttagactaattagtactgccattaaatagatctcaattttatggaaatactggaagttgaacggagtcaatctgagctacggattgagagatatgaattttggaagtttaattggaatttctgggcaaaggaagatatttgtggaaaaggggaaattgatttatgaaatttatagaaataatattctcaagaatattattgaccgtcactgacgtgcgggaccaaggaaatgatttatggaattttgggaataaggaattgatttatgaaaaagggaaaaggatttattaatccctttggataagaaaaggaaggaggga

SEQ ID NO: 24418 - DNA, 1501 bp, Oryza sativa
atattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaattccagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcgga

SEQ ID NO: 24419 - DNA, 1496 bp, Oryza sativa
atggacttaccggctaatgatgtgatactctaccaaatatgttcaatgcatgtaacagtattccaatgtttacagaatcaactacctcttggatatgggattgtctaaaaaaaatgtgtgctcgatgatctatagattctcttcacttctgggttacagtattgaacttgttatgaaaccaaagcttgaatttctgttaagaaccatgaagaagccacttaaagctgttgtagaatatccaaggtacttcagttattcactggaagggaggataaagccgcggttttgtgtacttcagagtagaaagatagactgcagtctgacagacatgcttgcaaaaaatgatgaactttttgctgaagagtacctgggagtaggaagatcacttgagacagatatacaatcaagcgaaggtgtctagttttggggctcatatcaagtgttaactgtgttacaatacgtatgttaattgtacagcagcgtgcttccatatgaggaaatccacttctgcagtgctcaagcattgtgaaggtaatacatgactggtaaattgctgtagaaaaatagcttgtacagatcgaccgttgtatgtggacgttttcttattccagcaaggtgtgtttagagtggcacccaatgtatgtatataactcacagaacataattagacatacatgttaatttgtttctcatgttgttctttcaggtctggaatacagataaacaagggggttcagaaataggtggtggataacaatctgcagcagaaagttcagggatgtttgacacctttgtctgaaagccaatatgaattatcacagccacaggccacaatcctcaccaggttcatcttttgagcaccccactggccatggtcttttatcgtcccgttctcaataaattgaaccctctccaatctccatggcctcgacactgttcttcgtttgcacaagttcgaggccttctccactgggatgcccccttaatgccaccagacagggtatgagggtaaactgaagttcaacccttacaattctgcaccagctgatcatctgatgaaattttgcaaaatctgcaattatcaggattgacgagagaatcaaagacctagcgtttgaacagttagttacctgagcgagttgatttgcactgttccttgaacacacaagtgccaatggcagtatgttgcatcttcatcccctgcaaacctacaagggagaaaaaaaatagttggcatgtattaatcggaatccgagtctcacatgtattaatcggaatccgagtctccgactcggatttgtactagctctcctcctataattcacgcgccaccgcttgcttgcattgcatgcgttctttgacacaaggacaacgtcgcagattcgcagccaaggacgtcgtccgtgatggcgctccgaccaccgcggccgtgtccggccggcgtgcagcagcggcagcacgacgtcgacggcgccggcaacgccaagacttccccg

SEQ ID NO: 24420 - DNA, 1501 bp, Oryza sativa
atacacactgcttagcttgagattattatagtaaaactatcaagccctaataactttatgcccagtctatgaacaaaggatctggaatgtagatgccagctagttagagggaaacttgtatattgccacaacatttcccggttagcaccttgcacagttgcacgttaatgtgaactgtaaggcattgctggttgctaaagagaagaaacactaatccaataagagaaaaagataaaatattccaagtgtttatacatactaacctccccaactccatagctgaccatctgaagtcagagccatagtgaaaaaaccaccacaagccacagcagcaactgaaacaggcagagcgttcaccttggaaggaacactgagagatccagcttcaccaggaccacctccacttccaagccccaacctaccatcgccttcatcacgaccccaagtgtagagctcacctgttcacaaaagccacaagatcagggctgaggcggtctgacaatcacaaaatgccaatattccaaagcattcaattgtgaaaggcagtggaagattatccacaatgtctttcaccctttcaggtttcagcaatcagcattaaccatgaactggaccaacctgagtcagtgattgccgcagtatgtgctccactggtagcaatgtgtgatatcttcccttcccaaggaccattcactttccttggcaacaattccctatggtaaacataatgccccaaagcaccaaatccaccataacccctgcagactacagtaaactgagtgatgcagcagccaaatccaataaatttgcaatgcattcttcttgcagttcatccagcgagcactcactcactcaagcatctattattattattattattattatctaatcacaccaaaaggaatttcaaatgagcaatgtggtggtggtttcctcaccaggtgaagacttccccggaggcggtcagggcggcggagtggatgccgccgagcgcgaggacgcggagctcgctgaggttggggttgtggcgcgggacgaaggcggaggactcgtccccgaggccgaggcggcccccgtcgcccttgccccacacccaggcgccgccgtcgacgacgaccgcggagtggaacagcccgcaggagatccccacctccacgccccccgctgccgtccccgcggcggcggcgtcagggaggcgtccgggcgtgggggagagcaccggcgcggggtcggggagggagaggtgcgcgacgggggacgggtagaggcggcgctcctccttgccgccgccgagctgccccgacgcgccgcggccccaggacaggatggacaccggggtggtgccgctcgagtagagggttggcgtcgcgctcgaggacgtcgaggtggagaagcagcgccggagggggaggaggaggcggcggaacattgccggcggcggcggcggcggcggcggccggttggttcagctgcgtgacacgaagactactagaactagacg

SEQ ID NO: 24421 - DNA, 1501 bp, Oryza sativa
tgtctatttgcttcatctgaatatgtttctcaaacgaaatgaaacctgtccccagtaatggctaattgctgccatcattccaaggatggatggtttcaatctcatcgaaacttgcggaagaaacgcttgcaccattagtccattatccatcagacactagctagtacactgctgctgctacaagttggtcacagccgaagacgatgctggagtgttgcttattgtatactactagctaaatgtataggcagggaaagcgggcgtgtttctgtgcaacatgtccgtgaatcttgtatttttctccggggtgcgccttgggtagcggagacagggaaagggagacggcattgctgccatgccatggaggtggagggaggtgaggtgcatgctggccacaagctggacgcaacgagaccatgtgagaaagctttggatggtagctactctgaatatgcgtgcaagccgagagggttcttcagctcactgcagaggagacgatgctagctgctgccccagtagccataccttagacctggtgcacgcacgcgacctcttttttctcgctgctcgtatacaatgtacaattatacggagtacaatgtatttttttcttcagatgtacacttatacagtgctatagtctacagtagatgtaccctagttctgtggctttgtgctgctatctggtctttagttttcgttgctgaatcttacaagtaaagttgttgcagtacatcacacggtgtcagtggcaaatgcacgtagtaatcccccaatctagctaggttggctgagtcagccccgcaccaaagctgatcagacgccgcacaaaaaaaaagcgctagaaaaatgtttcagttcatcgataaccggaaaagggaaaaagatattccgtcccatctgcgcaaagatcgtaaccacttctatgattccggactgtttagatccgctcgtatcaaatacttgacacatgtataaagtatcaaatataaaaaaaactaattatatagattgtatgtaaattgtgagatgaaatcttaattgcttcatgatttgataatatggtgctacagtaatcatttactaataataaactaattatgcttaataaactcatctcacattttatagacggaatttataatttattttatattaatctatattcaatacttcaaatgtaaatgtatatccctatacctgatgtgatacacctaaacttttaaccgaaatctaaacacagtctctatctcgattcccgccgtaatgtttccggctcctcctcccccacatcgcccgttttttcctttgttttctcaagctaaacccctgctatatattgccacccgaactcccgcatttttctcctcgctcccgcgtcccaccaccaccctcaaagcagaccacacactgtgtcgctgtcacacacacaccgggccgagctgagcctgagcttgttcggcgatggccagggcggcgcacggcggcggcggcatggggc

SEQ ID NO: 24422 - DNA, 485 bp, Oryza sativa
tgtggcacgtggttacacgtgaggaagatgtgtcttgtgggtaaagatgtacacctctaatcagagtataatctattcgaatagccgcgccctcggttatgggcaagccgagtaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcatgtgggttcacggccttgataaataatattgcatagttctagaatcgtgtttacaaaatagctttgagcaactaagcatctttaaatgctgtttactgcaaccctaaccctttatattataacccccttgtactcccttgcatttattatgcacttgtgggtgtgtcttgttgagtacggtggttgtactcagtcttgctcaatttttcccaacccaga

SEQ ID NO: 24423 - DNA, 723 bp, Oryza sativa
attaactccttaggtttagcgaagtttaggcataactgcagttcctccggcaagtccctaaactcttgttagatgaagttctgtttgagttattctgctgctactatagaatatttattttctcatcagtcacggtattaacgtttcaatatttctgagtagctgatttgttcattcatctttgtcagatttttgtaactaatcttctttaaatccagttagtatatcgcatagttcatcaaactcttcctttattacacttgcaatactgaatttggcttctgatttcactctgcaggtcaagttctgcatgggatacagtatatggatttcttgtgcttcatttttttattatacattcgaagagtctgcttcctggttgtgaagcttttcatagaaacttattctttgcacagggctggagcacctttgcaatttggataccttagttcttgtttttgtctgctttgtcatgcacaggaagctgtgctttgttactggattaggggctacatgtttctgtggcctcgtaatccattgctggaggattggtggcatcctccttttgttttgtgggtattttgtgactacatgcctgttttgcaaactcaaattaggcttgtaatacgattacatttattgttattgaaagggaaaagaaaaaggtcagaaaaaaacatcatatctcagtcagctgacaacttgaaccatttttgcttcagt

SEQ ID NO: 24424 - DNA, 499 bp, Oryza sativa
  unsure (1)..(499): unsure at all n locations
gaagacctcttagagctatggtaatgaaactgaaaacagtagatttcttcggtagaatgatcctatttgactgaacctaatagattgagtgcttgtcatttcttttccatttcttccaggagatcaggccgaccttgcaaaattctgagattttcagaccacctaatgcagccaacaatgactccaagtagcacccactataatcatctcataccacccagaattttctcttctgttttaatctcagacaaacggcaatttcttttttgtagattggagacagatttgtctggtgaagctttggatgaagtcccaacaaggcgccggcaactgaagtaccgacaactaaatggatctgtgttccgaagcttcaggccacagatgcagaatctnnnnnnnnnnnnnnnnnnnnnnnngaagccctgctccatgaaccattcagaagtgcagatatctttcactgactcacctgacacaaacactgaagagagggacatca

SEQ ID NO: 24425 - DNA, 1501 bp, Oryza sativa
ttgcaacactgtcagattctgctcgcaacttagctcttacgccgcgatgtggtcactcaatttccggccgcttgtttccaggggaaagtatgagactgcaacacctgagacgagcatcaccgtgatgaatatcaggatggctgcagtctgatggcacgcgtgcaccaaaccaacggccacaagagggcacaagatcccaccgaaacgagcgattgagctcgcaaacccgactccggtagccctgactgcggttgggtatatctgcaaggaaagaagataatacatgaggcaatggtttgtgattttatttccctttttattgttgcaagcgatgtaaccaagtattggggatgttgggagtgatcaagcaaacctcaggagcatagatgtgcaagacaatgaagcttgcggagatgcaaatgcgtgcaccgaacaggaagatagttgtcagggactctgtttgagggaccataaggggagctatgcacaggcaactgatataaagcatagaggacattgagagtttgcgcccaatcttgtccactattgccgcagatagtataaggccaggaacctctgcaacagtgtgatatgaatgtgattacatgaagtagaacattctcaagaaatatggtaaagcctaagggggaaacacatgtacctccaaagctagtgatgaacacgtttctgtacagattagcatcgtttgagtggtttgtttgcattgttactatcccctctgatccacaaatcttatttccatgactcaattccgaggttagtagaacaagaccgtagtataagaaggcatgaccaagaaagacagtccaaagaagaagactagatctaattaaatttggggacagaagctttaaaatcgcattgcggcccccaatctcggttttgctagaatgagcagcagggttggttttcttagcagaaagcaactgtgatgtctctgaggaatctgtcaactcatggagctccattcgatggccagacataagatggccagaagggagagctacacggtttaatcgtgccattgtttccaaaacctgcaccgcatcagcagttctgcccttcatgcataagtatcttggtgattccagtgtcagtggatagaacagtagtagagcaaatgatggcaacgatgagaacgctagcagccacctccagcccaaacttggcattacagcctgaaaattaaacaaataataagttcctacaaaattagaatgacagtttggagcatacatcagtacatactagaaggcaacatattgttcattgcagtttccattacattatatgaaatgcataaatcatcactgactaaccaaatgcaagctcattattctgttccatgggatctgatctattctaatattttatcactgttaaatttactcagggtagcagaaacacatgcatcgaagctgcagtgcagaaccaaagaaattcaattacatcaatctccactgttttaataaatatagcg

SEQ ID NO: 24426 - DNA, 1501 bp, Oryza sativa
ggcgtgtaccacttcaaaaatgtgtcgctttgacgtgggcccgcgtcatccacatacgccaagcccgcaaggctcctgcacctggacggtagcaagagcgtgggccaatgcattccggcccacatgtcaatttcatggtgtgcgtgcgaatatccggcaaggtcgtcggagcgtaacagtgtgggtgcgtcagattcaaactgacacgccgacggcgtgcgtggtttgtccatccgacggcgcgtagatcaacgcctggccccgatccaagccgtcgaaattcgaatcccggcacccaaaagcgcctcaagatgcaatgtgggcccacctacctttcgttaatccactcaccaactacacactgactgacatgtggtcccggtggggccggtacggcaaggcgtggacaccgctttgaaaacgtcgtggtcagagagggagcaaagacttgtactactactcgcagttgcctcggaattggcgctctcggcgtcctcctctcctcggcgtggagagagaaggtagggaggagtaaaagaaaaaaaaaagctgccattttactccccccacttgtttacctcaagttgcgattcgaattcaaaatctctctacttcttccaggagcagatcgctctcccctctggataggcgaggcgaggagaggaggcgacggccgcgagcgcgaggcgaggcttccgactcgagcaaggagatcccactgctccaaccgtacgtacagttcgttcgcgagccctctggtgtttttggttcatgtttgaattgagctttgctcgttggttcgtttattacttcttttttgggtttgtttttatgtgtgtgctaatgtgctctgtgatgtgggagttgggagggaaggggaggattcgaattttatggcattttcggtggttgttcgatttgttttcgtgcaaattttttatttggtggtgagaacgcgtcgggtgattatgttaatttgctccaaaattatatgctccgttagccagtagctttggagctcggcggaggggtttgggttgcgcaccgatgtctagggtttaactgttcaaatgatcatagtgcgatgcgtctaattaagtataagcttgagattgatgcgtgaaagccttgccgcaatagctattcatctcgaatttggtgcattatttggtttcccttgattgatttgggctaagttcatttcctcctgatttggttagctttctgaatcttactgtgtacgatttcaaaattttgacagctccaaatttctcattctaatattgattgctccaatttcaaatttgttcatcaactgtatgtggttccttcattcacattcatgtacgtgttctttcagagatcaggtgatgggtggggaatctacaggaaacacgacctccattccccaatgggagaagccactgttcccctcagtatccatgttactctgagctactgagctctctgctaagttggtgcctcagctgtgtatcttgca

SEQ ID NO: 24427 - DNA, 299 bp, Oryza sativa
  unsure (1)..(299): unsure at all n locations
agggtgttgactgctacttcgnaccctccnganngcacgtggggcggacgggagcggcgggatttgcggcggcggcggcgctagggcacgggcgaggcggcgggagcggcgttaggaaggggatgatgggtgggccccacccgtcagcgaatgtccgaacgattgtatcctatatcgcggtgaggagtatgaaaacctaaaagcatgccctgtttgcaaagcactacgatacaagattagacgggacgatccaggagaagttgacgggcaggtaacaaagaagagaattcctgctaagg

SEQ ID NO: 24428 - DNA, 1501 bp, Oryza sativa
tataaaatatactagtacagcaataatcaaacacatatgcgaagtgagcatagcttgactggttaggttccttgtggtggaaccagcccacctgggttcaaatcctagacgggtgccggccttgtgagtgcctgcgttttgtattgtgtttctaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacgcggtttatctctaaaatatttttgcattgtttttagctacttcaccgattattttcacgtcttagttgctccacgtagtctaaaccaaaccttaagtttcatagtgatcaatgctatatttgaataaagcacataattgtattttaaaaaagaaaataccatgtgcagcgtggaccaatctttatcatttcgttatgaaaaaaaaattaacaacagaaaaaaaaacaagcggcccgtactgtagttagggagcaccggagcagagtacactttactcaaacaaaacgctctgttttgtattgtgtttctcaaaaaaataaaataatcaaacacatatacataacacatttcaccaaatggtgcattttttaagaaaaacttttcgtattaaaagattaaaacaactcaaaattttaactttgtactagctagcagttagttaatcgtatactaattgagtgtctttcctgataagctaagcggctaatcaccaaaatgccgaaacgaacacggtttatctctaaaatatttttgcattgtttttagctacttcaccgattattttcacgtcttagttgctccacgtagtctaaaccaagccttaagtttcatagtgatcaatgttatatttgaataaagcacataattgtattttaaaaaagaaaataccatgtgcagcgtggaccaatctttatcatttcgttatgaaaaaaaattaacaacagaaaaaaaaacaagcggccgccgtactgtagttagggagcaccggagcagagtacactttactcaaacaaaacgccagagcggcgaaaacaaagaaaaaagagcagaagatgagaagacaaaaaaggggaggaaatgaaaactgaaatccacttccactaaccacaatttttaagcccgaagcagccgaaagaaaagcgcgcatacacgcagcgcaggcattggcgcatcgcaaaatcgcaatgcattgcagctaaccacaaagctcccacctctccgtctcctcccccctccattataaccacccccacaaaaccaccacgcatcgccccattaatggactcgccacctccctaattccaccgtccatttcaaaccagacagaccagcggagcggagcggagcagctgcagcggcgaggcggc

SEQ ID NO: 24429 - DNA, 1501 bp, Oryza sativa
taagattataagtaggtcaaccagcgaaccaattataggcaacctcatttccttgttgttttgtgcttaacaccatattatgaaactttcatcatttctccaatccttcttatccacggctcatttcaatgcaacttctaatgtttcttagccatgttgcttcttttgtttaaaggacaaagtctgttttactcccataactatcagccgagtaagaggttttagtactcaactataaaatcggatattgtatagacctcgcaatgcaactgtccaaaaatcgaacaagttcccctcgaatggcaataaggttgtttttgcaaagttggcatccaaataaattactaatatacttttcactaacatgtcacgtaatttcaataagcaagatagtaataataagtaaaagacacagtaatccatcccgttccagatgggctgaaaataaaactttaactggcgggccgttcgacttatgggccgattatcgttgggcctggacggcccatggataaggacgatccccatctctccggattccttctttccttccttattggggaaaaataaaaaagaaaaaaaaagatatggtacaacaaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcaga

SEQ ID NO: 24430 - DNA, 1501 bp, Oryza sativa
actatcaaaatgcctatgcactgccgacactgcgatcctgcctgtacatttgaagctttgctcatcgtggagagctatgttggaatttggatcccttgcgtattctgctgggggaatcatggcctgtgcttgcatgtgatgttttcagagactaaaatctactagctcggttcgtatattcagaaagctcaaatgattgactgctaaagtttctcctttccaatttattttagagattttttttctaaatttttcaattcttgtatgaacatttcaagataaactattgatcatgcagcaatgttgtaatattaacttcgagacccgagagcatctttcattagataagataagcaaccaaaggaaatcattgcgggagcagcttgctgagtatatgtatctcaaaaggcaggggaaacgaaatgaaaatgcaatggaaagtgttcttggatgtatagattacttcactgattggcacgggttatgatcaaacagcgctacgataagctaatgcaaaattaaacatgaccaggctacctaatctaaggggatcttaatgtaagaatcagtgggcgatgccatcattgcacaggattgagagaatggcttccagctcactcggggtttccaatcagtaagtatatggccatgatttctcggggtctcgttctcgccgggtcgtctcgatatgatagtctgcttccttgcaatatgatttctagagaatcacgcgtgctaatccaaatggttttatcgtggcaaaattctactcacgcataaccggagagataaattctactcacgcagtggcccaattcacggccttctcaggaccgagagaacttggcccagatagcaatactgggaggaaaaagtacaacgaaggtccctcaacttgtcatccagtcacaaaatcgtcccccaaccaagaacaaatatccggcgtctcttaactaatcaaaataggttaaaataggtacttcgatgattttaacccggttttatcctatgtaacagctgagtcagcatccatatgtcaggatgccgcatcagcgcacactctctctttcccctcgtctcccttcctctctcctttttcccctgggcgttgtggatggcgacagcttcatcgacgcagcggggaggaggtcaggaggcctgtcgtggccggcggctggcgagggacgactgcggcggtcgtctgccttccctcctcctcctccgcgtgccgtgcggcgccattgccgtggtcgagagagcggagcgggggcggtgacggcgggccgagccgtcgggctggacaaggctgtagagctcaccgatgcggtcttccttacctcctcttcctcctccagctgcgccggcgccgccgcggatgccgccgctactccgctccgctccaccgcccgagtgctcgcctgccgccgccgctctgctccgccgcctgcccgcccgcccactgtagcgctcgcccgctgcgcgctcgcggccgctcactagc

SEQ ID NO: 24431 - DNA, 1501 bp, Oryza sativa
taccggccccaccgggaccacatgtcagtcagtgtgtagttggtgagtggattaacgaaaggtaggtgggcccacattgcatcttgaggcgcttttgggtgccgggattcgaatttcgacggcttggatcggggccaggcgttgatctacgcgccgtcggatggacaaaccacgcacgccgtcggcgtgtcagtttgaatctgacgcacccacactgttacgctccgacgaccttgccggatattcgcacgcacaccatgaaattgacatgtgggccggaatgcattggcccacgctcttgctaccgtccaggtgcaggagccttgcgggcttggcgtatgtggatgacgcgggcccacgtcaaagcgacacatttttgaagtggtacacgccaacgaactgggcgggaccgcgggaagaggcttaggccctgtatagatggggctaaaatttttaagtccctatcacattggatgtttagaaattaattataaatattaaacgtagactattaataaaactcatccataatcttggactaattcgcgagacgaatctattgagcctaattaatccatgattagcctatgtgatgctacagtaaacattctctaattatggattaattaggcttaaaaaaattgtctcgtgaattagctttcatttatgtaattagttttataagtagtctatatttaatactataaattagtgtctaaatatagggactaaagttaagtccctggatccaaacaccacattagctaagttatcgtcacctaataatttgacggttatcatatttaccataaaaaccatatagttatcgtgatgtatactgcaatttcaaaaaccgagaaggttattgcatgtgataatcatgataacctcacgattttgtaaaccctgtaggtgccatgtcacattgtatctcgatatcagctatatgcatggccaacttacatggcctttaacttaacagcgatttcaatttttacccttcaaccgaaataccagatacaatgaattattcaagtgtcaaaaccggtgcaatataggtaatgatggtataatagcgggtggttttatccaacgtgacaatttgatctaagtcaacagcgctaagtcggtgtagaatacgagaggcagaaggcggatgcttacagggagattgacgccggcgacgccactcgacgacctcgacagcacgaaccctagcggcgcagtacaagcgtccttgaaagctcgggggacagacaggacaggaagagggagaataaacaaactttcttgcttagaacttggacacgacacggctccggcacaatgtatatgggccgcacctagaccataatcccgtttcgaatgggctgcaaactcgaatgggctgcaaacttgaacgggccaccctatctatgggccgattgtcgttgggaaatgggcttacacgataatgggccttgacggcccatagagaaggcccatagagaaggaatggctc

SEQ ID NO: 24432 - DNA, 1501 bp, Oryza sativa
atggtgtcaatgcccattaaaggcgagaataacggtctattttgttatccatataagaaagatggggacaatttatgcaatagatcatcaaagcctattatgctatctttagttggttatcgtatacttaattgtcacccactatttgtagttctctggtaaacaagcacaagtgtataaatgacgacatcatgcgtgagagcatattatcaagaaaaagccaagccagtagatttcatatgtatggttcccacaatcccgctcttttttcctacaatattttgccttacatagcttataagtgtctgcaaattttgaattttcaaattaaattttgaagttggttttaattttttttatagagcttgcttttagtattagcttttaaatcaataaagacatataaataaaagtttcacctacagattataataacatgtacggcttataatcagtatgtgtggcaaaccgattatagcctacggcttaattataggcatttgctcaattttttttgttttctttcatataggttactacagcaacatggggtgtatcttctggatttaattaactctacagattaattaagcttgtcaattccagtatggctggaaggccattccaatttggatattgggacaatatttcgatatactcgacgatatcagtctaccttgatggggtttaacgaaagtgcagacaaattattatgcaaaatttcacaatattttgcatgtaaatgctaccttgctagtatagttttgtaagctcattaagaaaactaaatacaccgataatatcatgtttttgtttgtgataaattaaatagaaaaaggagaaaattaattgtataacatcaaaaaaattgatgaacttatatataatgtgacacaaggattttttttttcaaaaagtaattgtttctgttgtataattgtgtagagtgtatgtagggatatcgtttagtgtgatctgttgaatatttcactttgtgcggaaatttaatccttgatatttataagtacgttttggtttctgagcaaatttccagaattatatccttatagagttatgtacaatctaatttttcttatttaaataattttgtaagagctgaaaggttctctgaattctcgatttcttatgcttgaacatgtatgatcatgctggtaagttttcatgctaccagattaaaaaatcagtaaaaagagtgtattttatgagcagaagtgtaagcaatgcacaaacacatatcagtgtttccaatttaggtgggcggaagctgtgagagccctttagttcacgtttattgggctgaaaatagaactagctactacagaaacatagattacttccagtttgtaagcctgcataggtgccggtttctgtaaccggcgtcacacaagcggcactaattaatgagccatgtgatagatgccggttttagaaccagtacctatcgtcagacaaaaaaaaaagggagccagcttgatgaatt

SEQ ID NO: 24433 - DNA, 1501 bp, Oryza sativa
ctcgcatgcatcatatgcacatttttttagaaaatggattaaaaacctaacctctacatccaacttaaatgtacacagcccaaacaaacaaagtcaagaggactaatcctcacaccttacacaaggttcacaacaacattcagacatcatatgcacatgcatgttcttcacacacggctaattaaaattcccggagcatatatatggacccactgagcgcgtgtgtcttaaaattactagtggacaccaattaatactaccaatttagaattgaagttctaaaaaaaagaatttgaaccgtgtggcctggatgcacattttaatataaaaataagggaatatatattaggcaacagcatcgagtaagaaaggaacataaatgaaggaaagcttaacagagacactattcctttcactattccatttccactcctttatttaagaagaaaaagattcggaccccacttaaacaatcacaccaccttttgtcaacaaaaggttttgctgataagaaaacgagacttgtgggaaatccagccaaggaaaagaggaaagcaaataaataaactcaagtgaagacttttaccaaggaggcaactagcaaatggcatctcttatctgcaggactgcaattccttgcgggcacctccttcagcagtaatatctccaattatgaacatgaaccaagattgtgtttacactgtactagccttctagcagaacatgaaccaaagttgtgtttgcactgctctcactcaacagaactgttcccaagaaaatcttatcctcaacgaggtgtggcccaagaaaagaaaaaggaaatgagaaagaaggagaaaagaaaaaggaaaacagaccgacaagaaggaagaggaaaacaagcaagggaaaaggtttcggtgcaagatgaacaaaagtccctcttattttgaaggtttgataagacagatgatgtttgggtggctgaagaacaaatggtttatttcgctaacatgcacgcaaatatgcaaatgcaaagatagtaaggaccacctcgtaaacaaagcaaagagttagacatcatcaatagctccacactagctaacatatgaagatttaggaatattgcagagatcatacaaagctgtgcgcgaagggcagcgcatgactgtaaataaataaagtctaaagttgtaatgtacatcttatatttttcctttattttcgataaaagttgtaatgtacatttatatttttctctatgttcattctctttttcggcttttatcatgtaatgcttatccctcactttagctctctcccacacgcacatgtgtagcagtaataattaaagtgagcttcactagcaaagcaagtcttcagctgggctacagaaaaactgtgttcaacaagtgtcattctgatatataggtgtgctaaactaaccgtccattgtcgggaacctacgatgcacaaacaaaaaaaatagtaacaaacagatattagatgcatgatagaatga

SEQ ID NO: 24434 - DNA, 1501 bp, Oryza sativa
ccctagccgcccgagggaagtttatattccctccctctccctttttcttctctttatctcttccaaaaaggatttaattaaatcattttcctttagaccaaaaatccaataatcttagaaattcaatatcttccccaccgtaaatccgtttgactccgttcaacttccaaaactccccaaatctcgagatctacctaatggcacgcttagaggtcagtaatagggctttattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcggacctacctagtttgttgcatttgatccttcctttgataattgttataccatgtccccttgtaaccatccagttgcgtctcgatattcgtgcacccagtgcgagtatcgacggacgccttcaaacttaaaatctgaaaaacaacttgggtaaaacttgggttttacaagagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgctgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaagattcagcagctgatgggatcagctaggcccgggtggccgtttgaaaagttgttggcccgggtggccgtttgaaaagctgttggccgggtgccaaccttgtttcaattctaaagactgatacatttgcacatactccgaccggacgagacgctctgtctcatccgagtcgtttgagaagcactcacttagttgttttcagaaaagagttcaaataaaatcaattgcaaaaacaacagccttcccttgaagcctgcattaaacacttaattcccttggcttgctgagtactcccgtactca

SEQ ID NO: 24435 - DNA, 940 bp, Oryza sativa
cgtgaacctaatgtgaacgtgaacttaacgttgtatgtgaacatacataaacgcacgaacgtgcgtgaatgaaaagtgaacttaacaagaacgcgaacattacttaacgtacgttaacatgaactcacgggaacgaacgaacgtaggtgaatgaaacgtgaacttaatgacaacgcgaacgtgaacgatcatgaacgaaacgtgaacttaacgagaatgcgaacgtgaaatacaatatatgttactttgcgtttatcctaatacatctttttgtatgttgcagaaaagtcgttgtcgtcgtcgtccctcaagccggagtggtcgctagccctcgaaggaattcgcgcaggcaagtgatgtaaatatatgattgttagatttttaatgcaattaagactattagatttaatatacgacacttagacttagcaacataattagagttttaatacaatattatttgagttttaatataagattattatatttttaatataagattattagatttgtaattagacttagcacataagattgtgtagggttctaatatacgacagttagacttagcatatatgactatttgagttttaatataagattattagagttctaatacaagattatttgagttttaatataagattattagatttgtaattagacttagtatataattattgtctagggtcctaatacacgacacttagacttagcatagttgactattacagttttaatacaatactatttgagttttagtataagattattatagttttaatataagattattagatttgtaattagacttagcatataagattgtgtagggttctaatatacgacagttagacttagcatatatgattgttagcatataagattgttaaagcaaaaatgacctatagacttagcaactatttcttgtatgaacaga

SEQ ID NO: 24436 - DNA, 1501 bp, Oryza sativa
tctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataagaaactcgacgcaacccctacctggcgcgccaactgtcgaaacatgatttcggcaataataaaagggggtagcgcacgagaactaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacaagatagaaaccttaaccaatacggtatcggtttcctaaatctggactttaggctgttccgtaatatacaaggaaacgtaacacccaagccatgatctgttacatattacatagatataagttatcccctataactagtcggataaccatgccgtgtgggtatggggtacccataatctccacagtggtcatgacgttggcgacttggcgtacagtcaaggacgcgcactacacatgattaagcatttaagctgatataaaactagccgccgtgggaacaattgccttagttaattctacatggacaacgatcgaatcagtcatccttcgattggtttagatatatatgaaaaccgatcgatcaacctatctctaatacacgtaacgcatatattgttgtcgaaaaagaagaagaagaagataacgtagtgtatccattctgaaccataaaaaaactaaatcctaaagataaatctagacacattatctagatacattaatagaatttggttttttatggagagagagagagagcacatagggttggaaattccggaacgaaatttccgcggtcatttcagacccctccgatactatattattttggttgaaatttttatttttttttaattttttccgtgaattttggtgatatttattcaagttcaactaaattttattcaaaattttggaaatttctaaaattttggcattccggtgagtccgatcaaatcggctaaaccgaaaggtttaaccctgcctgcggcgcacctacatgctacaggtgcaacacagcgatttcgtactctctccgttctacaatgtaagtcattctgtcctatatgtgacgcatcttatgacaacgaatctggacagggtcgaatgcatcacatctagtgtataaaaggtatattatgcatatagtgggaatattgtgagacggagggagtagctctcaccactctatggaagacattgcaaccggccagatgcgatgcaccgtgtcacagaaaataagctagtgtagccaggtatctcgctctctcca

SEQ ID NO: 24437 - DNA, 265 bp, Oryza sativa
agaaaaaaggtcgccctttatgtgcagggaaaaaaacaccaaccgcggttttcctctccaagcaagaggagggaaagtgggggtttctccggtttcaacacaaggggaacttaaagggtgtgtggggaaaaccaggagccgtttttcttgaagccccttggaggacaaacacgcggttttttgggaggttgggagtcccggcggtcccaaaatattgttttaatggggaaccattcccttcccttgtgaaaaactacaaaaaagg

SEQ ID NO: 24438 - DNA, 1501 bp, Oryza sativa
caattggtgtagtgaggcagaggaaaaggaaaaatatcatataaagaataaaataaatgatgacttagctttgtaatattccccttggtgatggcagaagtggccaatgtgggaacaaagttgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaagccggcggtgaagtcgtagacgcccaacagcggcggcataataggccggccgtgtaggcggaggcaccaatcggcggcaacggaggcaggccggcggtgaagtcgtagacgcccaacagcagcagcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataagaaactcgacgcaacccctacctggcgcgccaactgtcgaaacatgatttcggcaataataaaagggggtagcgcacgagaactaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacaagatagaaaccttaaccaatacggtatcggtttcctaaatctggactttaggctgttccgtaatatacaaggaaacgt

SEQ ID NO: 24439 - DNA, 308 bp, Oryza sativa
attaatttcggccgtttggcggaaacaaactgatttgacgagatgactagagtaaaccaaattcggctgtaatatgaccgaattgatcgattccccagggagtgctcaaaaatcgtattggcaacttttttgataagtcgataagtacgatcgcagcatctaaacgtcttgcagtgatatggagtcgccaaccacctcgatctagccaaatggccgaatcaagatgggttttgtagaaaaacggctaaaccggctagcggagccgatttagagatcaaaatcagcctctaggccaatttagatcgata

SEQ ID NO: 24440 - DNA, 208 bp, Oryza sativa
gtggcccaccacgcctaggccccacccgacagcgactcccagacttccacctcacccctaccccgaccgtgcaccaacccccccgcggccgcaccacacgcgagtacgcgacgagcgccaccaccaccaacccagccgaaagcccacgcgagcccatcccctgcagtagaagaggaggcggcgagcgagcgagacgccgagccgagca

SEQ ID NO: 24441 - DNA, 1501 bp, Oryza sativa
gggtatggggtacccataatctccacagtagcccctgagaccttcacagtcggaaagataaccttctctcgaactagattactccaaggccgagtgcttcaatcatcttcgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgctttagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaacattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 24442 - DNA, 181 bp, Oryza sativa
tgcgcatgtcgggtcgatggtcgtcgtcgaatcgccaaactccactctgatggcctttccctgaacatgttggttgaaaaactttgagagaatacaaatacaaggacctaaatacaaagtgaacatactgtgttcaaaacttgcaacttttcataattagtgatgaaaaaaagtagcttga

SEQ ID NO: 24443 - DNA, 1501 bp, Oryza sativa
gcggggaaccacgtgggcgcgcgcgcgaacaacggcgcgcgggagccggcttcgcgggcggggagcttgccagggatggggagaaggagagcgaggggaaagggggcgctcggcgcgagcggctcacgcgcacgcgcgcggcgcgcgggcggcgcggagcggagggggagcgagagagagagagagagagagagagccggggagggagggagagatgggccgagcgagattcggcccatcgaccctgggggaggcaaactagacttttgcggaggaatttgatttggaaggatttggattcggaattgaactcgacgatagatcggggatttgagatcttgagacggcacggacactagacgacaagcgaagaaacaaatttcgcaattaggatttttaggagataatttttccgctaggcgccacgacggaacgggcgctacaaaatcccttatgggacggagggagtacgtggacaatgtaagaacagagttgcaaattatttattgggtaaaggtactttgtcaggttaattttcaaaagtgaccgagacaaggtcaatgttaaacagcaacgttgtcaatcatggattggcgtacaagcaagtggtgagaatcaagcggcgatatgatcgagcattttaatttgcaccgtgtttacttcaaagtttttttctaaactaccaacttttccatcacatcatttcaatttcaaccaaactttcaattttttatgtgaactaattaagggtgtgtttagatggtggagaagttatgaagctgtgagaaagttagtagtttagagaaaaagttgatagtttatatgtgtaggaaagttttcgatgtgatgtgacgtaacagaaggttaggattttgggtggaactaaacatggcctaaacacagccggctgggcggctgggcctaaccgcctaacgactccgtcctggcgaatcatcagcggatgggtgtgcgtggctccgtgcttttggccgtaatgatccagacgtctcgccgccggcgatggccggttaattaacactgtggtcaagccaatttctatgaacacagtgtataattaatagtatatatttaacaaattaagtgcatatcatgttttggatgtactttgtcccgatcggccaacgaagcataatttcactagatatcgagctactcccccgtttcacaatatatatctaatttcattaatattaatataaatatgagaaatactataataagttacactgtgaaatggaggaagtattccctccgtattttaatgtatgacgccgttgactttttaatcaacgtttgataacgcgtcttattcaaaatttttatgcaaatataaaaatacttatgtcatgcttaaagaacatttgatgataaatcaaatcacaataaaataaattataattacataatttttttaaataagacggaaagtcaaacgtttatcaaaaagtcaacggcgtcatatattaaaatactagggagg

SEQ ID NO: 24444 - DNA, 1501 bp, Oryza sativa
gaaaatggggtaaacccggtctttacatccaatcatatgtacatacagccaaagtgacatgttttagctgctcccttatagcaagggtaacaaccctaatatggctaggttatagtcacactgcagacttccatataaaaataaaaaggatgcccaatctctaccattataaaaatagaagatgtttttgctgattgtttggtaagtcgttcgattccagtacaaatacatcgactgtatcagattcaaccgtcatcggggaacctctacagtcatcgtacgaccgcgtatatatacacttgccatcctcatatacgctcgcatcagcccatgtccatctcagatttggttgctcgcatgcataggaaagaacagatcaccagatcgatctgtcctagaatatccggcgcgtgcatacatctctctttattagttctagaaaagagaagcgccactgcatgcttgcatattgtaggcaatttatttatcctatccaatactttagtttcaattaaatagtaacccccaactgtaatatctttcaataactatacactggtgaagaaaccatctttcgtcggtcggccgatttccacaatagtcccggatgcaataaaaaccggggctaaagatgatctttagtcccggttcgaaagggtaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaaccaaccgggactaaagatcccggtgatctttagccccggttggtatcttaactttagtccccgttggtaataccaaccgggactaatgatcccggtgatctttagccccggttggtgctaccaaccgggactaaagtcccacccctatatatatgtcttcatcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 24445 - DNA, 1501 bp, Oryza sativa
agtcccctctcgtgcctaggtgaatccagaagcgacagaggccgtcgcagggcccgccccgctccatcacgcccacccttgcctagatgcgttaactagaggaaagctacactacaagcccagccgttgcccacgctggcttgtggtaagtacgataagttcttccagggcatcccgcgaaccggtccttatacgccatgggcgcgaccaacaaaaccatgcacccacagcccaccatgtgatttattttaattaaccaacaccgaagcggtggcactaatccaacattaacattagagcctacagtctatacattaatatgattttccccattatgtgctagttgaactaagcatggctaagcaatccctaatccaatctctagtcatgtttataacccaagctatcaaaggagcaaggtaccaaaaatagcagcaaggtaccaaaaatagcatggctgtaacagtaggtaaacatcccatagtattattgcaaaacaatgcagtatttgaaggaaaacaatagaccgtttgcaatataggatcaacatgttcaagtgacaagcatgacttgccttgctctgctgctggaggaacctcggcgactatctcaaagtacaccggagcgtcgggagagccggaatctaagcgacatacaaagcaaacaatacaaacaggctataagactactaaaacagagaacagaaccatttttaatggattctacttcttgatttactgatacttgaatgggctcaaacggagctcggatgaattaaatatgaattttagaatattcactgtgtttttactataaacagaaaaatccttaattgaattattgcgcaataaatatatcccggggagagagatgggcggcgccgacatgcgggccccacatggcagtgacacgggtggcggtccgcagtggactgggtccacggaccgggaatgggaacggcgcaccacgtggcgctgatgtggcgccgacgcggcggccacgcggcagccacatgggcggccgaacaaacggcctcgatctaccatccggtagattggacggcggatgcggctcgcggccggcgcgcgcgggcacggctcaagccggcccggcggccatggcacgcagcggcgcggcgcgcgtgcagtggcgacgcgaggcggcgaccggcggcaaccggccggcggcagagagcgacggcgtcgcggcgatgcgggcggcgatagcggcggctaagcggctaggcggcggcgcggcggctaagcggcgcgggagagagggagaaggggaggaggggcctcaccgacgacgatcgacgacggtgagcgacggagggcgatggcgacggcgggacgaggtccggaaccacctagggaacagagggagagaggcaaaagggagagggcgaggacgctggccgaaggcggcggccatggcgatgctcaccgacgcacgatgcggagtgggttccggcggcggattccaacggaggaggggtgga

SEQ ID NO: 24446 - DNA, 272 bp, Oryza sativa
aattcacacagttgcacccttgaacatcgaacacacagacaaatgcaacaatggaatctggggtcaaatttctgttggtgtcatcagagggccaagaaactgcaggagcaccaaaaagtctcactttcttcttcttcttccattgtctccctacaaaaagggctgcaagaacacaaggagaaaaaaaaaaaactgcaccaagaacaaattgcaaagtaagtttgtactttgtactttctttgcagcaagaagagcaagaagggagatgtcca

SEQ ID NO: 24447 - DNA, 1501 bp, Oryza sativa
tcagcaagccatgggaaataagtgtttaatgcaggcttcgaagaaaggctgttgtttttgcaattgattttatttgaactcttttctaaaaacaactaggtgagtgcttctcaaacgacacggttgagacagtgcgtctcgtccggtcggagtttgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctatccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatcggtccttaagtgcgagagcgggaaaccgtacacccggtacgttccccggcccgcggttttggaaattcatttagttcgcaagcaccgacccaggtgtcgggttttccaaatcttttgtaaaacccaagttttacccaagttgttattcagatttttaagtttgaaggcgtccgtcgatactcgcacagggtgcacgaatatcgagacgcaactagatggttacaaggggacaaggtataacaattaacaaaggaaggatcaaatgcaacaaactaggtgggtccgccaatctgccttgcagacgggacgacagaaaaagtgcgatcctatcaatgcataatatttttcaagcaacataattaaatttcaaatataggctcaagatgttcaaaggtggcttgccttgctcgagatctggagcttgatcctcgcaatcctcgcactgcgggtcttcgggctccgagactacacgcgaaacgggacaactcaacaaacggcgaaaataaagccctattaatgacctctaagcgtgccattagatagatctcgagatttgaggaattttggaagttgaacggagtcgaacggatttacggttgggaagatattgaatttctaagattattggatttttggtctaaaggaaaaggatttaattaaatcctttttgaaaaagaaaagaaaagaaagaaaagagggatggaaattagacttttcctcgggcggctagggcgcggcccgagagaga

SEQ ID NO: 24448 - DNA, 1501 bp, Oryza sativa
gcaatttgttttcccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggatgaagacatatatataggggtgggactttagtcccggttggtagcaccaaccggggctaaagatcaccgggatcattagtcccggttggtattaccaacggggactaaagttaagataccaaccggggctaaagatcaccgggatctttagtcccggttggttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgttaccctttcgaaccgggactaaagatcatctttagccccggtttttattgcatccgggactat

SEQ ID NO: 24449 - DNA, 1501 bp, Oryza sativa
ccgcaacgaccatggcgacgacggtggaacttgatggagatggcgccgacagcgggtggaggtggtcctgtgcggggatctcgggcagcgacggcgaggtgcatggcacggaggcaggctgtggggaaccgacgggggatggccgacgtggacgaggttggcgacggcaggacgtggattttatggaggttgaccacgtcgtggtcctgtgcggtgatctcgggcaacgacggcgaggtgcatggcacggaggcaggctacggggaaccgacgggggatggccgacgtggacgaggttggcgacggcaggacgtggattttatggaggttgaccacgtcctcagatcgcacattgtatcgagcctcaggggccgatatatataggagtacatggattgtatcttaagtaaactcaaagagatagagatggaaactaatcctatcctaccataacaaaccggatacaatacgatcttatccatatactctaacacgaaggtcacaaggccttggccataatagtagaagcaattgagcactagcgaagagtggcgggagtatgcaaagccatgcctgtgggctatggtgaagtgtgcaagatgacaaagggctgtcgaaggttacaggacagtgaaactgtgaaagagtcatggcacggtaagattataagcctttaggggtggctagagcgtagggagaaagcaaaagtaggttttgataggcgtactggcccaatcactgtccacatagaccaaataggccaagaaaggacaaaatacattcatgtagctgtcactacaacataacataaaaaaagatggcactatagatgccgaaaatactagaaagaacacctatagtgttttttcccgccagagcgcacactcgtgggatgccattttgatgaatggatacctatgtagcctcaaaggtgccggtttttaatgcgctgcgatttctaattgtggcgaggagcggcaggtacaatggattctgtcgatgagcttgttggcggacaggccagcctggactctggtggattgggcggcggcaggtcgccatcaaggtgaaggggaacaagccgaggccaacggctcggctcagtttgcccgacccattgagcaagctggctagggctgcaggagggttcggctggtgagcagtgggctaggtcggaaggagaaaataattgggacagggctaggaaaaagtacaccgaagttcgctcaacttgtcatcgagttacaaaatcgtcccctaatcaaaaaccatatatatatgacatcccactacttttagaaccgttcactttaggtcctttagtggttttctgtcacgccaagaaattcccgaatagaattccaagcagaatgtgcattaaaatccccgtccaggaccggccggggtacacaaacgacaaagttgacatacagatccacgtcttacaaacattataaaagtcttacataaatgcagcggaaaaacaaaagataactggagc

SEQ ID NO: 24450 - DNA, 234 bp, Oryza sativa
ttcatcatcatctaaacacttcaatagaactccatctatattttagtgatataaatctccatcaagcaatgtatatttgaacgcttgccgccgaattcttcaatcaaccttaagtgcagtgtctttcaaatatctaatcaaaggaatcctccaatcttcttctgtttcttgggcacaaatgtccgaatttacaattaatttagcctttgaatcaattgcggcgtgccccccagc

SEQ ID NO: 24451 - DNA, 262 bp, Oryza sativa
ttgagcatgtggctcgttaggtctaatagtggcaaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaaatctcctagaggcagatctggtggtcttcttttaggaattaatcttctaaa

SEQ ID NO: 24452 - DNA, 1501 bp, Oryza sativa
aaaaaatttgctcaatgtgtcacatcggatatacggacacatatttgaagtattaaacatagtctaataacaaaacaaattattctgctagaaaactgcaagacgaatttattaatactaattaatccattattagcaaatgtttactgtagcaccatattgtcaaatcatggcgcaattaggtttaaaagattcgtctcacaatttacacgcaatttgtgcaattggttttctttcgtctacatttaatactctatgcatgtgtccaaacattcgatgtgaaaggtgaaaaatgatgttttgggaactaaacaggacctcttacaaacaaaaattttcacgctgtcacatcgaatatttggaaagatacatggagtattaaatataggcaaaaagaaccaattacacatattacgtgtaaattgcgagataaatcttttaagcctaattgcgccatgatttaataatgtgttgctacagtaaacatttgctaaagacggattaattaggcttaataaattcatctcacagtttcctggtggaatctgtaatttattttgttgttagacaatatttaatacttaaaatgtatgttcgtgtatccgatacgacaaccaaacaaaaaaatttcaccaactaaacaaggcctaaagttttacacattgcaaaccgtgaatagtagtggcttcttgctaacggtaaatatgcccctcccttataatagcacatttgcaagcccatttcagtagtttggtacagcatcgcagatggatttttgtcgcttttgtacgtgctgtcttaaagtaataaaaaataaaaaaaatggtaagatataccaatatgtgaaagtcattccccacagcatcaagtaattgcccatctgcgttgccggcggcctttgggctgtcaattagtctgtagtactaacgatgtttagctcttttgagtacaactactttcaccggggtgcttgactgccagactgttctggctgcaggctgaggctgctaagagcaaaaataatagtatagctcacttcttattattagcatatcttaaagtcaacatatataatggattagttataaggttggctataattgttttctcttctctctagctatccctcacttatacatttaatgtatttgtcttggaatttgtgataagttagctcttgcatgaaagccaacacccttaatttttcactatctctcctccacctaaactcatagtaagcttatagctcattattatacttgctctaactgcactaatccaccggtcaagtaccaaggagctacctccatccagtgggagtaccaagaagcatgttcacttgccggcagtgacagtgaagattaatggttaaataaatgacggtacacactatctcaattgggaaatgtcactgtcagcaggctagccacattctttccccttttaaaccagtttttaagttggaagttggaactcacgcctccagccctgtggggttagg

SEQ ID NO: 24453 - DNA, 415 bp, Oryza sativa
agatgcatgccatcaaaactagcagtggtagtagtctagcagagatcagatcaccatttgtttggtatttttcctctgaccaattcgggatgactgacctcaagccagagtgttccatggagctaacagcctctggtcagttaattactattatgcacaattacacatgggtgcacccccatggtcgcgtttaagttacttcacgttggagaaaactgatttggcctagaaccttacgccattggtgtgaaattgcaccatggtgcatgtctgatgaatctgtttaaatccattgaaatacattgaaagaattctatcagaaaccccgctacaaaaataggaaataatgtcctaaagatgggctttcagggaaaagcttgcaaagagtttagtgtaactttttttgtataaaaga

SEQ ID NO: 24454 - DNA, 1501 bp, Oryza sativa
ctccggcggaggcgggtgcggcggcggcgggtgcgggggcggtggctgcggcggcggctgcggcggttgacgcgtgacgagttgttgcttatctgctcgtgttcgtatttggttactatagtggttaggcaggctgtcagcttctctaactatttgctcttatttgtttattcgcacgattatttgtaatgcatgattacatcgtgaaaatatataaatatgatttggaatgcgtattgtctaaatcgttgtgtgctgcctgaatcatattacttttcggggattgctgcctgaatcatataagaggtagaagccaaatgaaatgcctcttcaaattatctcaatcattgagaggtccttaacatgaattgagaattttgccggcttagccgtgaatgtgttagactttactttctctttctaaaatagtgctattttgaaacaagtagtaactcgcaacacacagaagtttccgaagaactcgataaggcacatgcaccgatgcacagcagaggccgcatttggtactgggaaggagggactaaaccgaaaacggataagccatttcctactattaagaatcggtatactactagaaaatatcccatccgatcttaggtctgatcggtttagatttataatattaaaaaatatcacagtttatttatttaaacaaggaacggcaacctgtttattatagtaaatcacattcggtttcttatattttaaaacggggaagaaatatttgtttgtttatttaaacaagggacggcaacctgttcgttagtcggcgatccggcgtactagggccctgtttggaagattagcccagggctaattttgagagctaatgtttagtcatgaattggtaggctaaacattaggctaaggtggtatgtttggatccatgtgctaattcaaggttaaaaggtggagagagagtagaaagagaggagagagagagagctgcttttttatggtccccacacaaaattaaccccattagctgtgatggaagcgatacccttcctccaggtacgcctgcatgttatataggctaggaataacccctagcgtggtacatacaaaggatgagagatcttatcctatctctctgttagttacaacaaactgaagataagaaccaatctatctagctaactattcttatcatctaacactccccctcaatctcaactctccaagattgagattgttacagaacaattgtaattgtctcacaggaagaggctttgtaaatccatcagcaatttgatcttgtgacggaacaaaccgaaattccaacattttctgcaccacctgttctctgacaaaatggtaatccacttctatgtgttttgttctagcatgaaacacaggatttgctgacaaataggtagctttaatattatcacaccataattgagaaggtcctggatgcaacaaaccaatctcttctagcaatttacgaacccacattacctcagcagttgcattagcc

SEQ ID NO: 24455 - DNA, 1501 bp, Oryza sativa
gaggcgttgtgttggtggcagcggccctaacccctggcagggcatgacggcggtcggcggagatgctgcctgcgtctggcagcagcggccctaccagtacggggaggttctacaagctgaccccgaggaactggaagttgggggtgactatttccctgttggggccggaacacccgggcctgcgggggtgggttggatttttggacccatgggtgagcctccaaaacaaaccgaactatccccactccactccaaaccctacactccccgcacgcgcctgtgcgcggtgcaccgccgcgcactgccgccgccgccgccacaaccgcgcgccgtcaccgccgcgtgccgtcactgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctggggggactgttcttggaagtggttcttgggagcatcctggtatggtaccttggctatttttgtgctttttctttgtttcaatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaaagatgttggagatttgaacaaattggaattacacaaattgattgctagcaatgttctattattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagttccatataactactaatctgttgatttaggtggctgtctttcactgtagtattaagtagctaactattttatgtgttgacatgacatgaggcctgtctttcttgttcaaagatgtgatttgatattcattatgttattagtggagtttcaaaaggtgaaaaaaaagtgcacaagaatatttatgcacggttctttgaaaagaaacatgtccagcccccaaatgctagatgcatgattacggtgtataacaggttgctgttgggtatgcttatcatttcactagtttttagcacaag

SEQ ID NO: 24456 - DNA, 1501 bp, Oryza sativa
tcaaaatggcatcccacgagtgtgcgctctggcgggaaaaaacactataggtgttctttctagtattttcggcatctatagtgccatctttttttatgttatgttgtagtgacagctacatgaatgtattttgtcctttcttggcctatttggtctatgtggacagtgattgggccagtacgcctatcaaaacctacttttgctttctccctacgctctagccacccctaaaggcttataatcttaccgtgccatgactctttcacagtttcactgtcctgtaaccttcgacagccctttgtcatcttgcacacttcaccatagcccacaggcatggctttgcatactcccgccactcttcgctagtgctcaattgcttctactattatggccaaggccttgtgaccttcgtgttagagtatatggataagatcgtattgtatccggtttgttatggtaggataggattagtttccatctctatctctttgagtttacttaagatacaatccatgtactcctatatatatcggcccctgaggctcgatacaatgtgcgatctgaggacgtggtcaacctccataaaatccacgtcctgccgtcgccaacctcgtccacgtcggccatcccccgtcggttccccgtagcctgcctccgtgccatgcacctcgccgtcgttgcccgagatcaccgcacaggaccacgacgtggtcaacctccataaaatccacgtcctgccgtcgccaacctcgtccacgtcggccatcccccgtcggttccccacagcctgcctccgtgccatgcacctcgccgtcgctgcccgagatccccgcacaggaccacctccacccgctgtcggcgccatctccatcaagttccaccgtcgtcgccatggtcgttgcggcatcgtcggcgcggcacagggtacggggggacccatccctgccggctcctcctccgcggcggccgccgccgcctagggagctcgtggccgccgccgccacctacgcccgcaggccaccggttcaccatcgacaccccttccgttgacgccccctcacgggatctggaggtcgtcgtcgttgcaattgatgctatctggccaagcaatggcctcgccatcgtcacctctccgcccgaggaccgccatcctctgcatcccaggtcgtctccgcccattcctcgtcgtcctcctccggccaccgacactaccatctcctcctcggactactcctgacgtgagctcgcatcagcctcgaccatccactggttgtcgccgctgtggtgggccacctcccggcgtcccctgttagccaacacacctggagtccctgcgctgtcaccggactgtgaggtcctctcctccatcgacctagagaccggcctgccgaactcctctctctctctgtttctctcgttgagagcagggaaaggtggggatgaggttgtttgactaaaggtctatggacttggtgtatggaccatcgaggtggaccagctg

SEQ ID NO: 24457 - DNA, 1501 bp, Oryza sativa
tttgtgtgacttgatgcttgatcctttcatgattgcgattttttcatgcttgcatattttagtttcagttctttcagtgcatgcacaacaagtacggtagaggtcattcagaatcgctataacatatcgactggatttaaaggatattgtgcaatcatatctgaaacaactatctaatcctggatgagatgcatatgccagcgagtgcgtcaggcatattttgacagccatgatgatcgagttttgtgccttggtggctttcatcgttttgatcatcggccgactagatctcttgagcatggcaaaaaaatatcttccgtcgccatcagacaatccaagctagctgagagcgaaattgggctctagccatggtgcagtgctagctagtgataatcttgtatacctgttggtttgatgaagggatagaatatcatagacatatgtgatatgtcgttcctttctccaagagccagtgtcgacatcgttcgagtgagtatgacgtcgatgcaacatggaaagatgaccggccgggagcatattatgccaaagcatggagagtaacatggttgatgtgtgcagaattgggagtaagtagggtggaatttggtgctcgaaaagtatggagagaataatctttttgttttccctcgtatcttgcttgcctgctccatcttcgtctgcaatggcggctccattgcctctcactagcaggattcgcaataccgctggaatttcgcgaaaaccggtcgacttttgtgaaaaggattggtattagtcagttttcgtatggtgttaattgaaagtcatcggtttttaccgattttcgatcggattttggcaaaaccgaggagcagtttttactttgaaattggaaagttaaaccctgcctctcagagtgcacaggaagaaggtaaaaatttcacaaagtcaacgaacgaacctagctatgagcaactggaagtggtccgagaaaattaatctccatgactccatcccaacaactgcttgaagctattgacttttgttatctattcgcatatcctcctgagctccctccctaacgcgttccttatatatactccctccgttttttaataaatgatgacattgaccttttctcacatgtttaaccattcgtcttatttaaaaactttacgtaattgtaatttattttgttatgagttgttttatcactcatagtactttaagtgtcatttatatcttatacatttatataaaatttttgaataagacgaatggtcaaacatgtgagaaaaagttaacggcgtcatctataggaggtagtaattatcaaccgcttgggcttagctgcaattgcatgggagagacattcatccacatccagtcaggctcagaaatttcctgacgttgagagatgctggagggcacgatgttctcaagttgtacgagtcgttttacttatttgaatactaaatattcgcgtacatatctgaggatattagttatagtatactactct

SEQ ID NO: 24458 - DNA, 151 bp, Oryza sativa
cactgggtttttaaacatattcctcacctatgcgaggcctacatcgaggtagtgcctttcttagatcttattattgctccttctatgaactccggtggatggaagccaatcgggtttcaagatgttgtatggtttcgccttcgtgatggca

SEQ ID NO: 24459 - DNA, 1501 bp, Oryza sativa
tgaacgggaacgttaatggagtgcagacactcaaatattactccgtttcaaaatgtttgacaccgttgacttttcagcacatgtttgaccgttcgtcttattcaaaataatttgtgaaatatgtaagactatatgtgtacatgaaagtatatttaacaatgaatcaaatgatatgaaaagaataaataattacttaaattttttgaataagacgaatggtcaaacacgtaataaaaagtcaacggtgtcaaacattttaaaacggagggagtactcaacgtgtcatcttgtactacaggtactgtaaataaacatgtttcctagagaaattgctagcatattaatgggctcttggccccacaaaaggttgaggctttgaatgcggcccatcaaaatgtcactatacgagttggtaacttggtatgacggtatctgtctgttcatgtaacagaaccacttgtgacacaagttgaaaattttcaattcacaaggagggcgaattctgattgacatggtaaacttttcagttgatcaacgccattgccggtgatgtaagaagcaataaaactgtttattctgagagggaagaagaggaaaatggaagtcgacatacaaatacacgctgttcttttttttttttagaaccaatacacgctgttccatgcatcgcagcggacgctatcatcgtaccaagctaagttcctctcttaagtttcagttccattgacttgctcatattcttaagggtgtgtttggatcccagccattgaatgccatagctacagtattttcgccacgctacagtgttttctgaggcggacgaaacgtccgccacactcctgtggcgagccacgccgtggcgtggcattccaagccgccaaccaagcagccccttatttatcgtccgagtgtgaagggtgcagaaactatttgttttctctccgaatgaaccattcgttgcacacttggaagaactatatatgtaaaagttgacaaacgtgataaataaatgtccaaaaatgacaagcatgaaagcagattaaatgaactaaaaaaacgtcacaggcacagcaagccaataatccatccctctttgcactgaagctatccagtcctaactgatcaatatggcggtcagaccaggtcaccaggaattcttgttttagcgatcagtaagtataatccatactacctccgttttttaatagataatgccgttgactttttctcacatgtttgaccattcatcttattcaaaaattttatgcaaatgtataagatataaatcacacttaaagtactatgagtgataaaacaactcataacaaaataaattataattacgtaaattttttgaataagacgaatagtcaaacatgtgagaaaaagttaacggcgtcatctattaaaaaaaggagggagtacaacttatatgttcatcgataattagcttatctatggtgctcacagttgtattaactctttaatttttttttgtaat

SEQ ID NO: 24460 - DNA, 1450 bp, Oryza sativa
gcactacctccacagacggcgccgacgccaacagtaccgcctcctggattggtgagccgcttccgtccacgggagctatccatgccatcggcgcagttaaacacgacgaacgccacgatcgctacggtcgccacgaagaccagcgcaatgccgacaacactcctgctcatgtcgggcggggagccgccgccgcctccgccggagaagcctcggccaaggccggcgtccacggcgagcctaaccattgtgatatatcgatcgatcgagctgccgcttgttggctgtgatatatcgatcgagcccccggctgcttgttggcgagatcgttcgggtggtaattatagggttggagagagcgagatacctggctacactagcttattttctgtgacacggtgcatcgcatctggccggttgcaatgtcttccatagagtggtgagagctactccctccgtctcacaatattcccactatatgcataatataccttttatacactagatgtgatgcattcgaccctgtccagattcgttgtcataagatgcgtcacatataggacagaatgacttacattgtagaacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcaga

SEQ ID NO: 24461 - DNA, 505 bp, Oryza sativa
cttcggaagatccgctcttcgtggaggttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattgttattgttattatttccttattcaccctagattaaacaaaaccccaactagtggacactctactcatggtaccactagtatgatgttaggtagatgcttcgctttttaattaggtaacattaggcggttttacaactctagactttgggatattcatatcacctggacactttggaattgttggagtattgtagaattggattcacaccgccccctctattcaaaatccccaaaatggttttaggctgggctcggggtgcatggttttgatagtagcacctcggccatataaggaccggt

SEQ ID NO: 24462 - DNA, 205 bp, Oryza sativa
agataccaaaatctgagactgcaggccacacttaaacctctaaatcacaccatcatattcaggcgatcccttagatctaggttgcttatgtagcattttggtttgatatatgtgaatatcaaggacaaaatccatgacacaaattagctcctctttcatcagcaatgcatggaacattcaagcattaaaaagaaatggcatctaa

SEQ ID NO: 24463 - DNA, 1501 bp, Oryza sativa
tcaagtgaattacaataaggaaaagataattaaattacaataaggaaacgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgtataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaattaactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttcca

SEQ ID NO: 24464 - DNA, 1501 bp, Oryza sativa
actttaactgtttagctccgtataaaattatgcggataatctcctagtgattgtgtgttaacaaagcacgctcaccatggaacgtgttgcgtatatatgtgtagcggtgtgcagtgtacatataatgtggaaataaaaccgctaggattctaggaagtttgatcgaaatatcgtgcagattgtaacgctttacttaattagttacgtacggcagctaggtcgccgtcgtccaccggagcacgccaaaccacgacgaaatacacaccaatggatcgtactagagcatgccaaactgcccattgccaagtcggattcagattaagtgacatagggtaaacatgtcacgagatgacatagcgtagatttcggtcctccaaaataaatccaatggctgagattcgtccacgtcattacgagttttcgaatttctttgaccaccgcctcggagcccttcttcaacaactatatgtgactttcttttcccccgagtttcgaacccctcgagttgaaccatgtagatctcctcctcctcgttgttgttgcggagaaagaccgtattcacgtctagttaaaatagatgcaagtcccctcggccgctactatatcgagaatcattcggatggttttgagcttgactgcttttacctgaaaccatgcggcactcaattgccgcacacgcaacgcagcgcaattcactcagccgacccacccttgtgggcaaacatgttgtgccgcgcgacgcgataacgatatttttcgccggcccggccgcctccacggtgtgagacgtgaaggcgatacggccgttacggccgttcgcgcgtaaaaatgccgactgagatgtggcggctcccggctcgggacggcgcatgcgcagcatcgaccaccatccgcgacggcccgccgccccgcgagagcgaacaaccacgggttgcgcggcccacgctataaggctacgtacaaggccgcgtgcagggcttggggttgggggatggaattttgggccttttggtggaatgaggggccgatacgttgcgttggggaagcccatcctatctgagagagttggagtttacacccattgggtcttaggcctgcctattagatcagcccaaatacgcccatttcaactcgtattcgatagctagagagacttcctttcccttaaaaaaaaaagtgagttcctttaagatttgagcacttttttttagaacaaagatttgagcactgaatcaataattaagtagtactactccctcaatggcggaggtaggtgtattagctggccggctcgctcccagcacgcaatgcaactctcctcgaccactgtcatgtcatctcatctaggccctatttgtaggccctatttggttctatgggctaatgtttagccctaacattttagcctcaaattagccctcaaggatccaaacaggtggactaattttgtatggggaccatcaagggatgctaatggggttaattttgcgtggggaccatc

SEQ ID NO: 24465 - DNA, 841 bp, Oryza sativa
aatattttattgcaaattagacttagtatgacattattgactacggaattggtgcgactcctagcaattgactactgtagtcttaattagacttagcatatacacacgaaacacttagcatacatgactattttagtcttagcatgtaatattatttgagttttaatataatattactttatttgtaattagacttggtatgtaattattgactacggcattggtgcgacaagtagcaattgactattgtagtcttaattagacttagcatatacgcacgaaacacttagcatatacatgactattttagtcttagtatgtaatattatttaagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacacacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 24466 - DNA, 1501 bp, Oryza sativa
cttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaaccaaatacgaacacgagcagataagcaacaactcgtcacgcgtcaaccgccgcagccgccgccgcagccaccgcccccgcacccgccgccgccgcacccgcctccgccggagtcaacggccgaggcgatgatggcgccggtggcgagccccgcggcggcgccgacggcgagcccggctcctgggccgaacccgctgcggccaggcctcccggcgttcgccgccgggtacgcgtaccccgcggggggcggctgcgccgggtagccgtacgcgccggcgggaggcggcggcgggtacccctggccgtagtagtagacgtcgttcctgttcttccgccgctgcctcttggccccgtccgcgcagccgaacgcggcgacggctgccacggccaccgttgcggcgacggccaagatcaccaccgcggccgggctgagggaggcggcggcgcctcttccaacgccggcgtgaagggcatggagagccactcccgctctcaccatggcttgcgcgcccgataagagaagagatggagcgaatgaatatgaatgcgtgtttaaaagagagatgagggtccacggatttggcatgattggctccttttggtcaaagtctaccatatttgattattgaggagtactactactgtatttttttttaggagagtagtatactataactaatatcctcagatatgtacgcgaatatttagtattcaaataagtaaaacgactcgtacaacttgagaacatcgtgccctccagcatctctcaacgtcaggaaatttctgagcctgactggatgtggatgaatgtctctcccatgcaattgcagctaagcccaagcggttgataattactacctcctatagatgacgccgttaactttttctcacatgtttgaccattcgtcttattcaaaaattttatataaatgtataa

SEQ ID NO: 24467 - DNA, 330 bp, Oryza sativa
cacaaaaatgggttcttgacttcttaaggaaaaattagagacttgaacggtccaattccgagttcaaatggccaagttatggccatttgaaggttatatgctctttaaatgaatatttgcgaatttcttcatttaaatattaatttaaaatggatttattgcgtcagccgaggggaggggcgcgcggaccgggtccacgggagtggggcccacgcggcagcctcacggtccatggtggaccgggtgcacccggctcacaccggccggcgccgtgggtcccacgcgtcagccgcacccgagggcgcgggcggctgacggccgggccccaca

SEQ ID NO: 24468 - DNA, 534 bp, Oryza sativa
atctagtggaggaaaacacaaatttcctctcactttatttcagccacaatgtgagatcaactaggaataagatccctcgatacgatgatggttcctctacatttgagagttcttgtaaccttcaaattttccagtaccctggtcggtgttttaatcgtcgcacatgtcgtgatctaacagtggaggagtacaaggctgctttcttgtatattcttactaatatttctgagatggacactttgtttgagtaagtattcatattaaaaaattgttttaacttaataaattcctattattttccctaatccatccctacatatagacaatttgataaggaacaatggaagagcagaattgcacctagtgataagcaacgtcatgacttaagattaaatggttggaaatattaccgtggaactaaacatgggccaaatttctttgactggttcaagaaacaagtaattctgcctactttttaacttcctctccttccctttatttgaaatattctaaactagtaactttcatttatgc

SEQ ID NO: 24469 - DNA, 1501 bp, Oryza sativa
  unsure (1)..(1501): unsure at all n locations
atggaactgaaacttaagagaggaacttagcttggtacgatgatagcgtccgctgcgatgcatggaacagcgtgtattggttctaaaaaaaaaaaagaacagcgtgtatttgtatgtcgacttccattttcctcttcttccctctcagaataaacagttttattgcttcttacatcaccggcaatggcgttgatcaactgaaaagtttaccatgtcaatcagaattcgccctccttgtgaattgaaaattttcaacttgtgtcacaagtggttctgttacatgaacagacagataccgtcataccaagttaccaactcgtatagtgacattttgatgggccgcattcaaagcctcaaccttttgtggggccaagagcccattaatatgctagcaatttctctaggaaacatgtttatttacagtacctgtagtacaagatgacacgttgagtactccctccgttttaaaatgtttgacaccgttgactttttattacgtgtttgaccattcgtcttattcaaaaaatttaagtaattatttattcttttcatatcatttgattcattgttaaatatactttcatgtacacatatagtcttacatatttcacaaattattttgaataagacgaacggtcaaacatgtgctgaaaagtcaacggtgtcaaacattttgaaacggagtaatatttgagtgtctgcactccattaacgttcccgttcaaacatgacatcatacatgcacttgctgtcataaacttgatagactcagccgcttcctttggattgactgataaaattttcaactcctattacttgctgatcctgctggtgttctgtaaaataatattgcactgcgtgttctgcgtacacacgtactctaaagtttgaacgacgtgtaacggcatatgcatatgttaatgatcctaagcagtacgcgtaagcattttttacttggtagtttagagtatgtgccaagtttctgtaaattctccctgcgataccgacccnnnnnnnnnnnnnnnnnnnnnnnnnnnnnnnnacaggtcaaacgaactgcgaaattgttccgtgaacttaactgataattcaagtttcaagtttcaagccaagaaatgaagtacacctctcttgctctaggtaagcatcattcatgtgatcgtctcgtgtgcttgacttggttttttttctcgttttaatttcgtttaatttctaatggaaattttgtgcacacatgtagctgggattatcatcggtggcattgccgccatcctggtcttgaagttcatcatgagatgcgtggaggccaagcacgccgaacgcgcgaggcggcgggaggaggaggcagtgccagtgtcgccgccggcgagcggcacgtacagcagcgtggacgtccgcgtcgagatggggtcggtggaccgcttcctggacgacatcctccgggagaagccggcgcggttcacgccggagaacctccgcgagttcacgggggactacgcgg

SEQ ID NO: 24470 - DNA, 1501 bp, Oryza sativa
catgtccaggtaagttgtgtaatgaaagaaataacactcatttgtctcagtatattaaaaaaatccaacctaagcaaccatggtacccttttttttcttttattttgttaagagaactaatcgtttttggtagcagaatgtcaacaacacatgcagcagttcacaagcctcatgttgagaactgtaacacctgggcataacctcattcttagttctaaattatggtaaggtagccaggaatgtcacccctattagaggtttggaaatatagatgtctgaagcttgtgacatagagagcttgattctagtaactttttgctattctagctggattcgattttgttttacatgaagtttggatatatggtgtctgcgatgggatattaaggatttaagtgtaattgttttattgctgccacaaccgttagtgttgtagtatactgatttctgctagcattggaaataatggtttgccacaactgtttctggtcatgtcatccaaagtcaggcatgcgatttctggcattatttcatttcaatgtttgctattacttcagtggaaagtctagctagccatagatgttttttttctttataaggtatatgcatgttcattggatagatacttctttcatcagaactttggcatcactgcagtgcatacttccaatcgcatgacttaatgttcggacctatttattgcagcgaactggttcttctcatgcgggctcacagcaggaagctgaaaatgatggaaccactgacaccaacatgggcagtgaggagaacgtggtctgtgaggtgaacatcggctgcgaggcgaacaatggatgcaacagaaatcaagtttgcagcagtggacgggctatcgcagcctagcttcttgcatttgcacaatgcatcggtgacgtggacatggcttttgtttcgcacatcagtacttagcccatatattattttggtagcaacttagtagatagagacttcggtaatacttcatggcctgtttggtggtgactaaactagatgagacttaacatagtttatgctcttttggtagcaacaaagtcagattacacatgctcttctgaacacttaagtagtggctcacaagtgtattggttgtaagtaatggctaagtagttgtgcaatgtcagttagcatgtcaaggtgatatggggacacctattggttgtaaacctgattactcctatagaatcagtactagaacttgatgtactgcatgtatggtgatgcaagtatatgaaatggtggctatttgaatcaattggtggctgagatgatggctatttgagtcagctgtgatttggcattatttgaatgattttgtgatttctgggcatgttatttgtgaagctgttgtgatttcattgtttggatgcattctattatgtaagtgaaatgaaatcagatctttttagcagcttttattagctgtttttttttcaatatgctccaattattctgacggttttattat

SEQ ID NO: 24471 - DNA, 1501 bp, Oryza sativa
gtgtgtgttgggccttcgctgcccatgtaataaattaactatttacgcttccgcttgttgaactctgaattgtatcaacttttggtgtaccttgcctcctgggacaaggaataatgcacgcacgtaaggaacgcccgttgggttatttccggtcgtgacaaagaggatgcgggagacggcgcgggtgagggcgtccttcctcgcgcggagaggacggtagttgaggttgagcggcgtggagcaccagaggtggtgccaccgggaggcgaggacctgcgtgctgccagcttccttggtggggaggcgggcgatgatctcgccgaggatggcgtctgggaggttgctgatgatgtcgacgccttcttcttcctccgcgtccccaatctcgggtgcctttgacctccgcttcttcggactgtgacccgcgttcccgacgtggtccatggctggcgcaggcgggactctatgagcgatgcgagaggacggcggcggccggcgtgcggcggcgtccgatgcggagttagtgcacgggagaggcaaaatgcggcgcgggggattaggggtttcggggaggggaatcggtggccgatgtcttctttcttttttctgtgtgtaacccaagtaaggccattattgggccagcgaatcgacccagcaaccagcatgattcttctttttcttcttcttcttttttttttgttttgacttttcacccgttgctggcaagtgtgtactggaactggaagagaaaattcacagaaaacttcatgactcattcacaatcaagtgtttaagtggcactaaaataatggataaaaattgaagtgtttttgccttacaagagaaattaggttaaataactaaaatcggcgtgcttgtgggcatgcctaacttatagcccgtgtacattatttggatctttcgagcatagtaattttcaagtatttactttaattatttcataacttgtacaataaaattttacatctagaagtagcattttaattaataattttaatcttactttgccagtagtggactattcgtgtatattttttttcttactttgcaaaattggtgaagatgatattaagtacactttttctttctaaatactgtgactttcataaaggcagaaaattttgcatttacacctctaaaaatatataattatgtcttatttttcttcctaccctggactggacatgacctttttataataggtttaaaattttatgcttggtaaaggttcctcaaatcaaagtatacatttttcttcctaccctggaatggacatgacctttaataggtttaaaattttatgcttgttaaaggttcctcaaatcaaagtacatttgactgggcatgacctttaatatacaggtttcaatttttatgcttgttaaaggttcctcaaatcaaaatacgatgtcaaagtgggacatcgtacaatacttgccttgacgtcaatttcattttcaattctcgagcggaaaactat

SEQ ID NO: 24472 - DNA, 628 bp, Oryza sativa
cgccacctcatttaaacggtttcgtaagttgggggaccagttgtacccggttttgcgaccaagggacgaaaatcggactgggcgacaaatagagggacccaatgtgaacttatcccttgtcataacgagccagctcactagctaaacgaggtcaagtcaaaaggcagtccaacaaaaatatttagaggctcagcccaactaggcaccaggtataaatgcaaacaaattaaccttagatccctatccccccgttatctcgatcccagtgttgcactctcgctcccccccatctcgcatcgagcctccgacgctcccaacgccgtctcgacctcccccatcacgcctcgtgccgccgccagcagggtcatcgccggccgttggctgccctccgcactggatttttcacattttggtccttttaaaaaacttatttcgcaaatagacccctaaaaaaacttatcccagaaatggtcctttttgggccgccagagtggctggtgccgtcgtccaacgggacggggccagcctctcttgcgccgtcctcttgccaccgtggtacacgcgaaccgacgtggcaggaggagggcgccaaaatggttgcaccgccctagggaggagagcgccagca

SEQ ID NO: 24473 - DNA, 1501 bp, Oryza sativa
caagatcttaatataatgggcagatttaacatgtcaatcaagcatatggaataactatagttaaatcaggtaagatcggctgaaaccccgatgctaccctaatcgacaaccagaaggtaggctaaaggttgaaattctaagcacgacttaatagatcaaactcaactgatgcagcattaagtatgaaaagaagaacaatatctagacaatcaagccgctggatgtgtcatagagtggtagatatcctatataatctaagccaacatcgttattttacctaatcggctgccctctattagcagatgttagccgattatagattagatgacgatattgtcgaagattatgtaagatatgtgataactcgacgaattacataaacaagattagagtatcataaagatggaagcactaatctcgagaacgcaagccgccataacaagttttacctcttgttgaagatcgaaaccgatacagctcaacccgaaagcaataactcgtcaaaacaaaacgaaaataaaaagggtggcgatgcgccgagattgtattgaacgtgtgtttatttgattacatggggcttgggatctatttatacccgagaattacaaaacatgtccatatcggacacgactcttatctctaacaaactctaagataccataagtctttgcggcagacttttgctcaaacatatctctaaggaaattacataagatatcgtaattaatagatacaattgccttctcaggactctatccatgcatggaaatcatcttgaagcatatcaactcgacccgctgacgtataccgagtcgtattgtcggaattggccatatcggcttacctagtctgactcgaactcagtcgatcctgatcgtagccgatttggactcagtcgattcttactctgtttctgaaacgatcttcgtctttgattccactttgatctaatcttcatcttcgatactgatattaccaaatttggttgttaacagcgtgtatattatcctaagttaatttcctggggagggtactcctccgtatttagccccggttgtatggtcatgacgggctgtcgtaatgaactcgatagtcaggggtggcttctcaaagtaccaggagggcattagatagagggtattagctagtatatcagataactaggatgtatgtatgctatgtatactagaagtataggaatagattctctttctattttctttccacttagcttagtgttgacgaaaaaattgaacacactggcctaggaaatctgcttaactcctgtgcaggtccaaaggttggtgagatgcgggcgtgccagtcagtttgatcctgcaactgacaagatatgtaagcagcaggtaaaacagccgaccggctgacaagccgatggagtagttccagccaatgccgataccagccgatagccgatgccagccgatagcgatagggttctgagctatcggctttatgtccaatgtagatgatgatataaagg

SEQ ID NO: 24474 - DNA, 1501 bp, Oryza sativa
cgcgcaatctgcgtgggccgccatgctagtttgtctaatattgttggtttagattgatcaatgagagaattccttatatgccactcaaaatatagcccattcctttacctgccactccaatttgacactttccttctatgccacaagctcaaatttgtccaccctcctgtgccactaatgtcactccaccagctgttgacttatttcgaacccctccaataggtaaccacgtcaagccattagaagcccatgtagttattgcaaatcgctcccccatatcggttcaagggccgcatgcagcctcttaagagccccacttgtaaaagtaggagatatttttccaagcaggcctcttacgcagccacatgcgaaagtcagattttcacaggcacctccttaagaggcccgcttgcgaaaatcactaggtactaaatattaaaaaaatcttctccgctcctcctccacctcccctctctttctctctcactctcactctcttattcatttctccccctctctgtctctctcactcattctccctcttgtgtggcgctaggctagagcggctgacagtggacaagagcggttggcagtgagctggagcggcaagcgggtcggcgatcggtggcaaggagctcggcgatgaatccgatgtggaggacgacgggagcagtggtggcgggctcgggtagctggagcgacctcgggcagccgcatagatctggtgctggctgcccttccctgcacgggtccggtggtggggacccttggtagcaacgacgccggacaacagcgaggatagcagatctgacgggcggtggatccgacgatgacttattgactgctacgaaggtctaccacaagcaccacgatggtgatgaggaggtcaacaaggcggcggtggctggcgtggggacaaagaggtgcgggtccatgatgaggcagctgtcacaccctgaagttctcctcccaagcctaaaattcaatttataaatgaccctaagaaaatgccggtgcaaatcaagagaaaaccgtaagaaagtaatacaaataataatcgaatatggcatgtggaatttttcttgagttctacatgtcaaaattcactaacaggatttttagtggaattttcaaagccctagaaataattttaaccaattaaaattgagcaagcaatattttaattccagggaaaatccttttcttcctttttctttttccccttttcttttcgagtgggccgccagcccattctccttcctcccctcccctccgctgggccggccgaaggccaaggcccagctaggccggccgcctccctccttccacccgggacgccgacaggtgggccccacctatcaggcccgtcttctacctcgcgcccgcaaccgccgacgggcccacacctacggcttctccgggccacgtcggcacgcccgcgcatgcgccgcaccttccgcgcccacttccctctttctctcgtccgcccccgcgcccgaga

SEQ ID NO: 24475 - DNA, 1501 bp, Oryza sativa
ctcggattgagacaaattttatatggaaattatagctctcgacgagatctacaattttataggtgataattttttcatttgaaatcttttagatattcaaatatatgatttaaatctcagttagctaggctcaaatggaactatatgtattttccaacagaattgatgtgtaggtgagttggtaaaggagagcacacctaaaggacaggatttgggttcgaatcctagcaaagacacaaaataaaaaagatatctagataaatagataggatgatagattaatatttgaaattttaatttggtacgtaaaactaatactacatatggagtggtggcaataatttttattacaacaatgtgaagtgttgcaatatgactttttgccacattcattccgtagcaacatctaaatttattaccacaaaataaaaatcgttgcaataacctattaccacgttgtttattaccacagctagcaacgattttacaattgtggcaacatatatctattgccacaattttagtattgatgccacgatttttttcatggcaacaaatgattttttgatttttctagtagtgatttaaactcaagacctctctctccatccaaagcctccataccaactcacgtacaaacatctgttgtgttggaaacaaatgatatcatgagactcctatcatccgaatttataatccatatttaacatcgttgatgagttcaaatgaaaagcttgtgaactacaaaattttagatcttagatttgcaactttcatatatgtttgtctccatccgatatcgttaagagattttaaatatttacttatgcaaatagatctcagaccttgtaactcattttcagatttttaaactaccttaaatcgaaaagtcataaactacagagtggaaaagcttgctaggtaccggttttaagcaaaccggtacttataagatcgatctctatgcgttgttttagtaatgcatcctatcaaaatttcagtgtaaaatgacttgtatagaaacaaataaaataggataatatcgttcgaaagcaaagtgaaccattttgaaaatagtttatgagtaaaatgggccgagaaatattgtagaggtaaagtactctgaatggtttgacggagtaaaacgattttttttctttgaattttacgtgcccatcaacttgcgcacacttttacgtgccgatcgtaatttaccgatcggatcaagacctgctaggtcaattaatgtacgtatctggaaacttactgcgcatataatattattaagaactttctacaaatttaattttatgctcgcagcctagttggcatgccgcagttatcttgtccgcatgcatgggcaattggacaattagcacgttaattggaatttagacccacgtgttagtttcactgactaccatccccaaggtgaaagtgttggtttgtccccttggttaatatatacaaattgatcatctcaaaatagtttttctattaa

SEQ ID NO: 24476 - DNA, 217 bp, Oryza sativa
aaaatattgttgcatgtttatagattttgaaattttaattttaaaattacattttgggacaaaaaatgacttaaaataaaaaaattcaactacaaagttgtagatcgcgtcgaggactacaagtttgatataaagtttgtctttattagagttcacatgaaaaagttatgaattatttttaaatataaagtctttaaaccgtcctattggatctaga

SEQ ID NO: 24477 - DNA, 373 bp, Oryza sativa
cgtgccgagcccgcgcccgtggttcctcaggagggggaagcctccggcgtcagtagcacggaggatgcgctgttgctcaccttccgtcctggcccgtcgcagcggtagacgagcagttagtaggcttgcgcgtgtgttctttctcgtttgtcttcttgttggggtcttgtggggcatggttatgccggtgtgtggcataactgtgtcggagcctgtctttattttatttgcttaagcaacttgaactttaatgaaccaatttaatagcagtaataaattcaagagttatggtagtcgtggatggttagctttaattgtcagctctctctgtttggtggttctgtgtggggttttcagatggtgacgaccagga

SEQ ID NO: 24478 - DNA, 1501 bp, Oryza sativa
  unsure (1)..(1501): unsure at all n locations
gtaatattagttgtgtctcatggtagattcgtagagggcttgagatataaaccactttcattattaaagaaatacaatacaggggttctatttttttttctctaggaaaggatgcttggaaatgtcttgttaattatgatttattgtgcagctccctggatggaaagattgttagccattgtagggattatctatttgattatagggatagattaaatatttcaaattataaacttcataagtagcttaaaacaagtggtcaaaattgaatagaacttctttaaaaaaacatatttcttttgaagctttagagcaaataatttaaatttcaataatccgatgaaataatatgaaaagaatagggcgtatatgggacatatacacagattcaacaaataatgttataatcaaactttattaactttgaacaaaacaataccagaaatagtatttggaattgtggtatttttcaaattgttttatataattattttttactaaaatatgtacataaaaaaacaaaggtcaacaatgctttttaagaccatctagatatataatctttatatacaggattattttccgtgaatcatgctagattttcttatgcgtatgcaagttggcgatttcggaatgtaggaacatagaggtcatcatgcagtagttctctacgagtacttttgaactgttcaagcacaaatcacaaatcacgatcgtggcatcaggaaactgacataacatagcctaaaaaacccttgtttgtatttaaccctcatttggcaataggaggtgtaattatccgttctccgagcagtttggtttgccgagtgtaatttttttttgacatttgccaagtgtaatttggatatgataggagccgtattaaggcccggtttagttcctcaaaagttttttccaaaaacatcacttcaaatctttaaatgcatgtatggagcattaaatatagattataagaaaaactaattacacagttaagaggaaaatcgtgagacaattttttgagcctaattaatccatgattagccataagtgctatagtaacccacatgtgctgatggattaattaggctaaaaagatttatctcgcggtttccatgcgagttatgaaattagttttttcattcgtgtccgaaaaccccttccaacatccagtcaaacatccgatataacacctgaaaatttttaacatgatagataagaaccacccaatcaattcaaattctactgctgctgacaaggacacaaaccattggaaatgtcaatgcatgatgatggctctagagactagtgtcatattattcatttcctggtttcatctccaagattgtgactccatcagcaataaaacaagagggaaaagttaccaactcgaggttgaattggctaactgtgacagtatgttaatccactagacgaaaatccaaattaccagtaaaattaagtcttgcatgatatacccaacaaccggtgagacgangtg

SEQ ID NO: 24479 - DNA, 788 bp, Oryza sativa
aaaatattgttgcatgtttatagattttgaaattttaattttaaaattacattttgggacaaaaaatgacttaaaataaaaaaattcaactacaaagttgtagatcgcgtcgaggactacaagtttgatataaagtttgtctttattagagttcacatgaaaaagttatgaattatttttaaatataaagtctttaaaccgtcctattggatctagatgatattcaaatccaaatttagagaccggggtgacacaactgaacaagttggaggacctaaacgagtgatctgcaagtttagggaccgggatgacacagttgaacaagtttgaggacctgaacggtcgatttgtgagtttagggaccgggatgacactgcggtacaagtttagggaccggcgatggactttactcttgttaaaagcaactctaatgataaaataaatcataataaatgaaatgatgaatatataactttttaaataaaataaatggtcaaacatgatttaaaaattaactgcattaaaccgtcacgttgcttctcccgttaatccaccgcccactagcgaccaagcttattagttatcgggatactaggtagtatcgttttgcttaaaatagtatcgtatcgcagtatcaggatactatgagattttattttttttaagtttaattaatatttatattaattatgtatagctattctatataaaaatatagtaataatatatgttatgtaaatagagacatttataagaaaatacattatgtttgatatatttaactgatt

SEQ ID NO: 24480 - DNA, 192 bp, Oryza sativa
ctcgtccactcctccgtatcgcccgccgaccgccggagcaccgtcgtcctcgtcgacccgagccgcgccgccgcctctctggacttgggtcgccgtttccgtcgtcgccgtcgacccggggtgagccgaggaccgttgtttcacttcccccttccctcccctctctcggccgccgctccgtcgcgccggagg

SEQ ID NO: 24481 - DNA, 1501 bp, Oryza sativa
ggggaggacccctgggcttcctggcacagtatggtctgggacctaacctgttgttggtctgggacccctctcgtcggcatatggtaaacctgtatcggctttcgaaatgccttgccatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactaccgcttgtgaatttgctgttgagaaaatgggttcgatgtttgaaaaatcagcagctgacgggatcagctaggcccgggtggccgtttgaaaagttgttggcccgggtggccgtttgaaaagctgttggccgggtgccaatcttgtttcaaatctaaagactgatacattgcacatactccgaccggacaagacgcactgtctcatccgtgtcgtttgagaagcactcacttagtcgtttttagaaaaaaggagttcaaataaaatcaattgcaaaaacaacagcctctccttgaagcctgcattaaacacttatttcccctggcttgctgagtacccccgtactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctgggactggtatcgattaacaggttaatttgaaacgtcacgggctagttccggtcgggactatttcggggcgtgacatatattccctaaataaccaataatcggataatgcggtgagaaggatgaaacgggcagagccaaatcatccctgtgctgccttgtgtaattcctataaacactcctaaattaccatctggcattctaataaataaggtcatgggccacatttacttatgtacatacaccatcaaacgtacatatgtaggtacgtacaaacacccgctcatccccctcccctttattattatttttttttttggggggggggcgccaatttagtcgttaaactttcgctttgaggtcaatatgatccttgatatttcattttgttcgaactagtcctcagagtttatctttcagtctactatggtccttggaaaaaaaaaatcacgttgccatgccatcttgtaacataatctatttggtgtttgaatctcctgaagatgaagatggagataaagattaagtgtttcacgtaaaacgatgtgataataacgtgtgattaattgagt

SEQ ID NO: 24482 - DNA, 1501 bp, Oryza sativa
gccgtcgctcgccgcgtgctcgccgccgtcgccgcccgagctccgtatcacccgcttgtcgccggcctcgctcggcgtagttccgcccaatccgacgctagcatcgagttcccgaagccgcgtagatgctctcaccgccgggaatcgacctctcgtggcctcgtcgccgtttccctcttctcccgccgccggttgccaccgccgcaatccgccgccgtcgagcaacccccggcaaatccgagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctacctcccgccggcccgcgtggcggccatgtaggcgccacgtcggcgccagctcagcccagaccgggtcgggccgaccccggtcggtccctccgcgtgcgcgcgttccaccgcaagccgtgaggctgcgcatgggcccgccgcacctgcgtccgccgcggaccgcgcgcgtgcaccgcgttcctccccgcccgcgcacgtgcgccgcgtgctccctccgcacggtgagccgagccgctgacaagcgggtcccacccggggccacgcgtggtgagcccggtccaccggactctctctcctccctcccgcgcgcgcgcgcgcttgggccgtcttgggccggccggcccgttaagctcggccgagccgccccaaatctcttgggccgcaccctagccgcccgagaaaagtctatattccctccctcccttcttttctttttcttttccaaaaaggatttaattaaatcctttttcctttagaccaaaaatccaataatcttagaaattcaatatcttcccaaccgtgactccgtttgactccgttcaacttccaaaattcatcaaatctcgagatctatctaatggcacgcttagaggtcattaatagggctttattttcgccgtttgttgagtcgttccgtttcgcgtgtagattcagagcccgaagacccgcagtgcgaggatttcgaggatcaagctccagatctcgagcaaggcaagccacctttgaacatcttgagcctatcattgaaatttaattatattgcttgaaaaatattatgcattgataggaccgcacttaatcttttgtcccatctgcaaggcagattggtggacctacctgacttgttgcatttgatccttccattgttaattgccataccatgtccccttgtaaccacccagttgcgcctcgatattcgtgcactctgtgcgagtatcgacggtcgccttcaaacttaaaatctgagtaacaacctaggtaaaactggagttttacaaaagacttggaaaacccgacacctgggtcggtgcttgtgaactaaatggatttccaaaaccgcggaccggggaacgtaccgggtgtacggtttcccgctcttgcacctaaggaccgtttccttggaatttcatccg

SEQ ID NO: 24483 - DNA, 209 bp, Oryza sativa
gagaagaaaacggaatacaaaataatagcaggatgattcatggttttttttgtctatccatctaatcaaatttgatcgaaatcacgctaatgatccatcaatgtgcctgatgtttatacattttttgcctgctgctactgcaatctgatatgtgttcagagtcatctactcctagcaatgggaaatttaactatttgccactcttgtga

SEQ ID NO: 24484 - DNA, 1501 bp, Oryza sativa
aatcccaggaattgatatatacactaggtcttgttcgtttctccaacaagatggagatgaaattttggatactcgtgatatgcttttcaaactactaaacgttacgtttcgtgcgaaaacttcctatatgaaagttgctctaaaatgtcagattaatccattttccaagtttttaataattaaaactcaattaatcacacgttattatcacatcgttttacgtgaaacacttaatctttatctccatcttcatcttcaggagattcaaacaccaaatagattatgttacaagatggcatggcaacgtgattttttttttccaaggaccatagtagactgaaagataaactctgaggactagttcgaacaaaatgaaatatcaaggatcatattgacctcaaagcgaaagtttaacgactaaattggcgccccccccccaaaaaaaaaaataataataaaggggagggggatgagcgggtgtttgtacgtacctacatatgtacgtttgatggtgtatgtacataagtaaatgtggcccatgaccttatttattagaatgccagatggtaatttaggagtgtttataggaattacacaaggcagcacagggatgatttggctctgcccgtttcatccttctcaccgcattatccgattattggttatttagggaatatatgtcacgccccgaaatagtcccgaccggaactagcccgtgacgtttcaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtcttgtccggtcggagtatgtgcaatgtatcagtctttagatttgaaacaagattggcacccggccaacagcttttcaaacggccacccgggccaacaacttttcaaacggccacccgggcctagctgatcccgtcagctgctgatttttcaaacatcgaacccattttctcaacagcaaattcacaagcggtagtcaaacaaaactacgctaggaatcacctcacatccgcccatgaccgtgggcacggctgttcgaacagtttgttaacctctgcagagggggtacactttacccaca

SEQ ID NO: 24485 - DNA, 540 bp, Oryza sativa
atttttgcatcctttccaccgacgagatcatcacggattcatgtcagttcggtgcgagcgattcgacgatctgtccttagggggccccccgggggagaaagggggggggaaaaagcgattgcatcgatgcatgcagccgtcaggcctaagggaagtcaaggtggaatatttttttattgtttcatgttgcgatggattagaattcaaacgtggatccctcttctaattttatttgggtggattagagtctgattccttttagttttgtttttgtgtttgagttgggaaatttggaatcttgagaaggcgctaaccgcgcgaggcagagaaggtgctcaacgacggatgaaaacacattgtgatgatgggaaaaatccaaagttttaagtagggatagatttgattcagactctagaattctggatgatatttgccgcgactggcttttcaatctatctttgatttgtgatttccccaccatacactatcaagagtttgattcgatctctgatctgtcttttttttcctttttgctttagc

SEQ ID NO: 24486 - DNA, 1501 bp, Oryza sativa
gaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgccatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactaccgcttgtgaatttgctgttgagaaaatgggttcgatgtttgaaaaatcagcagctgacgggatcagctaggcccgggtggccgtttgaaaagttgttggcccgggtggccgtttgaaaagctgttggccgggtgccaatcttgtttcaaatctaaagactgatacattgcacatactccgaccggacaagacgcactgtctcatccgtgtcgtttgagaagcactcacttagtcgtttttagaaaaaaggagttcaaataaaatcaattgcaaaaacaacagcctctccttgaagcctgcattaaacacttatttcccctggcttgctgagtacccccatactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctaggactggtatcgattaacaggttaatttgaaacgtcacgggctagttccggtcgggactatttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggaagtgaacgccagcttcagttcccacggttttggtgagggtcaccacgtcgcccagcttcgtgacctcgcccgtttccttggcttctcgtgtcccgagtacacggggtactccgtggaccgtgttccccctcactg

SEQ ID NO: 24487 - DNA, 186 bp, Oryza sativa
tcctggcttatactccagttgagcgcctgtgaagatggagccgtaggcccgctagtccgctgctgtttatctttgtttgtcaggccttaagtgcctttgtaataatgtaaatattatcgatataataaagatgtgtcttttatatcatgtttgtatggtgtaccccggcttttcctgggacgggga

SEQ ID NO: 24488 - DNA, 627 bp, Oryza sativa
catatttcaagccctacaattgtaccaatcatatttaatttaattttgtttatattttttcatattgaaataatgaaacttacagtagcatccatcaatatgaagggttgtctgtcaccatcaacctcggcaaggaactaggcatctaccattctaccatgacaataacactaaatgttcagtttaccctgcaatcatcaaactcaacatcgtcgaagtacttgaaccttctgaaacaaacaagcagtcaataacacaacaatataaattccttactaagtctaaccaattcatcaactaacttacatatgcacaacaggtcttgcatgcgcaacaggtcttgcacggcgcccaaactgtgcatacgttctctttcggtttagattcgttggggccatttctatgcgaagacaatttcagaagtagcaagaacaatgactgccataattttaataaatattttactgaatagtttgattaagacctaaatgttatcacccctgttcattccctcatcaagaatataaacacgcatccgataagtttcaactcttattttagaaagagagcatagtcatccaaccgagacagccgcacaatccaatatgccaatgatcttggcacaat

SEQ ID NO: 24489 - DNA, 1501 bp, Oryza sativa
tgatctacgggatgcagcttggggttgtatgctgtgagtaaatgatgccgtgtgcatgttgccatagccctgaagtgatgttgctagtggaaatgcactgtatgatgttggctagacataaaactaaaccttcagtttaatgtgtgttgtatcgatgaatggtaaaatttgggctgagaatgaggccatgtggtcgcccgatgttgctagcctggagagatgtgtgattgtgagatatttaagaatctcttagttattgctgaaaatttgtgtcaatgtgttgatgaatctgtgagaacatatttatgaaactgtgatttgtgcttgtgaatctgatgtaggaatctgtgctacttgttgaaatttcagaccatctgcggttttatttcagaccatgtctgttgagttatcgttctgttgattttcagggatcactctgacatactgatcaccccacttgatcacacatatttcacatcctggtacaaccgattctaaaccgctgaaatgccacttgctcacaagagaaatcacataataaccatagcatgcccaggatgttttagctttggtcaaaatcaaaatgtttcaaatttgactaagtttataaacaaatatagtaatataccaaattagtttttattaaactaatgatgaaatatatttttataagaaatttatcttgggtcaaagatattactatttttttctataaatttgattaaacttaaaacagtttgactttaaccaaagtcaaaagtcaaagcatcttgtaacctgaaacggagggagtaccaaaagcaaaagcatgaacttatttacaataaaagaacttgttctacaattgcaagtttcaaaattgtcatgcattttgcatgcaccaagttcagttccccatatttcaccatcaggttctattggcattatagagatcatatcttctgccccttgaagatgctctccctagccgattcaccatacaggcatagtgcttcaggttaggctcaagggagtattcctccattctagtgaacaacttcttaccctcatcaaccctcatcaacaagtccttcatcgcaacaagcagacagaatggcaagaaaagtgaggctattgggcttaatttgcagaagctgaaatgacagtgaccaaaattgctgagttgggtttaaaataccttcagtgagcttctggtcatacagtaccaaagttgtgagtgtgacaacatatgtttttgttttgaccgaaccaaatattttcggtgcaagatcataatttccactctttccgtacatgatgattaatgcatttgcatctgatgaattttcaccgattaagtgttcggttaaataacaatgtgctggttgacctaatcgtagtctgcccaaaccttaacaagaagaaattatggaaaacaaactgttggtatcacattcaacagcctctcgggcatttcgtcgaacagcctcacggcgcgtcgcggacgctgcggtgcctggcg

SEQ ID NO: 24490 - DNA, 302 bp, Oryza sativa
aatttttccttaagaagtcaagaactcatttttctgctttgtttctgctgttgtatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagtcatgcctatttacccttgtta

SEQ ID NO: 24491 - DNA, 1501 bp, Oryza sativa
accactctgaataggagtcacttttcaccagtttcaacagttagatgattctttataccttgtttcatagttaagcgatatgaatcagatccgatttatatttactttaagagaactagcctagagctcgtaaaactagaatattagagaaggacctaatatcaaataattaggaggggtgaggctttgaacccaagtcgtctagcccaccaccttgtggagctagtcggaagacccctgggcatttctcaagctagcctagagctcgtacgttacaacggaaaacaaactgaaattcttacttattattaaatcaattaataaacacttatttagtctaagtaatgttatgattattcttattgaacaaataagttattttgaattttgggggagtcaatagtgatataggagaaaacttgttgaaaaatgatgtaatagtatagattgtggtcattagatatcagctgtaagggtgatgtggaagaacaccacccctactattaacattttaagtactctatatgtttcatattataaggtgttttgattttttttccaagttaaacttttatatgtttgactgagtttataaaaaaagtagaagtattttaaacaccaaattagtttcatgaaatatagtatgaaatatattttgataatatgtgttgttttgtgatgaaatgatactcgataaaattagtcaaatgtaaagaagtttaaatagaaaaaaaaattgtcaaaatgacttactccctcgtccctccgtcctaaaatataaatatttttagctatgaatatcagatttatagctaaaaatacttatattttaagacggatggagtaacttataatacggagagagtagtatagattaaattggacttttttttcgattttgctatatctcactcgaaagattttttcttatctcttactcgattttctcactcaaatttacagtgcattttcttataagttacaatgtaatttatggaacttacactgtaaattttgtaagttacattgtaatttttgaatcttcgcatgtaaattttaaattttgtattggatttggtctttttcttaaggatatggtaatttagtgtccattatggtgtttcttaattgttttttgttttttattatatctatcggattttaattcaaagattaaaaatctgtgtgatacaatcataaaaatctttcgagagatgtataggtactcttttttttttttctgacggcggagaggcgaggcaatggggtggtctttaacggatgggttgaaaatgggttgggctttaacggacggcccacatgtcatctggtccatcagaaccagcgacgcggagagactggagaactagggctccgcctccctataaggagcgttgccactagtggagacccgagtcccgaccacgacgtccgccgcggtcgctgccactgcactgcactgcactctaccccggcgagcaccacgaccggcggcgagaga

SEQ ID NO: 24492 - DNA, 1501 bp, Oryza sativa
ccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctccgcccgcttgtcagacggtgtcgggtgcccccgaccctcaggaaggccccgaggccactgcggggaggccgcacctatcactctctgaccccgaggctaaccctgtaccgattcgacccgggagagagcagggagaagaggcccccgagccgaacggtggcctaaggcccctgacgaccggagttggccctttgcccgcttgtccgatgacaccaggagcccccaacccccaggacggtcccgaggccactgtgggaaggccgctcctgtcgtcttccgaccccgaggtcatcggcacagaagacgggtgcgccccgaggggccactcggacgaagaacgccccgggggtgcggcccctagcgaagaagatcggcctcgccgaaaggtgcagcggcctgtctactttgttagtgaggccctccgggacgccaagacccgatacccacaggcccagaagatgctttacgctattctgatggcctcgaggaaactgcgccattatttccaggcgcatcgggtcgctgtggttacgtcttaccccctcggtcaaatcttgcataatcgagagggtacaggacgagtggtaaaatgggcaattgtcacgtcctgataaattcatcccgaaataaaaatcattcgctaaaaggcataatagaattaattaaaatgcgaaaagaaattggcaaacactaaaatacgtacaagaaaaattccaatgtggcccggagaatttttgttaaattctccttggtctaaaaagagccctcaaattttacttgaattttcagagcaccggaaataattattaagcaacaacaaccttgatcaaagtttattaaaaagaaaagctaaaaatccctcctcttcctcctttgggccaagcccagttcaaagtctccctctcctccctctctttctctccttctctccctcctcctcttgggcctcctcccctctcggcccagctccctcctccctctctctcccgggctgcctcttccccccccctcccctcccggcctgcccggcccaagccgcctctccctcctctcttcctgggccggccgccggcccaagccgccccagcccccgagccgctcccctcccgcacgtgccgcgcgcgtgcgcgcgctgacgccgccgcccgaccgcgtggggcccgcgcgtcaggcgggcgtcgtccccttcctcccgcccggccgtcctctctccctctcccgagcgagccctagcgccattcctcctctaaatccgctctattcaagccggctcttaccaaattgattaggggcaattaatccccattgattcctcttcgatttcccccgttttcccccttgaa

SEQ ID NO: 24493 - DNA, 1501 bp, Oryza sativa
tcaaatttggacctcaattcatctaaattcaaactcttcattttaatatcaaatttgctattttaagattttatttgaatttccttaatttattcaaataccatccgaataaatatttgatttaatcttataattgaatttacaatttaaacttatatttgctttccaaatattttcttttatttccaaaataccctttagccactaaaaagccgccggttggaactttacgccttccatggggacgttcgcggtctacggacctcaacgtcggaccgttggttgtaaagcccggcctaaaccaaacccaaggtcgaagtgctgctcctggaaccccacgccttgatgcgtacagcggtcggagcttcactatcccctcgacctttattgcacgccgcacagttagctctcgggctctgtgtgatcctagccgctccgccgctactcacggttgtcggagtaacacttccgccccactaaacctgcgcccacctcctattcttctagccgatatgctgtctatcgacacgtctagaaatgataccaaacctagtcgttatgctgtccaactctagcaacgactagcaaacacctaaaaccctagccgatatttatcctacctcgatatcggcctaaacaactaaatcctagccactattctatcaaagctaaccttgacccatattagccacatacctatttaaccatatcaactatcttgtatatttcctatcatccaaaccacgagagcctccacataaaatatagagcctagccgatatgctatcctactccacaaatgactcccatacaactaaaccctaggtattatactacctaaacctaccgctagcaaatactagccccataatccctataccctataaaagagataggttatacattaaacccaagccctctttaccgtttatcgttttcttattattttatggtttttattgaaattggttcttcctctttcttagtagagtctattgtcttttggatggcaacctatggtatttcaagaattggataatcaggttgcctatcttggatttatttgcgttggagcaaggcaagttattattcctcccctttgaccataattatcctatattctacattctattctatgcatttgccattcatgattttgaatgcataatctgaacatatagcaaaccagttatatgctagcttttgcttagccctgcctagttaaattgcataaaatataatgaacttagattgggacagtacgcaagatttggttgatttccgggtggctagtactgtctcagtcgatataagtttaccaagtacttatgtcaaacaaacgagtacgaccgcagcttctagaatggggacagacctagatattatgttaattaacaatgtggtacctccgtacagtggttcttatgtaagtcctcgcaaaggagacaaacttatgccgagaagggcaaatgtgatatttaccgaggcgcaggtaaatatc

SEQ ID NO: 24494 - DNA, 567 bp, Oryza sativa
atggcccgtcccatcagaaggtcattcggacgggcaaccatacaaatctccgtccatttatgaagagaaggcaagtcaagttggagaaaagagaggataagtccccacacaaaagagagagatggtgcatgtggtatccccttgagatataaaaggaggaccttgcccacttagagagagaggaaaaagggatggagaacgatccgagactgggattcggaaccagaaagggagagagttagagttctctggctctccagctctttgtagcttcttcatacacagatccaccaaaacacaggagtagggtattacgcttctcagcggcccgaacttgtatacatcgcccgtgtcttgtgtgtttccattctcgcgaactttccacagaccgagagcttagaacctcacccagggcccccggccgaaccggcaaaggggggcctgcgcggtctcccggtgaggagccacacgttccgtcatctggcgcgccaggtagggggctctgcgtgtgtttttccaagctctcgcattctttcgtgtgcgccaagcttttcctgttcagcccaa

SEQ ID NO: 24495 - DNA, 1501 bp, Oryza sativa
tgatgcggtcctcgccgccgctgccgcaggtcccggcgcgaccgacgacgatgacagttggtggcagttgtcggcggggtggctgttcagttggcggcgagcacaggtggtggcggcgtggggtgtggcggggagcggcgaggttgaggaatggggagaggtggcgcaccggccggtagagtagttgtgggcagcaacggcgtcgccgccccttctctctgtctccttgcctattctgtctcatctttcaccgtgttctctgagttgataaggggcaattttgtctcatcacctagtagaggagagaaaatcttttcgaaaatgaataaaatggcaaaaatggcaaagtggcggtagacgcacgctctatattggcattttatcgaatcatgtttttgagatggcattctagcgaaaccgcgttttgaacatggcgaaatgtccattttctcgtctctaggagtccaggtgtggtggttcccctcctgtttcctcctcttctctaaccaaattttacctgctgttggtggtgtatggcgtttgattaggggggatgagtggttgatcttgattaaggggaccataatattttcctgttgttctcaacgtttgatttattcacatcaaaggagcaaccaagacatgattgtgtggcatttctgaatctgatactactgtgctacttttacttttagttaatctggcttgttctccagcatgttgtcaattataaggttttaattggctaataagaaaaaattgccaaccccatctatttcagtttattcttttttgtcatagctaaagtttgaattttaaagcaatctttttttccctaatagctaaagtttgaacgttcaagcgatccaatcaaacattcacatctggaaattattttggtgctacaggtttgctgagaacaatttagcaaatcacatcaatgtacagtcatgggtgtattttctaatcaacttactatgttaggtgtacaatggtaaagtggtctgtggagaggaggaatcataccatgggagttcaagaggatacacataagtaacatttttattgataaatgtatttcgatatctccaaagaatctgaaagtagttctttacaacatgtgaaatgaaaccatataagctgaaagttatagaaacctgtgcacgttggtcgcatctaaccaattaactactagactactagaggcatcgtgcggtacccataaatcttttcaatcaacttgtcctaggattgtttgattttctaatgaaagatccagtggaaaagaaccgctatacctgtgacacggcaatattaggagttttttttttttttgacaaataagaggacccagttacctgttactgctagcagaccagccctgctgtatttttttctccactaacaattttgatgtaatgtacatttgataacttgatatactatattcatataatgttcaaaggggatttgacagatttaataacttgctacctacctt

SEQ ID NO: 24496 - DNA, 1501 bp, Oryza sativa
gcaatttaaagaatgcttatatatatagattcttcttgacgatacatctagttacacgacagaaaacgagatatgaacacacatgcttattgtttttcaacttttgccggcgctcttgcattgcaagtcgatcagaatcacctgctgctcgaagacgccgtatgtcgtgttgagaagaagggaatagaaggtgggccatcagcttggattcgtcctgtgtaacgtcctgagttttcccctgacctatcttaaattcttaatgtactaaaattacattaaacttcatataaatattctcaagccgtcacgtgggattctgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagcgcagtatggcgcgttcctttatccggtctgtgaccagtcacagaccggtcagatcacgggttaggtggcgactggcggtctgacgcacgccttgccccgtcccgtcaagacgaaagcctctaggcactcgtctcaagccggagttaagcgcgttatctattagagatgacacgttagccccggacgatatatgccaggcttcatcctaaccattacaggcgagatgttgagtgaagaagggcaaacatgcacgttgccaagattacacgcggtggacaagaatgaccgatttgtgaccggtctgacactgatcatatcgtcagcgcacagccatgttcccacgacgcgctcactcccggcggaagtggaggtaggtgtgggctgtcccatcggagcgtcattcggacagcaaccgtgctgatctccgcccattcaagagaaaaagaacagtccagtttggaaagagaagggtgcgtgtggtatccccttgaagtataaaaggaggaccttgcccatagagtggggggtttgttgattctttcccagattatgagcttagaacgggggagaagtcagctcacacttgtagcccattcatacacagatccaccaaaacacaggagtagggtattacgcttctcagcggcccgaacctgtatagatcgtcggtgtctcgtgttttctggctggcatacgatttttccacatacagagagagagcgagagcttgagatttcaccctaagcccccggccgaactggcaaaggggggcctgcgcggtcccccggtgaggagccaccagctccgtcatctggcgcgccaggtagggggctcagcgtgtgctttcagagctctcagactcttccgtgtgccccaagtttttcttgttcaacctaa

SEQ ID NO: 24497 - DNA, 1501 bp, Oryza sativa
caggatttttgttcccactatgtatgtaaaatggtgccccctgcctttctataaagatcttccatgagaatatatcgttttgatttctcagactaaacaattcttgcacaaaacaaaaggactaccgaccatttgtgcatactagctaaatgcccgtgctttgctacggataaaagaaaacgtattaatgtgttactcatcttttttgctatagggaatattcatcttactctagttttttatgtggctatccatttagatttaatctttttaatattaataagttcaggggttaacttgcaaatttacaatgggagtaggtgtagtgataactacactgtcaccatcactacattctttttaaagatgtatatatatgtatggatgtaaatgtgatcctcaactcctcatattgtatcttctcatgggagtatctcaaatgaagaaacctgaactccttctgtagttggctatgtgtacctctacattgcaacaaacaaaacctcttcatatggcaatgtgaaatcattgtcataattaatatttgtgacgaacaattggctatgcaaatgatttaatcaaagaattggtttgagagtttgtgtgaatgttggtgtgagtgcgtgtgactaatgtgggtcaggttgtgatatctgtgcccagaaacggttgttttgtctaattgtgtgcaggtgacttgagtccagccttggtcaatggtgaggaccgggactatgctcagggaggagcataggtctattgcggtcgggataccatgtgagaaggtgactagagtctggattcttggaggtcaacttcggtcaacggtggggatcgggactagactcagggaggagttgagttccagacggtcaaggataccggtgacgaagttggatacaagatagcatacagtggatggacatcgtgtgggagagatcttcgcaacgggcttcacgaggtgtgcgtgcaagtgccggtgttcgcgaagagaattgtaaagttggagtagtatatggtgctacagtacacgaggtactgtagcgtgcaggtatgcatgcatgtacggtgctgtacatgtatgtgtgatcgatacatgcatggtgaagcatgtatgtgtgcatgactggttggccgagcagcaggagagcggctcagtgggcttcggtggctgttggcggcatgccaagtcggcccaggagaagtaagggcccagttggcagcgagtcggagacggtcacgcgtggacgtcagcttgggagcgaatccgttttggatttctggtgcggtcggttgtttgctgcacgtttggaaattgtaaaacgtatggaaactgaaagatggagtcctattgtgtataggagttatacacatactttgagtaggggtttttttggtataaatagagagggagcgtgaggcttcctatatcgctttagagagcaatagagttgagttttggtttagggtttcgagtttagtcaaaatttttgtaaggagt

SEQ ID NO: 24498 - DNA, 1501 bp, Oryza sativa
ggctttcacatggattttaattattctatgcacaatttcgaggatgtattttagagtcgttttgggacgcgacaaacctaccccccttaaacggaatctcgaccccgagattcggaagaactggcgaagagatcgggatgggctgccttcaggttggttgccttcaccggtggcagcatttctcctggtcgtcaccatctgaaaaccccacacagaaccagcaaacagagagagctaacaattaaaactaaccacccacgactactataattcttgaatttattactgctattaaatgggttcattaaagttcaagttgcttaggcaaataaagtaaagacaggctccgacatagttataccacacaccggcataaccatgccccacacgacccaacaggaagacaaacgaggaagaacacacgcgcaagcctactaactgctcgtctaccgctgcgacgggccaggacggaaggtgagcaacaacgcatcctccgtgctaccaacgccggaggcttccccctcctggggaaccacgggcgcgggctcagcacgaggggtctcgacgaagcaagtccatgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcatctaggtccttcttgagctgcaggttctcctgacgcagctccaggatcttcaagttgttctcgaccatcccgcggcgcaccatctgatggaagtcgatacgagccgcgtcgtacgcctccaccatgcgcgccaggtgcacgatggtagcgtcatcctccgagctagcatcccggaaggtggtgtagtcgcgggctcctccgcgacgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcttggtagtccactccatgtggataccccaggacaacgcacatgccccgcagctccaagacgaagccagtcatgtccaaaccacgacgggtgacgctgccggccatctacaaacaaaaacaaaaagaaaaacaacattttaaaggtcagtttttggcgataaatgaagcagcaagacagagagagactagacagttttcacaaataacaaaggatttttatttttgaaaatattgctaaggcttgggatctacggctcgtcctagggtcaagggggctctgataccaacttgtcacgaccggaaataacccaacgggcgttcctgacgtgcgtgcattaatccttgtccca

SEQ ID NO: 24499 - DNA, 1501 bp, Oryza sativa
ttatgaataaaacttttatatacgtgtttttagcattctaaaagcaaatgctgaaaaataaacttcgataaaaaaaaatcaaaatcaacttcagatttaagattgaaaattcaaattttggctgataagtaaagcataagcgaaaagataaggccgaaagctcctgagttgttatctgccgataagattactgtgtggatcgacatacccatgagcatttcttaattaatccgtcaatattcaactatataaatcgaggttttacttttagctccttatttatttaccttgttggagtatgctggatcaaggaataccttgtggagtttaatccacttaattaatttgagttcttagcctaggcataatcacctttcttatgtggagaataaatcgattcactgaccttgatgtgaagccatttaatccaatgatctaatccttcgattttcttcttctttttttctttttcttctctgtttcttcttcttgcgagataccttatgaaccccttccagtgctgaatagattggatgattgaaatagggttttagggttagagatagttcggccgtgacatatgtgtttacacctaaaattgacacctaggattgaaataggaaaaattgccaaagtttggaatctaccggtgttttcctctagaaggccagcctgaccgtcgtgtataggccggtcagactgctgcggccagaactccgattagaccgccggcatgtggccggtctgaccaacagagtccgagtctgagtctgttttgttgggtctcgagttttccttgctcgggaaggtatgtttcaggtttcctttggtttctaccccgagttggacgtggaggagggcctatagagggcaagaccaacccctatataagggacaaggcctgttcaattgtaaggtatcctacaatcaatcaatcgaatcgcttttttcaatattgctttctagttctagtttagtttgtccacctttcgatttgcgccgtaaatcgtccgccgctgctgcgagagtgcgacacctctttgtaggtttgtccttaaaaccttctgtttgctcacaagatgggtagttatccatagtttcatctaaatcggctccgctagccagtttaatctatcaaaacccatcttgacttagcgcttactgggttagggtggttggcgactctagtatcaccgcaaggtgtttaggtgctgcaatcgtgcttgttgacttgtcacaaaaagttgccaacaatatgcctctctccttttccttataaaccgacactggtggggctcaggggctttatctctaattaaattcgaatccatttgtaccgatcaaacaaaacatattttatcacttagttgtctcttgttaggaaaagaaaaccggtgggattttatcccttccctaactaaccggcatcagctgataaaatcaacaacttacctacgaatcaacactaaatacaccctttgcaacgaaagggagagaacga

SEQ ID NO: 24500 - DNA, 1501 bp, Oryza sativa
acgccgttgaattttttaaatatgtttgaccgtccgtcttattcaaaaaattttgtgaaatatataaaactatatgtatacgtaaaagtatatttaacaatgaatcaaatgataggaacataattaataattacttaaattttttgaataaaatgaacggttaaacatgtttaaaaaaattaacggcgtcaaatatttagggacggagggagtatttggtagtaaatgctgtctgccaattttctaaaagggttactccattataaaattcaatatttgtaataaaattattatcttagaaaattggcagtaagcagacaatgttaggctcatggtgagatgaataattttggggagaaataaatggcaggtcgtataatgaaagattcaaaaggagaaattaaaagaggagaggaggagaatttatatgcaattgccattttttccattgatttaaagctaggagtgacagcctaaagctaggcaggttttgcgttgggctgaatgagacacaatatacaagggccagcaaggaggctcatattgcttgttatgatgtggccacactccatataacaggtggcaaaacttttgttgtttttgtttcgtttgcggtgctaggagtagcagctctttgtaattcagctacttcgggctaggatgatatacttttttagaactaataagacttgctccaaataaaattcagaagtgattctagctaggttttttttttgggtgtgtggctcacaataactatgcagttatcctacttgttgaagcatagctcaacaatttgaaaagatggctctgtttcattaactttcaaaaaagataaatgtcttttcttttgaacacaaagaaaatgaaaaagtttatatttgttctttactgcaaattactatgtatatatatttttctagtttcatattgtatttgcggagtattttaaactcacacttatgttttttatttggttttttttagttacaatgtatctacggcatgcatgcgtggacaagtagcaccctttgaccttcacatttatgacaaatttgaactaaacttattttcgtagcaataaaatggtacatatcatgtgtggtagtagattagttatttggtttattttgtagaagttttttatggtagcatatctatgcatgatgtgtggatagttatcattatttacttcttgttgtggatgtttggatgttcgtaaataaaataggttttctgtgaaaaaattcagacttcagattattttgtgtagtaagctagaatttcagatatgttgacacctggggcttatatataactatagtcttccttagtttgtatctcctagaaatgttgtactaattgcaaaattggttaggtgcctaattaacataagaggttacgcaaaccatttctattgtctaaaaaaagttaaatgaatacatattaattctgtttttttatgagttataacatacccatagccttacatgtctctact

SEQ ID NO: 24501 - DNA, 1501 bp, Oryza sativa
cgtccctggtcaattaaggaccgagccatgaagttaagcatgaaacgacccccgtacaaccgcatttctcgtatgggtatagacctagcggaatagatagctgagcggaggcagtatccatgcatagtggtttcttgatgtgtaaggtaggggctctacggtggggcagccattggtagaaccgcgaggcaggtgtctacagtggtgtcgccatcagtaggactaccatgtgagaatttaaacataattataacttaatgcatgtgtgagtctttccttcccgggtgtaccagaactcctctcactgctagaaaccgtgtacgcctagagtgtatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggtgattgagcaccgggacatgtgttacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcatattaaacactcgtgtatgtgcacttgatattccagctatgaattcgtgtgtaccaaactacttgatccagggaaatggtaccgtttacacgattgattcctgttataaaaacgggggtctacagagctggtatcagagccatacgactgtaggaaaagaccaaaaggcgccccaccctttttctaagttggccaagggagaaattcccatctagtaatactttcaaaaataaaaacgctatgtttacaaaactcggcacaattttcatcttactcttaactattttctttacaaaacaagttttactctcaactgactttgggtttttcttaaaattagatggcagattcggattcacccgctacctgggagt

SEQ ID NO: 24502 - DNA, 1501 bp, Oryza sativa
gtaatacatgtcccggtgctcaataaccgcgagcacggctattcgaatagatttggtttactcacactgcagtggatgtacactttacccgcactccgcgactgcccaacacataagcctcgtcccaacacatgagacacgtcacggcaaagcttttcgataacctcgcattggcagtacccgctccatgaactttagccctcatgcactctaggcgtcatacgtttctagcagtgagaggagttctggcgctcccgggaagggaaaaacacacacattcctacgttgtttcttgtcgttgaacccagtccatcatgattgttctcttatgggtatcctcttgtagtattgccaagccagcctctgaccatccggaatgggcatccgccatccaccaggccatccgaaccgggcatccgccagcagactgcttgccgtatcacacacctaaaagaagaccactacgcatggatactgcctccgctcagctatctactccgctaggtctatacccatacgagaagtgcggttgtacgggggtcgtttcatgcttaacttcatggctcggtccttaattgaccggggatggtactagccttttccagataccacccaaatcctccgtccgccccagtcgaaaaaaattgtttaattttatttctcctttcacaaatcatgtcatcaacatcatggcaatgtggcgctcatgtctccacatgccgcatctcaattaccttcccaaaggtaattgcccaagcgtatagcatttgataaatatgagtatgcatgattctagaatagcatttctaagcatttgtcataattgactagggactcatacgtaaacctggttacgaaggaataagggcaaacaataatcaaggcatggcataatcacaagtaggatgttcatcattgcatgcaattttatttataaacaaaataatttcgcaattgggattaacatgttcaaggaatagtgatgacttgccttgcttaggataatccttattattgatataatcttgatcaaccttcacctcctggaagttgcagacgttgcctcacgactagccgatacacatggtctataatacgcgagaaaaaccaatattcaaacaacaatcaaatatgcgcaacaaattgtactattcgtgtttgctaatggatcccaatcatgctaaggctaaagtttcttaatctttctattgtcatcgtggcctatttaggagttaacaaacatagcatttatgggatacatatatatttggctaatcggtggtttagtctatcaaatggctatggaaggattatggctatgtatgcatctatctaaataggacggttatatactagaggttctgttgttagatggatttaggatcaatcaaacaattacagcgaattatttgtattattattttattgatggaagctttactttaattatgaacatattttacttgccattataaattataagagggctaataattgtcca

SEQ ID NO: 24503 - DNA, 1501 bp, Oryza sativa
atggtggccccaggttcttggaaacctaggtcatcatcaccatcatcaatgtcaacagcgggggccttctgcttggcctcacttcgccgtttgccggatgggaccgccggggacttgccctcgcggcgttcctgcctcctgtcctcctcccacttcctcgttcgctcagccaaatttttgactgcgcgacagtccgcgagatggtggagggaggtgttgtggacggagcaccacctgccggcggggcgctccctgctgggtgtaccagccccgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcagattcattagccaaccccgcgcctgtccttttagggccatgggaaagaagttcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccaacaccaccggccgggggcacggagggctgatcttcacgtccatgtcggagtgacactctggacgaggaggctccctccgttgcacggggagtacgccggctattacaccgacgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacg

SEQ ID NO: 24504 - DNA, 1501 bp, Oryza sativa
ggggagcggtgtcgggcgggaggaggcagctggcgattggggggtgggggaggcggaggtggcgttgggcagggggaggcagggagagggagggggagaatgaatctagggttagggttgcaccagggttttgattgatttggaactgatttgagccgtccatcgaaacaaacggctaacatcgatcgagcgtcgggctggcctccgtcaccggaccgtggcacttggccgtacacgggccggcggtccaacacaaacgtggaagtgagacgaggagtatggggatgttagttagactttagtcgcttgcggcctaagaaaagtgggtcggctcggttgcgggctgaagaagaaaatgggctgaaaatggcccatagagaaagaatgatttttatttaaattaatgctgaaatgatgtttgtattattaaaattagcaattaagcacaacaaatttcaagaaaattttaaagtgtagttaatatggagaatttaataaaaattaaatccaaccatatcattttacctacctacttaaaaaaatatctaaatataaaaaaatgtatttcaattaattagaatttaatatgttttagggctagtatatcataaggcaaaatctaaaccgagaagcctctcggtttagtgttaaccaacgaccaatcaattgtgagaagaagtactgctatacatgcatgctttatttctcttagacatgcatgtctttttcttcattcttataaagttttttctcaaattacttattcgatctacaatccgattacaccattgtatttgttacaattaaatcttcacaacaagatcttacatgattatactacgatgaaaaaatatttatatttgtaaattacttttattatatacgtaagttacttttatcatatatataagttacttttagatttgactaaattatttcttagacatataaaagtaaattcaatacaatctaaaagtaatttacatattataaaagtaacttaaaacaaaacggaagtaattttgtcacgacattagaagtaaattcgttgttgggttaaaaacatgactagttgtgtagtcacgtccaatgaaaaaagtcaagcattaaagttacgtttcttttgttataagttacttctataatatatgtaaattacttttagactttattgaatttacttttatatgtctatgaggtaatttagtgaaatctaaaagtaatttagatatttgtaaaagtaatttatatttttttcatcaaaatatatttatgtgagatcttgttataaagatttaattgttacgaacacaatggtgtaatcgaatcgtagatcggataaatagtttaagagaaaattttatttaaagtataggtagatagagtctctcatatatgaagtgatcgctggtttatctagctgtgactagtcacgtccatatcataaattagagttgtaccaaaggtacgtacgtaaaagctctccaaacctctccaaacc

SEQ ID NO: 24505 - DNA, 1501 bp, Oryza sativa
gagtatgcacttaacccaactctatttagggtgtgtttagttcacgccaaaattagaagtttggttgaaattggaacgatgtgacggaaaagttggaagtttgtgtgtgtaggaaagttttgatgtgatggaaaagttgaaagtttgaagaaaaagtttggaactaagtaagggcttaaggcttttcttgaaacatactctaatagcgattttataatatttcatacaactatttccaaactacaaaaaaccatcaaaaatgtctccaatcatagaagaggccagtaaagaatcacatagtaaacctcaaccagatttttcacctaaggggaattacacacgcacgtgcagccacttcgctcctactccctctgtcccacaatataagagattttgaatttttgtttgtaacgtttgatcactcgtcttattcaatttttttttacaaatataaaaaacgaaaagttgtgcttaaagtactgtagataataaagtaagtcacaaataaaataaataataatttcaaaatgtgtttgaataagacgagtggttaaacgttgcttgcaataactcaaaatcccttatattatgggacggagggagtatatacttatggatgacctatgggtttttttttcacaatcttacctatccctccaaaataaatagaaattcagtccacctcattttaaaccctgctttcaaattttgtaggctaaaacattgatccttttccccgtaaaaaaaatatattgaccccttaaccataaggctatactacgggccaatttgatagagttccaactcctatttaactataggagttgggtctaagttgaattttggagcatcctaagctcagggcctgttgtgtacagctctagctccatcactcctggagctggagctcagccaaatagttttagctccacctaaaatgggagcagagctgggtggagctttctcacaaaatgaactagagtgccacaactccacttcagacccaactcttgaagctaaatttagaatttggagctctactaaacaggccttcagctccatctctctagttcatttttgtgagagcgcatcatccgactccactcttattttagatggagctgaaactatttggttagtccgagctggagcaaaacataagccacagaagatccctcctacctctccaaaccaaaccaaaaataattctcgcccgctagcaagtgggccccacatctaatcatacatgatccatccgttcccctactcctattaaagaggagggggtaaagccctggctttcctcccccaacaactcggccaaattcaaagcaaagccgccattactgctcctcttccattccactggggacgtacgagctccgcgcatcccttccattccattactgaccttggctgctgcggctgcagtgcagagggggtttggtggtgcggttgatttgagcaataaattctctaggggggagggaggtatcggtca

SEQ ID NO: 24506 - DNA, 1501 bp, Oryza sativa
tcaaaaccatcaaagttaatttgcactagtttttgaacttgagagagccgagagatacgattctacaatggacaagacacgagggaggcaaaatagacttatttccaatttttaccacaaaccgctagaccaccaactcccaacgagagaagtccactttatgccccttaagtatgggtccaattttattggtgtctctcaaccgtaaatccaaacacataacgtcacccagatatcaaaatcagtataaatctaatccctcaatggttttgttctacgtaacgtcaatctcacatgctggatttggtattcccctcccaacccatgtgatgtttacgtgacactaaaagaaaaaaacaaaaatagaaaaaaaaactcaataggacctacatgacagccagatataataataatactccctccatattttaatatatgacgccgttgactttttaacaagcgtttgacattttgtcttattcaaaaaatttatgtaattataatttattttattgtgacttgatttatcatcaaatattctttaagcatggcataagtatttttatatttgtataaaaattttaaataagacgagtggtcaaacgcttgttaaaaaatatggcgtcatacattataatacggagggagtaataaattagtaggtcctcacgtcagtcagcccctctccctctcttcacccgtgtcgctccttcccgtcgtgttctcgactacgttcttgttcgacgagtccagccacacgagtgacaagacattgctcctcgccatgcacatgctaccgatctcccccacggcacgtatgtaagatgacattcacgcatccatggaaaaatgagaacagcccatggtcttccggctagcttcataaggtgattggctagacgatttggctttaaaagctcacccccttctaattatacttaatattagatcattttctaatatttacgtatttttcatccatggtaaaataattcttgcacaaatttgtagatcgtcatgcaagttcttctcatctagatgtgtgtataatttgtctttgggaaacagaaatcgatgccacgaacaaagctgctctgccttggcctcaccgaacggctcacgcatgcagtggcaccaacagctgccgttcaaggacacgtattagggctttggagagaagatacagaaaaatcaaatgttttagagtttattgtgaccatagaggcatttccttttattatggatgatgtgactcaatgcatgctgagtaacagagacggatctatagtgtaagcaggtgtcagctgacacccatgatttcttactaatcactttgctaacacactctagaaacaaggattactgtattgacacaccaccatatttgagtagtgaccctagctactctattttctagatccacccctgccgagtagtcggttctaattatataggaataggcatatatatatatatatatatatatatatatatatatata

SEQ ID NO: 24507 - DNA, 1501 bp, Oryza sativa
aaatgtccttaattatcaaagaattatagaaaacaaaatgcattgaaaattttggtgtgtaggtcggttccgtccgtggactacactgaccaaaccaccaaaattccccatgcattttgtattttgtgatggtttgataacccttaactagctagcttaataaactatttctagctagcttaataaccctcaatccatcctttttcagctaaatgtaaacatgatccacaaaattcaataggtctagcaaaagggaacaaaacaacatatatagcagtacacactccatgaatggttatatgtccaaatggcacttaaatccacatccaagttgcaaactagctacacattcaagttttaacaaattaaggcgattgaagcgcccaccttggcaagcatgctaaacccagctccacctgatcagagttgcatgcatatattaaccaatttaacctaaacgattaagctgagaaggaaagatcaacggacagttcatttatactttgacacttgtccagtcgccctcacgcgacgcccctcaaatcatttcttcctatatagttgatacccactacaaacattaactcctataaaacagcctccaggttcattgtcacgtccagaaatttagcccaaatttccagactattttgtatattaaatccctgtccaggaccagccagggtacacaaaacgacaagtaatataaagttccaaacgtaaataaagcgtaaatacttacagaagaggcacttagtcctcacaccgaaacaaaagcagcagcagcggaaaaggcgatcctagcggggcttcagctccactccacaggcaaaactcaattgggatctgagccttggtcttctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaagcattttattgagcaaaactgtaaaactgttgagtaattaaagtaacattaaatctccactgatcaacgctacaccacattgaacaggcccaaccaatccacctaaactacagtgcattgggtcgatttattaaggtaggactaattacggtgaatctggtcgaccgcccctaaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcggctaga

SEQ ID NO: 24508 - DNA, 1501 bp, Oryza sativa
ttctaggtcactctatgctcaggctgttcctatggttaagtttactagttaaactgtttgtgagaataagacttatagtttatattcccattgtgttgtgacctctgtggtttgaataatgtataattgaagtttgtgcttttatatcgtttcatgcgtaaatggacttccttggaagttacgtatacgtggggcactttgaccttcttggggtgtccccacaagtattcacatgttgtttttttaaagtacttgtcattctcatattgtaaagcacttttgcttaaaatctccctcttctatccctcatcaatatattcacccctctcattataatccacgtatttagcaaggagttaacaataataaataaaggttagctcggtgatttgccacaacttcatatttcgtctgagctagaatatcttgtcaatcagaaaattcatcgactcaaggaaatcatacggagactaaaaaaatttgtcgattttcaactagaaaattgtcctgccatgaatcaaacagagaaaccagcaaacaagaatcatcggtgcgtgtatcttgatcaaccagagactaccgttcatctcgaggctctcgcataataagggctgacaaccataactctcctagtatctagtatctatccctgttggaagtgcacatgctatgttcatcccagtttactcgagactgatgaattctcaacacctcccattcttaaattcctatggataagtaggtgccatcattggcaattggcaggatatcacagaaattgcagcgaatttgacaaaagcaattggctagcacgaacaagaacataacaaaaagggagcaagaacaaagtctgcaaaagaaaaatggggcaattccttacatacccctaaaagtttgctccatcccttgcatgcccttgaattttgtcacatcccttgtatacctctgagatttcgtcttgatcccgtttatacccataccgttagttcaccgttatcttttttccaaaatggccatgttgccctttttatagtcatgtgatcacttcaaaaggcgctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatggtcaactgatggtcaactaacggtatgggcttggaggagatcaaaatgaaaact

SEQ ID NO: 24509 - DNA, 1501 bp, Oryza sativa
tgacccaagaaacattttattttagccaaagtaagaaagttgaggcgtcaatacattggtactttagagtgacttcagtgcttcaaagacgacctattcacagggagcaaacatttagaaaggacacaactacaccgagagtgctagctggatagtgctgaagagagacaccattctttccaaaaaaaaaaaagctactagtacactcaatatctatatatttttttcttcttagagaagtttctcttaaattactcatccgatttataatccgattacaccgttgtgttcgtaacaattaaatatttacaacaagaactcacatgattatattttgatgaaaaagcacaaattactttcatgatatgtctaaattacttctagatttcactaagttacttattaaacatataaaagtaaattcagtaaagcttaaaagtaatttacatatattataaaagtaacttataacaaaaagaaagtgactttaatttagaactatatctagattcattaacattaatataggcaatactaaaatgacttgcattatgaaacggggggagtaactctctatagtagaaataattatattgtgagtgagctgaaataagaaactatgtagagtgaattcgcaagtaaagtgtagagaagatttataaagtccacaaattatagaattaactaaaaacaataataaaaataatcaacttagagcattatgaatgtatagaagtaatttagtcaaatctgaaagtaacttatatatattataaaagtaacttagtatataataaaagtaatttacaaatataaatatttttttatcgtaatataatcatgtaagatcttgttgtgaagatttaattgtaacgaacataatagtgtaattgaattgtaaatcggataagtaatttgagagaaaactttataagaagaaagaaaaagacacacatgtctaagaggaaaaacagcacgcacatcagcatgtgtagcagtaattcttctcacaattgaatcgtcgctggttaaaactaaaccgagaggcttctcggtttagattttaccatttagaaagcttactagcacaccacaatcaaggttcacaaaaccgttttagatggagtttccaccacccccaccataaagcgtaataaaccatgtgggtaaccacacgactaccgtgaaaaccataaggttaccacaatttaaggttaccacatgtttaaggttaccacaaaattaaacatggattcaaaaactaaggttaccacatgtgatgatcgcgtggttttgtaaacgctggtgactcacaggatttccaaacgtaaccaatacggctcccaccgttcagtcaagagcctgcacctcaacaaaatgtcaccattcatgagcacgattacatgactacccaaatacccaacaaaacttaagccttcaatccagagaacaaataaaataggcacttgcaatctggtactaaacacatgaaaaacaatcg

SEQ ID NO: 24510 - DNA, 1501 bp, Oryza sativa
atattaaaaagattaaatctaaatggatagccacataaaaaactagagtaagatgaatattccctatagcaaaaaagatgagtaacacattaatacgttttcttttatccgtagcaaagcacgggcatttagctagtatgcacaaatggtcggtagtccttttgttttgtgcaagaattgtttagtctgagaaatcaaaacgatatattctcatggaagatctttatagaaaggcagggggcaccattttacatacatagtgggaacaaaaatcctgacctctgcatcatgagatgcagtcatgcagctacagtaatttatattcaaccttgttaagcaagtatgataatttcataaaccttaatttcgtgatttgtacaacttcatatggatgtagggatgaagcaatccacaataattctgatctctagagctagtttgctataccagtcaatgacctttctaatgtggacaacataaaatccgaagaattcacatacacaaactcttcaaaacaattagaattaatgaggtgtgtattgttatttttatcaaatagatactccctccggttctataataattgacgttttgggcaagtttgaggtcaaacttttataactttgaccattaataacttcaaaatatttagtttaaagaaactagaacaacatatatagatttgcctttcaaaacactataataaaagtaaacatgtatttattcattgtgtatattataatagaaaaataaggtcaaaggtatattttgtagactatgtcattgtccaaaacgtcaattaaaatgaaactggagggagtaatttggtgtctcctacattataccatactgtgtgagtgaggcttcaaaatagtaaatactaaaatatcatatgccattatattccaaattacatatcttactgattatctgaatttagttaccaagatatatagtaaaaaaacgtcctatctttggagatataaagtagagtaagggtaatgtcaccaaatctggtaacattactgtaggattgcacaacaagaactaagccaactagaaaggaggtgaatgcaccctaaaaccaaaactttcagtggaattaaaagttaccatcgaatcgacggagattggtctgactttagtagatggccaatcaatttcatggcagacatggcgttgctcggttaatccgatctgctatccaattggcaacaaatttttttttttgcaaagcttatgaagcagtgagaaaacacaattgtttgtgattggcaatggtgcaaaagccttcaagcagcataagaaactgtgatggtgatcatagttgttgtaattatttgttattttttctttttacacagctttaattggatttgctaaagttgattttgttttttctcctaattatttccaggcaggattgtccatagcaattcttcgtgttatgtaccgtgcaacgctggggtattattagaaattattggtccataaccagtac

SEQ ID NO: 24511 - DNA, 277 bp, Oryza sativa
tttataaaacctttttaactttgtttatttcttctcagttattatttgtgctctgaaaattccactaaaatttatttacgcattttaggcttttaggaaatatacaaaaatcctccaagccttatttgacttttaaatttgcacattttaattgttggaagctttcacatggattttaattattctatgcacaatttcgaggatgtattttagagtcgttttgggacgcgacaggttctcccatccgagctcaccctgaggtcccctcgggccacca

SEQ ID NO: 24512 - DNA, 1501 bp, Oryza sativa
gaggtggtggaggagaagttgatttgattaaaaccgtctcccctctgtgggatttcggatttggactcttcgcgtccagccgtctcgtgcaggaggagtttggactttggagggtggagccgtggagaccggtttggagaggtttggagagcttttacgtacgtacctttggtacaactctaatttatgatatggacgtgactagtcacagctagataaaccagcgatcacttcatatatgagagactctatctacctatactttaaataaaattttctcttaaactatttatccgatctacgattcgattacaccattgtgttcgtaacaattaaatctttataacaagatctcacataaatatattttgatgaaaaaaatataaattacttttacaaatatctaaattacttttagatttcactaaattacctcatagacatataaaagtaaattcaataaagtctaaaagtaatttacatatattatagaagtaacttataacaaaagaaacgtaactttaatgcttgacttttttcattggacgtgactacacaactagtcatgtttttaacccaacaacgaatttacttctaatgtcgtgacaaaattacttccgttttgttttaagttacttttataatatgtaaattacttttagattgtattgaatttacttttatatgtctaagaaataatttagtcaaatctaaaagtaacttatatatatgataaaagtaacttacgtatataataaaagtaatttacaaatataaatattttttcatcgtagtataatcatgtaagatcttgttgtgaagatttaattgtaacaaatacaatggtgtaatcggattgtagatcgaataagtaatttgagaaaaaactttataagaatgaagaaaaagacatgcatgtctaagagaaataaagcatgcatgtatagcagtacttcttctcacaattgattggtcgttggttaacactaaaccgagaggcttctcggtttagattttgccttatgatatactagccctaaaacatattaaattctaattaattgaaatacatttttttatatttagatatttttttaagtaggtaggtaaaatgatatggttggatttaatttttattaaattctccatattaactacactttaaaattttcttgaaatttgttgtgcttaattgctaattttaataatacaaacatcatttcagcattaatttaaataaaaatcattctttctctatgggccattttcagcccattttcttcttcagcccgcaaccgagccgacccacttttcttaggccgcaagcgactaaagtctaactaacatccccatactcctcgtctcacttccacgtttgtgttggaccgccggcccgtgtacggccaagtgccacggtccggtgacggaggccagcccgacgctcgatcgatgttagccgtttgtttcgatggacggctcaaatcagttccaaatcaatcaa

SEQ ID NO: 24513 - DNA, 729 bp, Oryza sativa
tattcgactctccaatttgagcctttccaccttgcaaaattctatctaaaattaagctccaccatgtttgtttacttttgatggagtggtttcttgggttttattagagtttttccttgttttgcgtgccagcatgtagttcccgtcgtttcgaaagtccgcggtcgccaggaaaaaagttcggaagatcaaagtgaagaatcaaggcaagtcacacaatcccattgagcatattgagcctattttataaatgttttaccgtttgcaaataagtatgcatgttttgctaattacatgggatccgggtattatctatctgctcgcttgtgccatgtttacttgatatttgtcctttgtcaaccgggggtaataaatcgactagctcatgttacttatgtaacctagctagaactatatgcttagccatgcttaattaccactagctcagttgatgggataattacagtattagacctttttagtatcagaatgagctgcgtgctcgagacacctggcaatgcttcatggtcgtaattatccaactaaaatgtgactgaatagtgggctgtgggtgcatggttttgctagtcgcacccatggcaattaaggaccggttcgcgggaaaccctagaagaatttatcgtgcttaccacaagccagcgtgggcaacggctgggcttgtagtgtagctttcctctagccgacgcatccaggcaagggtgggcgtga

SEQ ID NO: 24514 - DNA, 1501 bp, Oryza sativa
cgaaaataagtttagttcaaatttgtcataaatgtgaaggtcaaagggtgctacttgtccacgcatgcatgccgtagatacattgtaactaaaaaaaaccaaataaaaaacataagtgtgagtttaaaatactccgcaaatacaatatgaaactagaaaaatatatatacatagtaatttgcagtaaagaacaaatataaactttttcattttctttgtgttcaaaagaaaagacatttatcttttttgaaagttaatgaaacagagccatcttttcaaattgttgagctatgcttcaacaagtaggataactgcatagttattgtgagccacacacccaaaaaaaaaacctagctagaatcacttctgaattttatttggagcaagtcttattagttctaaaaaagtatatcatcctagcccgaagtagctgaattacaaagagctgctactcctagcaccgcaaacgaaacaaaaacaacaaaagttttgccacctgttatatggagtgtggccacatcataacaagcaatatgagcctccttgctggcccttgtatattgtgtctcattcagcccaacgcaaaacctgcctagctttaggctgtcactcctagctttaaatcaatggaaaaaatggcaattgcatataaattctcctcctctcctcttttaatttctccttttgaatctttcattatacgacctgccatttatttctccccaaaattattcatctcaccatgagcctaacattgtctgcttactgccaattttctaagataataattttattacaaatattgaattttataatggagtaacccttttagaaaattggcagacagcatttactaccaaatactccctccgtccctaaatatttgacgccgttaatttttttaaacatgtttaaccgttcattttattcaaaaaatttaagtaattattaattatgttcctatcatttgattcattgttaaatatacttttacgtatacatatagttttatatatttcacaaaattttttgaataagacggacggtcaaacatatttaaaaaattcaacggcgtcaaaaatttagggacaaagggagtatcaatcaggctcctttgtctcgcagagttatagcaccacattgggcttgaattttcaggagccccggaagtaatatgcactctagcatccttgattttttgctacatacatgggtgaggacaacctcaacaggttccaaaatcaatttcagtaagtcgtgcatgattcctctcaatgtacagccagagagaaagttgagcatctgtctaaaatgtttggatgcatggtaggagacttgccttttacatatctaggcataccaatgggtatctctacacccaaggtaatagatttcagtcctctggtggatagagttgaaagaaggttgtctgctacttctgctctcctttcttatggggatagactgactctggtcaattcagtgctttcttttttgccca

SEQ ID NO: 24515 - DNA, 1501 bp, Oryza sativa
agccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcagattccggcatgaagcggcgcggcagcccggcctgcctctcgctcacgatgcgggaaggcggcagcacgctaccatcgagcagagcggagccccgtgccatgacgccggaagaagagatgtttgagagcgagcgcgtgtggcgagggtagggcacaggaaacaaggagttagggcgcaagcggtgaagacaaggagaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtggatatgcggctgtggcagtcgagatggaacatatcgtgcgcgcgttgattacgctcgccgaccgaagcgccatcaccatatctcaaggtaaaacgaaccggctcgtcccgattcgtgtgctactcgagtaatgtggcagtcttgaagagaccgctcattattggcagccgagttaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggggggggtcgggcccgagggtgatgtggccgcctccctctttgtctccccgaggggtcggaccgctcccgtttcggccccgaggactgaggcgccccgaccccttgtggattttgcgccgcgtgtatgggttaggtgagcgcagagcggggctcacctaaccgcatttattgcggtttggacgagcgcgtcacgctgcatgtaacgcagtgcagcgtgctcgtttatccggtctgtgactggtcacagaccgatcagatcgtgggttacgtggcgacaggcggtctgacgcacgcctcgccccatcccgtcaggatgagagcctccaagcactcgtccctagccggagccggcgtgttacctcctggagatggcacgttggtcccggtcagatatatgccaggcttcatcctaaccattacaagcaagatattg

SEQ ID NO: 24516 - DNA, 1501 bp, Oryza sativa
cggaagcggagattgagtttgaaaacagagcaggaatcgattggagtccagatcggctatgatgagatcggctgagtctgagtcgggctaggtaagccagtgtagccgattccgacaatatgacttgtatacgacattgggttcaggatgatgtgcttcaagatgattgccacgcacggatagagtcctgggaagacaattgtatctattaattaggacattttatgtaaattccttatagataagtgtgggcaaaagtctgccgtaaagacttgtgatatcttagagtttgttagagataacagtcgtgtccggtatgggcatatcttgtaattctcgggtataaatagaccccgagacctatgtaatttagaacacacacgttcaatacaatttcggcgcatcgccatcttttgctttagttttattttgacgagttcttactttcgggttgagctgcatcggtttcgatcttcaacaagaggtaaaacttgttgtgatgacttgcgttctcgggattagtgcttccatctttacgatactctaatcttgtttatgtgatttgtcgagttatcatatatcttacataatctctggcaatatcgtcatctaacctataatcggccaacatctattaaggaaggcagccgattaggttagacgccaatgttgatttagattatataaggtgtctaacaccttatgaaacatccagcggtttgattgtctagatattgttctttttttcatacttaatgctgcatcagttgagtttgatctattaagtcgtgcttaaaagtataatctctagcctgctttttggttgctgattagggtagtatcggagtttcagccgatcttatctgatttaactatatttgttttatatgcttaattgacatgttaagtctgccctttatatcaagatcttgttgcatctaaatacgttaagcttctacttgagtattatacttgctttaatatcttaatataaagtggtatcggagtattagctgatacatgctagatctatttgatcggctacgctatacatatatataatcttgttgttaatgtatatttcgatctaagtaatttatactgtctcggcgtggtgaccgatctatcccaatcacttgatttaagtatacatcgatataaagattatatattgttaatatctacagccgatcgagtagatttggtttcttgctacttattgatgatcgccgatcgattcacatatgacatcggctcagagataaatgatatgtcatcggcatctagccgatcggctatcatttatagatttaaccacggtttctttgtcttcgtttcttgtttattgcaggatcaaatcaactggcacgctcatacatccgaaggcgagctttggacctgcactggagttaagcagatctcccaggcctcgtgtttttgtcaacacgcttttggcatgcccagtgggacgcttaagaagtcagatgacagttcttcctca

SEQ ID NO: 24517 - DNA, 1501 bp, Oryza sativa
tcagctgacacctgcttacactatagatccgtctctgttactcagcatgcattgagtcacatcatccataataaaaggaaatgcctctatggtcacaataaactctaaaacatttgatttttctgtatcttctctccaaagccctaatacgtgtccttgaacggcagctgttggtgccactgcatgcgtgagccgttcggtgaggccaaggcagagcagctttgttcgtggcatcgatttctgtttcccaaagacaaattatacacacatctagatgagaagaacttgcatgacgatctacaaatttgtgcaagaattattttaccatggatgaaaaatacgtaaatattagaaaatgatctaatattaagtataattagaagggggtgagcttttaaagccaaatcgtctagccaatcaccttatgaagctagccggaagaccatgggctgttctcatttttccatggatgcgtgaatgtcatcttacatacgtgccgtgggggagatcggtagcatgtgcatggcgaggagcaatgtcttgtcactcgtgtggctggactcgtcgaacaagaacgtagtcgagaacacgacgggaaggagcgacacgggtgaagagagggagaggggctgactgacgtgaggacctactaatttattactccctccgtattataatgtatgacgccatattttttaacaagcgtttgaccactcgtcttatttaaaatttttatacaaatataaaaatacttatgccatgcttaaagaatatttgatgataaatcaagtcacaataaaataaattataattacataaattttttgaataagacaaaatgtcaaacgcttgttaaaaagtcaacggcgtcatatattaaaatatggagggagtattattattatatctggctgtcatgtaggtcctattgagtttttttttctatttttgtttttttcttttagtgtcacgtaaacatcacatgggttgggaggggaataccaaatccagcatgtgagattgacgttacgtagaacaaaaccattgagggattagatttatactgattttgatatctgggtgacgttatgtgtttggatttacggttgagagacaccaataaaattggacccatacttaaggggcataaagtggacttctctcgttgggagttggtggtctagcggtttgtggtaaaaattggaaataagtctattttgcctccctcgtgtcttgtccattgtagaatcgtatctctcggctctctcaagttcaaaaactagtgcaaattaactttgatggttttgatagcagtattgctgatgttgcaggttgacttagccctgatacgctgacgtggcaacccaatctttaaaggatttgaaaatagaagtgggtcccacatgtaagtgacaaggagtaaaaaataaaaaacggtgggggtccatacttctcctttttgaacagcgacgcgcgtagtagtgttgagtatagatggcca

SEQ ID NO: 24518 - DNA, 1501 bp, Oryza sativa
ggttaggtggcgactggcggtctgacgcacgccatgccccatcccgtcaagacgaaagcctctagtcactcgtctcaagccggcgttaagcgtgttatcccttagagatgacacgttagacccggtcgatatatgccaggcttcatcttaaccattacaggcaagatgttgtgtgaagaagggcaaacatgcacgttgccaagtttacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagatgatgagcttagaacgggggagaagtcagctcacacttgtagctcattcatacgcagatccaccaaaacacaggagtagggtattacgcttctcagcggcccgaacctgtatagatcgtcggtgtctcgtgttttctggcgggcatacgatatttccacatacagagagagcgagagcttgagatttcaccctaagcccccggccgaactggcaaaggggggcctgcgcggtctcccggtgaggagccacgagctccgtcaaccccaatataggcctcacaaagatgagaaaagatactgaggaaggcgatagagctggggttcaaatggagcagagaaagaccgtagaaattcaagaccaaaagaagaaactcagagggaggaggaaggaaaccacagagaatatagtcctcaactgcaaccatgcggcccaggacaggtttaggttcaatacctcctggttccctctccatggtcctgcgaccggggagagcgccttcctcctgcaacttcttcagcgacgcgctggtagaagtggacttgtcgagctccatccccgtcgaagatcaccggagaaggggctgagaggaacaagctagggtttgtgcagaagcggagaagacgaagagctcctgaaggcttgaaagtttctcgcaacagccggactccaaaatggattcccaaaactcccttaaataggcgcactaccgacggtgcgaattccaaggaaaggagagagatggccaccggaaatttctgggtccgttgcgtcaggcggtttcttggactttaatttaaatttactcataaccgttggacttcgcatggtgttgtcgaacactctttgtctctacggtcctcacaccgagatcgaccagttgagaacgacaacaattccgacatcagaagtcgcgattggttacatgagttcatttaagtagaagtcgggggctattgtcagggttacggataaggtataccctctacccttggacgtatgctatacggcaata

SEQ ID NO: 24519 - DNA, 1501 bp, Oryza sativa
ggtgggcaagcagtggaaaggggatagattgctggtggctcccatggtgctcgtgttcgtgttgggagcagtcaagtacggcgagagaatatgggcgctcaggtcagccgccgcacgggcacccggaagtagttccattgctagccttgctgctcgcacctacagcaatattgctagtttcattactagccttgctgatgtgctgccggaatcagggcgtggtgtgatggcccattatagaagcatggttagtattagttcacaagacaaggtaagtatcgagagcatcctgaaggaggcctccatggagttccaagcaagcttggactttttcatggacgtgagcccttcaaatgtaagcggttcctactcgaggtaccataggatcaagaatgcgttggtggagatcaagtcttcaaagaatggatacgggatggcatacaagctggctgagatgcaggtctctttgatctatgactacctgtacaccaaattcggcacagttcgattccaaaccttcccaatatcaaaatcaaaatcaaatccaaccatggcggcggcgctccaatggcttgtctctcttggcctaacctctgtggctcttgtgttgttcgctagggccatggccggtaacactactagtagtaagttcaaatatagtagacctgatgttctcatatcttacatactgctcgtgggcgccattgcaatggagatatcctccatcttcattgcactcaccacatcatgctgggcaggcatcgctgtggtcaagcatcttcatctccatgtaggggagtggtcagggaagctggcacaatacaacatggttgatgcatgcgtccaggagagggagagacgacgacagacagcagctagtggcgccgtagggaagctaatccgctggatcctggcaccatgcgacagcgagacaccacaaccacacgtcgttgtctctcttgaggtaaagaagctgcttctgaacaaagtgcttgaaatagcgaccgatgtagacaacaaccgctgggacttcagtaggttccaaggccagtgggctctgtgggtggccaacagagtcaacggcggagacagtgatcctgctgctctaggcccagctcacagggcactttcggctagcaagatccaagagctggatttcgtgtccaccgttgttgcttggcacttggttacgaccatatgcttgctgcccggcgatggccctggcgagctcacaaaccctagcaaggacttgtccagttacatcatgtaccttgtggctaagcatgggatgatggttgatagcaatggacacatcgtgattgctagaagccgaatggaggtgcaggcatcttcgcaaatgcttgattttctcgatgagcttcacgaagatggcttcatccaggaactccgtgatggtgataggcaatataactctccggatatgatcgtacgtcatcggagtagacctgcacttaccacagctcgcaaggtctgtgtggag

SEQ ID NO: 24520 - DNA, 271 bp, Oryza sativa
cctgcagccctcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcaga

SEQ ID NO: 24521 - DNA, 1501 bp, Oryza sativa
gcggctgctggacctggcagcccaggtgacgatgtccgtgtacgtggtgggcaagcagtggaaaggggatagattgctggtggctcccatggtgctcgtgttcgtgttgggagcagtcaagtacggcgagagaatatgggcgctcaggtcagccgccgcacgggcacccggaagtagttccattgctagccttgctgctcgcacctacagcaatattgctagtttcattactagccttgctgatgtgctgccggaatcagggcgtggtgtgatggcccattatagaagcatggttagtattagttcacaagacaaggtaagtatcgagagcatcctgaaggaggcctccatggagttccaagcaagcttggactttttcatggacgtgagcccttcaaatgtaagcggttcctactcgaggtaccataggatcaagaatgcgttggtggagatcaagtcttcaaagaatggatacgggatggcatacaagctggctgagatgcaggtctctttgatctatgactacctgtacaccaaattcggcacagttcgattccaaaccttcccaatatcaaaatcaaaatcaaatccaaccatggcggcggcgctccaatggcttgtctctcttggcctaacctctgtggctcttgtgttgttcgctagggccatggccggtaacactactagtagtaagttcaaatatagtagacctgatgttctcatatcttacatactgctcgtgggcgccattgcaatggagatatcctccatcttcattgcactcaccacatcatgctgggcaggcatcgctgtggtcaagcatcttcatctccatgtaggggagtggtcagggaagctggcacaatacaacatggttgatgcatgcgtccaggagagggagagacgacgacagacagcagctagtggcgccgtagggaagctaatccgctggatcctggcaccatgcgacagcgagacaccacaaccacacgtcgttgtctctcttgaggtaaagaagctgcttctgaacaaagtgcttgaaatagcgaccgatgtagacaacaaccgctgggacttcagtaggttccaaggccagtgggctctgtgggtggccaacagagtcaacggcggagacagtgatcctgctgctctaggcccagctcacagggcactttcggctagcaagatccaagagctggatttcgtgtccaccgttgttgcttggcacttggttacgaccatatgcttgctgcccggcgatggccctggcgagctcacaaaccctagcaaggacttgtccagttacatcatgtaccttgtggctaagcatgggatgatggttgatagcaatggacacatcgtgattgctagaagccgaatggaggtgcaggcatcttcgcaaatgcttgattttctcgatgagcttcacgaagatggcttcatccaggaactccgtgatggtgataggcaatataactctccggatatgatcgtacgtcat

SEQ ID NO: 24522 - DNA, 1501 bp, Oryza sativa
gttaaagtgtgactgtcacgggctgggcacatcctttcatatcgtgctgacgaaaggaggtccgtctaatgtcacaaactttcccatataaaatttggactagcggtccatttcctaggtagctactcctccatacatatccattatccatcggtagcaagacaagtagtagcgaatcaaaaagatcataataaaaaaaatgtagtagtgaatcaaattggaacaatgcacacacaacatgccgcttttgaacacaatatcttttaccttttccaatggcattatccgattaagaactgaaatatactctctccgtccataaatatttgacaccgttaacttttttaaacatgtctgaccgtttgtcttatttaaaaaatttaagtaattattatttttttcctatcatttgattcattgttaaatatacttttatgtatatatatagttttacatattttacaaaagtttttgaataaaacgaatggtcaaatatgttttaaaaaaagttaatggcatcaaatattatttagagacggagggagtatataccctgccccctgctgccctactttgtcgtctatctttccccttttcttaaaggaattctatctgcaatttggtatgacaatttaattcagcatggatcatggatgcatcttctcaaaacaattactccctccgtctcacagtataagggattttcagtttttacttgcaacgtttgatcactcgtcttattcaaattttttttgcaaatataaaaaacgaaaagttgtgcttaaagtactgtagataataaagtaagtcacgaataaaataattaataatttcaaaaaaaaattaataagacgagtggtcaaacgttgtaagcaaaagcttaaaatccctaatattatgagacggagggagtaattagtagtatgtagaacgagataggcatgagagagacgattattatggctcaattcacggttgttgtgttcctccatgtttggccaccttttatagtcatgaaaaaattaaatctataatcattataactagttttgcaaatcaagttaaggttagaaaaaaatacgttatatccagttcataggttaaagttgttgtttatcaaatattaaaatgttaaaggcaattacatcaaacaagtaactataatccatctcaatatactccctcagttccatattgttaggcattttaatttaattttatcttaaataaaaattttctacttttaccatgtaaaaagataattaacatctatagtaatataccaaataaatacactatcaagacatatttcagggtggattttaatgaaactaacttgattttatatgtttatatatttttctataaacttatcgaagttagaaaattttaaccagtaagaaaaccaaaacaccttacttatgttataggctatagggtgagtacagattattaactaagagcatcaccaacagctcccaacacaaaaattatatgattt

SEQ ID NO: 24523 - DNA, 1501 bp, Oryza sativa
catcttcttctttatataaaacttcggcaactgcctcaccgttggaaaaaaattatcaatttcaaattccttggtagattgtacttgatacatgctcttagtttccttgggctaatgaggcaatctgatgactcattgtacatagtaagctaaggtgattacaaatatactggtcattatctgaaaagcgttgttattatccaaaaaaaaaaatcgtatcatggtcagcgttaatattagtcaacctgtatgtctgtgaacttggcaatattaacgctgcctaatatatctatcaaacagttctaccctttttgtataataatataagacagttctaccatgatatgatatgatacaacgttaatataagacaatttattatgcttgctgtgatatttgccatctgaacttttgttgaacacatcaaatgcctaggaatgtattgagtatatcaaaataggtacatatacgtcatgtgtcgatctgatttttactcaatgacaactattttgacatcatgtttcttattaatcagtaattttaggcatccggtaccaatttcattaatttacttggcaaattatgtagtagcttacagtaactgctcatcattttatcttcatcagcattgtaaaaatttctatgtaaaatccatctaatggagcaacatttttgattaactgcaaaatgttaagaccaatcatcagaacatatgcagtataatatccccatttaaatagatttttgtgtcagttttgacaatttacctttgaatcaaactgtagagttctcatgctgaataatcgcacatgacctgaaaacgtgagagaaattagcatccgctagctggttatggagaggagcaataggagtgcacgtcgtcgttgccgtggccgtcggttcaaatgctgcaattaccagatttagtcctcccagacctcaaatgacgccgacgaggatgatgttggggaggtgcgcaggaaggatggcgtgtattctgttagatttaattgggtaattaatctatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttgattgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccga

SEQ ID NO: 24524 - DNA, 1501 bp, Oryza sativa
gtccggttctgcagtaaaccgcccggttcaaccggtttctcgccggtttgattgcagaccgatcttttagctggaccggaccggccggcgccctggttctagttttttctggtcggaccgctggtccagtccagttctaataactatgatcgcaagtcagaatgcatattagaacattaaaaagatctcgtcctgatctgatgataagttcataactgattctggtaagagtttccatattagaacatcaaagatttttggtgcttgtgcgttcactgttcagacgacggggaagggcgatacggagatgaggggtgtagaggaagtggggcaggcggccggacaaggtgaggaaggcggtgacggaggagtttccctgccgtggaacccgccgaagctccatcgccggtagtgccgccttgcctaagctttgtctagatttggtgtgagagatgactgttagcttcaagcgacagcgacatgaagaggagcaaagtagggagggggaagatgaaggtgagggcttgatggagacttgggagagctctccctcacagccgctcggcctcgtcagcttcctctaccatttccgccattcaacttcctcaagggagacgacgactaataggcttgcaccggtgggtcgggttccctgctatcccttctccttcccttttcgccgccgccaccacctcttgcgacctccactagaacaaaagcttcgtcgcccgtgccatcgaggtgttctccctatgctcctcgctcctcactgtgacactaagatggggaaggaagaagataagggagggtaaaaggaagaagataaatctgataggtgggtcccacgtgcaaaggaggagatggatggaaaatgtaacgagagtgatacggttataattttgtaaaatttcagtagcaaggctacgaataattaaacaaatagaaaatttgtatttgcatggatcgaattaacccttaaaaaaattgggaggtagtagtacataacaaatcaccacatgacgtaacaaatcaccacatgacaaaaacctgtcctagactcccaagtacggagtagtaccttagtacaccaccatttcataagccttgttagcactattagtctttacctgtgtgacaggtagggtagccactactaccaaatttatcacattttactcccaaactttcctcatcacattttttttccaaccatgcatttccccatgaaatatctcacttctccacgaatcttgtcaattttttaacacttttgtgcagaaatgaaagaatcttgagtagaccgttcaattttcaatcagaccgactgagttttgatcaattttgtcagtctgtcgaatggccttttagtctaaattcgtttttgtcatgaaattttggaacgtttatattcaaatatctgttttctcaatatttgcccaaaaattgacaaaagttggtgaaaagagccgcttcaggcagggttctccagttcgttactagt

SEQ ID NO: 24525 - DNA, 1501 bp, Oryza sativa
ttggtaccgtctgcgagatgcttgttgggaaattcgatacctatatgagattttcaaccaaccccttttagattctctgtagtagtgataccattgatgttgcagtgagattgtggtgcgtagataagtgcaagtgggtgcaggtggatggagagaacgtacgtgatcggctacgatttgcagagcatactagattaggcactcacaaagttcccggatcgacagagtcgagaaaccgtgatacgctacttgtaagatgtttttataaggtggggaaatgaaaatgacctgtgtgtctaagacgggggatggcagtcccgggttaaggaacgctgaattcgacccagtttcctgactatgggcacagtatgtcaatcaaattaaaagacagccgagctaaggttgtgttcatctgctgccgatgaaggcacactggtgaatgaacataagctaagctaccatcgtctgatcgatttagtaaactgataccgacacctacatgaaattggtttggatgcatgattatatgtgcgtgcaggggggaggtgaaagagcacttttttcttattattgacccgggttttggagaaagccaaggagcatgaacgaagtctttacacaaacaaaacattcctaagagtataagcagagcatcagaactactaagacaaattaaattatcattccagctgataataagtcggcacagcatcatcagagaaacttacacaaactttccaggtaaacaaaaacattcaaatggtccaaaagacaacagcatcacagaccttcagggtgcacatcttcacgctgtcacgcaaaacggacctgacagctgtatgataactacataactgaacaggccgtgtatcctgtcttgttaaggctaacaagacggaaaaatatgtagtgtaaactctatatatatatgtaggacaaacgtaaaaactatcgttggatattcaaatagacgtttgagatttgttcacatttttgaagtaaaaagattacgcatagataagtctaggagtaacaaatttggagtaaaaaaaaatagtcagggtgacgtggacaaatctcagacatctattatgtacccaacagtagtttctaaatttgtactagacatttttcctgataaggcccgccactaaccacccaatcgacaaagactaaggttgccttcaagttgtttgacagaaaattatttttcagtgagtgtatggctgatggctgagagagagacagctctcatatctagcttgtcgtgcacgctgtgatcggttgaatatatagtctgtgatgacattattttccagcaagtctgtggtactagcattcctaattatcaaaagtgttacagtttcttgcactttctgagagcaacagtcaaggtcttcgtcctagacgttgaaagcaccgagttgctaaataaaaccacaacttgttcgtccagtgaagttacttcactccttgtcaatgcatcacacacacccagaca

SEQ ID NO: 24526 - DNA, 613 bp, Oryza sativa
actattctataagttatatagatgcatgtccccagtcatttttttatcctgtgtccgcccctgcttctacttgcattcttattcctccatcctatcacgatctggctccaactagcattcaggtgattgcttacgacatatttagtcatttccatccttccaaattgcagtgaaaacagagaataaggaatcaccaatgcttgaaccattcatatgcttaacacataattcaagtccgtcaaaaccgtacgaagttttctaataacacctcacaaataccgctgatactttatcccatctttacctgtttagtatcaactttctaaatacaaacttcgcatgttcatcataaaccatgaaacctatcacagtggtcatgaaattaataaaaaaattcctaacacataaaaatttcttatcatatgatatttcttcacaaatatgaaatagttgagctagttgcactgcatgccacaccaaaaagccaggcgtggcaaacaccagctaccacgctaaggagccggccggaacaggtagttgtgccacgtcagggactaattaaccttgtcaatggcaacgactgccacggggcaccctttaatttgcgacacca

SEQ ID NO: 24527 - DNA, 1501 bp, Oryza sativa
cagcacacctgatatactttaatggaacaagatcttaatataaagggcagatttagcatgtcaatcaagcatacaataaataaagtagctaaatcaggtaagatcggctgaaaccccgatgctatcttcgttagagatcataaaacaagccagatattgcagttacgaatattacttaatagatcgaactcaaccgatgcagcattaagcataaggataaatacaagatctaagcaagatgatgaaaaccttagaaagatggtagatatgctatataatctagattaataacgaaatcgaaccctatcggctactctccagtgatagatactagccgatcatagattaaatcgtgaaactaataaaggttatgaaacatatatgataacttgacgattcacataaacaagattagagtaacatgaagatgcaagcactaatcccgagaacgcaagctgacataacaagtttacctcttgttgaagattgaaatcgatgcagctcaatccgaaagcaagaactcgtcgaaaacattgaaagtagaaaagggtggcgatgcgctgaaagtgttattgaactgtcgtttttaattacatgggttcgggtcatatttatacccgagatacatgataggtccttaccggacacgactcttatctctaacaaactctaaaatacaaacgaatcttcacggcggactcttgccgaaacatatctctaaagaaactattcaaaatatcctaattaatagatacaattgcctatctgtgagcttacctctatcgtggcaatcctgatgtagcacgtcgattgattccggaaacggtttcataaccatctcaacgaaatcggccgtatcggctgtatcggctatcttctgtccgacccatctcagccgatgccctcgcagccgatacgtactctgttttctgaacacaatccttcaccgaatctacttcgattctgatgtcgaacctggttcatggtttactaaatttggtcgttaacaagggttataatatatcatttttttaagaaatatattaaacacccaatataaccataataactcaaacgtcgattcttttttttttaaaaaaagagtatagtgcatggatgacctctaaacttatgtgaatgcatgtgtcatataggtccttgaagttgttatgtgtatcatataggtccaaacgggtttcaacctattccgtacgctgacgtggtatgctatagtagcacctatagtacgtgccggtgagatccatgtgttagtcacatatagaagcaaaattagaaacatatttttctcctctctctctctctctctcgcactcttaatttattatctttctatgtgactgacatgatatgtgggtcccactgacacgtaggcaatactgtaacatgccactttaggacacggagcgggttggaacctgtttgaacctatatgacatccaggacaagtttggggacttaaaagtatattatgaaatttcag

SEQ ID NO: 24528 - DNA, 238 bp, Oryza sativa
  unsure (1)..(238): unsure at all n locations
gtgttcttatgtgatactgtgttaattgatttcttcgtctacttatcttttgtcattttatttttgnaattatatcttttatctccncnccccccgtgggggccgccttgattgttatacgtacctcgnaccgcagaataccctaatgattttgggaaaaatcattaagttaaggtggatacacatcttgtcatatgatcaaatggtttcgcgaaaaatcaataatcagacaacaaga

SEQ ID NO: 24529 - DNA, 1501 bp, Oryza sativa
tctcggtatgtagaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggaccccccccccaaaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatatggttaggtgagccccgctatgctcacctaccccatatacgcggcgcaaaacccacaagtggtcggggcgcctcggccctcggggccgagacgggagcggtccgacctctcggggagacaaagagaagggcggccgtatcaccctcgggcccgacccccccccccccccccgagggggttaggccacgtgggtgatcatgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaatgcgcgcacgagatgttccatctcgactgccacagccgcttatccacctcatgcaccgcaaacgggcgaataggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcttgtgccctaccttcgccacacgcgctcgctctcaaacatctcttcttccggcatca

SEQ ID NO: 24530 - DNA, 1501 bp, Oryza sativa
ccaatcaggtgagtgacagacagagagaactgtaggtaaaaatttaccataccccaatgttcctccgccctcactaataaccatgtttgcagacttcttgtccttgcgctcaggacaatccttggcccaatgcccaggcttgccacacacaaagcaatctccttttgcctttcctttgcctttcttcttaaaattggtagtagcctttggtttgacatcaggcttgactttcttgttgttgttgtgagatgcatgaaggttcttcttctgcagcaaattggcgctagaacctccctcgatctttttgccctggttgtcctttgccctcgccttctcctcaacacccaaagagacaataagatcagtaacactgaactcttgcctcttgtgttttagagaagtagcaaagtctgtccaagaaggtggcaatttggcaataatgccacccaccacaaacttgtccggcaactcgcagttgttgttctcaagttcctttgccagcatctgaacttcatgagcctgttccactacagaacggtcatcgaccatgttgtagtcatagaactgctccatgacatacagcttgctaccggcgtcggaaaccccgaacttggcctcaagatcatcccacatgtccttccctgaaggcatgtgcaaatacacgtccacaatactgtcggcgagcacactgatcaatgctccacggaacaagctatccgcagcctcgaacttagcctcctcctcaggggagagaggcggttcactcggtttgccccgtgaaacaaagaaacaatgcatcgccgtcaaccacaaaaagtgtgtgtgctttccatcttttctaatttgaaccatcgaaagcatgtggttttagtgatgcagcaaagccaactaccgaaaaagacctatcaagtttttggattgttggaaatttggtcataattcggcatattttaatccaaaatattaagacaataaacatgacatacacaatgagaaacgatctagtgataaggctaaacataaacataagcatgcttaaggtaaaataagcatagacatcgttgacattcacataggattgaaatcctatggataacattgtgaacatgtaaataacaagaagaaaatcaaataaagtttgaatcttatacccagataatggtgcagaagatgttgaggcattcgtattgcctccgttgatgttgtctcctccgttctctaaagtagaagccatggtgaagcagaagtagaggaagatgcaacgttgtcgtcgaagaacgaagaacaggagcagtcgcgcttgaagcgctacccaaaaacttgattgcgcgcctacccgtgcaagttctcaagtggacggagttctggaggcacctgctcgtcccgtacacctgtgtgcgcaggtgaacagaaccgggtaaggattctgcagctacagaggaggaggaactcgaagtgcaagagttgggaagaacttcgtaagtccttctggtcgctgcgg

SEQ ID NO: 24531 - DNA, 272 bp, Oryza sativa
tctagagtctgaatcaaatctatccctacttaaaactttggatttttcccatcatcacaatgtgttttcatccgtcgttgagcaccttctctgcctcgcgcggttagcgccttctcaagattccaaatttcccaactcaaacacaaaaacaaaactaaaaggaatcagactctaatccacccaaataaaattagaagagggatccacgtttgaattctaatccatcgcaacatgaaacaataaaaaaatattccaccttgacttcccttagg

SEQ ID NO: 24532 - DNA, 1501 bp, Oryza sativa; identical to SEQ ID NO: 21687

SEQ ID NO: 24533 - DNA, 344 bp, Oryza sativa
ttcggtaaaatggaggtcgtgggaacaaattctttcacatatgtgtgtgctatgatttgttttcttcctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccttccgactggattgggagtcgcgggggcagcagcctgccggcccagtgaggtcgaacagctgggggagttgtctgcggccca

SEQ ID NO: 24534 - DNA, 662 bp, Oryza sativa
ttctcataagttcatcgatagtctgatgtattaagttctattattgtagtgcaaactcagcatacgcatgctcatttctgaagtgctacagtttccttaacccatccccaagaaaggtcgtttcttaatagtccttagtgatcaccagagtcaagacattatacatcagattaaggtagattatttttcattagcaattaataatagtaatagaaaatcacatgtgggacaactaatacaagtcaactgaattgagatcctataacttatttccctctgatgtcagtcattgacatgtgaaccctccaccaagtgggctggtatatcagagactcaaagttatagggatataagttagaggatttgcttcccaagtcaacggcacctttggaggcctcagttcatatgttatggcccttgtaacttagacttcgtttgaaaaggcttcttaccttagattttgagtggcacgtaaaacgagataagccattaccacttaattaattaagtaatacgaatcaaaaaataatattgtttgaattttttaacacatagtttaacaattagggaaacatgatcacaaaaaatgagggagaaacaaatctaagaagcagtttagaactcaacgttactctctgtttttatttaattgtgttgacagt

SEQ ID NO: 24535 - DNA, 680 bp, Oryza sativa
agtggcagagctagaattttttgaaggggtgggcaaattgtaaatgaaaagataaaactgctacccgcttatataatgtttatgtgctcattttactaccaatcgaaggcagaacaattttctaataaaagcatagtttagtttaatatgcatataatttttcactagttgaaaaactacgttgattttaatataaattaaaacggacgtatgccatattatacttgaatggatcattgtcatccattgtgaagcagtcaagtctggctaggcctaattgcatcgtgcaacagtactgcttgcatggctagctgccagtaccgatgcttctaattatgtctacgaagtaaaaaaatcgttggattttaatgcaaagcaatcactcgatcaccattggtggcacacgcagagcccgagcagctgcccgcgctggccgggcagtgaatatgtcgctcctcacaagttctatcaatagtctcatatattaagttctagtactctaatgcaaaatcagcatgctcatttctgaagtgctacagattccttatccgattctcaagtggggatatttcttattagttttaagttgtccttagtgacctactggagccgattgcccgttctaagcgctgacagaaggcaggttaatttttttaattaaaaatctataatttaatagg

SEQ ID NO: 24536 - DNA, 1262 bp, Oryza sativa
atctttggctcgatcgcttcactgcagtgctcggcttgcttcgagtgatctcctccatttggcgcctttttatagtggcgcgtttgaatctcccgtttgttcgatgttaccaaacccattatcttgagctttggactttggaggactgggccgtgttgcaaggagctccaaatttcacgctgttggtacttggacttggctggtactagtagtttggtctttcgagtttcaacctgactttggtatcctggcacttcgaatttcaagtttccaacctatttttaacataaaatggctagataacacactcaacctaactttgaattctatatgctccattcaaaagtacatctaaatgactgctattaagatgtggaacaaagtacctgctatagatagattgttactgaacactcaaatcagaccttgcattatagtgttaacactggtagcggagtgcctactactatttcactttcggctgtatatctgtacacaagtagtgaagtacagagtatcatgggatatcttgactgatctattcgatttgatgcgtcctctcgtcgttagctgaatttagttgaactgacactttaatgggctagtttggaccttaaggacgcattgatctttgcggctgcggtgtgtttggaccgaaccacagtccacaggagatactagtgggcttcaacaacgtccgtgtctttggactggacaattatctggacggaaagtatgggtacaaatgaatttcgtcggtttggcagaaatcaatctagacccctagacactagcggcagaggaggctggaactgcgacatgatggtttggcatccaacgaaagttttacatttgacttctgtaatactgtcattttggaatgtaatcatcagcagtcttgattgtctggctcttgcctagccctgcattacaggcctgtcttgattggttggctctttcctagccttgcactacaggctctaatgaaatcacatcttcttcatttagtttatagttatttcactcaaaaatgaaattccgttactgtgatcattttgtgagtacattttgatgttatggcaggtctaccttgaattgctggattttggacttactgtaacagcattgatttggacaagatattgctggttctttacctgaggcctgatgaagcacagctgcaattctttctgatcctgataaacacttcaaaattcaggaggcatgatgatagccaactcgacaggttggttctcttcaga

SEQ ID NO: 24537 - DNA, 1501 bp, Oryza sativa
gcgcacgcgcgggcgtggtcgacgtggcccggaggaggcggaggcgtggcggcggttgcgggcgcggcggttgcgggcgcggcgccggctggaggagggagacgggcccgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaagagaaagaaaaaggaaaaaggattttccctggaattaaaatattgcttgctcaattttaattggttaaaattatttctagagctctgaaaattccactaaaaatcctgttagtgaatttcgacatgtagaactcaagcaaaattctacatgccaaatccgattattatttgcattactttcttagggttttctcttgatttgcacctgcattttcttggggggtcgtttataaattaaatttttggcttgggaggaaaacttcggggtgtgacaatgaacgcatggccgcacatcggtccaatgatccccagccgaccattcctcctgcaatggtgagcccatcaggaaatcgtagcagctgcgcctcaacggggcaagtaggatcacagagcatggacgccatgcaaacccaggacgaaaccacctgccccgttgatgacatcactcagcggacaccatgtgagctgcatatccccttcaagaacttatcaataaaggtaaactcgtagtttatagattttagatttggccattccgctagttgctgcttatatatgttgattactaataaataacctctcaccacatgaaggtggcgtcgggcatggccatctcaacggacccttcaggtacttaccactacaggccgattccagcaggatactccaaggtcgaagttgagttggtcgaaggcgcgtacgaggacctcgagctggattaccctggaggagacggtgagacgcatctacaagacacaagccacgccattattctatggcgcaagcggtacatcatcctccctgggcgacaagcggcgtctcgtgcactatctcctccggctccgccatctcctcctcaggctcctacaccgtctcctcctcatgctccagcaccgtctccacctcaggctcctgcaccgactcctcctcaggctcctgcaccgactcctccgcaagctcctcttccggcaccttctaagtcaagggccccccaagctccaccacctgcccccacaagggcaacgaagaaggcgaaaattgacgccgccaagaacaaggacccagggtacgattgcacgcaagaggagcttgacgcttacgtggcatcagaagtcaggagacaattcaagcctcgaagtccagaaaagaagattcctatagacccgagtgtcaagaacttcttcaggggtatgtctacacctgccaaggaggccataaagctattggacta

SEQ ID NO: 24538 - DNA, 1501 bp, Oryza sativa
ccaggagcaaaccaaccagaggccagagccactggcctgccagggaatggtaatacgccggctccggcctgagaagcgcatcctgttgatgaagaagaagaagaataggaagaatacaaggcaggtagtatgggtattgtcccatcttaaattttatattcagcctgcaacctagcattttgatctgtttcgcctccaaatgagacgattatcagcagtggtaggtagaggattattgtattacttgtgggaaaaccataatattaatgtatgctactgttggtactggggagtgagaactcgcccagttggaactgcccacgatttcggcttcgtttcatgacaagagtaatcaaattgaccaaatgcaggccttccaggaatttgaagatgcagatatagttgaccttcacacggacgaccttgcaaccgcttctacctacctgaaatatgattgatgatagtagtttcttcctcagctgcacttcttccacctcctccaatctgcacttgtgcagcctgtgacgcctgagaatacatcaagtgaggctccatttcgtaactgctcgtcgctcgtccgtgcaggagcctattaacctacaggtaccaaaatcgaatttcttgtcagttctaatttcctcctctatttctactttacttttgccaaaacatgatatagtagagtgcccgacatgggatgcgtaggaaacgctcattcttgaagttgaaccgattttgaaacttaaaaggggactgttgctatttgaagaccctattatacatagcatagcgacaaccttctccaaacttgttactaacagactagcctcttaattctattcagaaatagcatatcaagatcatagaaaggagaagataaaaaaacgaagtccctttttttacatcaggaacctttctagtgttccattggcatccccatcactccgccaaaaagaactttatcaaatactagttccttgcagctagcagtatagagcactagtacgttatgagtaactataataaaattgtcatcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattc

SEQ ID NO: 24539 - DNA, 1501 bp, Oryza sativa
aagataagcagctccgacttgctacgacggatcttaacctaaacagttgacttcactgaccaagaaagccccaaaggatcacataggagacagcttaatcggaagctttaagaggaaaagaggtccagccactacagtagtccagatcaacagtgacaggcccaaaacatcacctctgacggatttaacctttgtcagagatgagtggtcagtgttgtctcctctcgcctctaacgggtggaggcatcctttagtgatgactatcatatgtgacgggtcgtaaaatttcactcatcacatgtgacagatcgtaaaatttcacccgtcacaggtgatattgttctctaacggactacatattatcacccatcaatgagctgcttaatagggaaaaaaatcagttcacatgttagcacccgtcacttatatgcactaatgtggaaaagcaaaaaataaaaagttaatccttgttcatcgttgtcgtatcaacacagtgtcaaaaaactacaaacagaaaggaatcaatcatttggatctctcactgcaaactaaatgcaataaaatctcttgcggaaaaaaacatggaagatctcgatcatcacaatcacataatctcacatctcacatgaggaaccataagaaatttctgtggaaacaatactcttcggaaggggctcataaggtagacaagacctaggatggccgataggggctcgcatggctagatctggcagcttgccgacaaggattgcaactagccgccaggacctcctcctccaccgctaccaccatccgtcgtggtcttttgcaagttgaacaacaagcttggagggggcaggtggagcttggggtggaagaggcggtagccagagctcgaggatggagaggcgtccactggctcttgggggcaaaggagacgatgatcgtggcagccagagcttgaggtagaggcggagggacgggggtgctcgtgggtgggagagatgacatgaccaataccggatccagccactacggtgttgggggcggtcaaatccagtgtccccccgacctcctgacctcgaggaggctggatatggcacccctgtggctcgatgaaggaggtggtggtggcggtggcaaaccgagcttgtaggtggagaggttgccgccggcgcttgggggcggccgaagctcaaggtggaggtggtggcgatgctcgtgagtggagagaaaactcaaccaacgccgaatcgacccaccacgaggttggggccgatcagatctggcgtccccccacctggggacgccggatctggcatccctagggctcgaggatggtgtcgatagtgacaacgatggtggctgcacatactaaaaatttcttacaaatttcttagtaacaaaaatcccatacaaacttctttctaacaaaaaatcttaaccatttgatttagtcaactgaaaattgtaaaaaataataatcaagatttaaccgtaatgtgatacctcaatgtctgta

SEQ ID NO: 24540 - DNA, 1501 bp, Oryza sativa
ataggaacacactagaagaaccaagatgcatatcgacaaacagtgactacagatctgcaatgcagtgatgacacgttgacaccacgaccttaattttaatttctcaattattaaaatcttcaggtggcatatctataacttggatgattaattcaatatatctataataatgaaaccagttgatcaaaatgtaattaagcaggccaatcaccactgcatattgttaactccttttctgaaatcctgcatgaataatgttctcttcagtgtcaccaccatccaaccacccccaatgtctgaagaatcttagctagtcgcagtcagtctgccttaacaccgactactcccagttttcaggtacaaacaattcacatgcttaacattcttccctgctactatcagcctgtcactaacaataattaatagttgcttactaaataaatattacagcactataaagtatagcttgcttaattagctaatgagatgtgcacgcgtaatgcaatttactaacctgacgagtccacgctaaaaaagggtaacttcttggtggtagtggcatgaattgtactactgacactactagtgtactattaaggactaatcacctcattagtctatacacattctccgttttctaatgtgtgacgttaattatcgatttctgaacatagaattttactatttatcttgctaaaagaactatataagcattatttcttttgttgcgacttgttttataccacatccatcccaaaatattaggatttttagggttgaacacaattattaacaaaacagatagaattaaatagggaagattgtgattggatgcaagtgaagataagtgaggaaattgatttgtggagtgttgtaattagttgggaagagaacatggataaagatgttgttatatttttaaataaactttgaagactaaacgttactattttaggacgaatgaaatacacggctcaagtatatatgacttatattttctatatatttgtacttattttattttaaataagatgaatgatgaattgttaggtgttgacaatgtctcattaaaaacgaagggagtatatataatagaaaaaaagacagaataattaaacagagaaatgctaactataggctaattaaggagatgctaaatataggttaaatcaaggagatggctacttcacataccaaccccattagaaaagggaaaaagctctaccacgtgcatgctgcttcatcacttcatctcctacaccaaccactcccatcgcattatatccattgcttccctttcatcttaaatacttcatctgtcccacgaaaactcaacctaagaaaaaatatgatctcttttaatataacaaatttggataactaagatgtgccacatctccttctaagttaagttttttttaggacggaaggagtacagcagtagtagctacattaattatatattagcagcactcatcctctcactagctcctccttcagc

SEQ ID NO: 24541 - DNA, 1501 bp, Oryza sativa
gataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgcggccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggccgggcggcgacaacagcgactggattttttttattttgtgaatttttgtagtgaatgatgaatggtttgtatattttattggatattttttttgttgatttggggatgatctcacaagatttgtagattgtggatgtgtatgtattgtggatgatttttgttgtgcttgatttgtggaaatttttattgtgcatgattgatgatttgtgtggatttggctgggggaatagatacaagcagcaaaaagaaacaataaataaaagaaaaaaaacagttgggatgtggcccctatccatctttaaagatggatttttaagcccggttatttcacccgagactaaagatacctatctttagtcctggattcgtccttcctgttgtaaaaccgggagtacaggggttccgaagagggagtaaaacccctttctccactagtgttaactaatttatcctccattata

SEQ ID NO: 24542 - DNA, 439 bp, Oryza sativa
gacattccttttgggcccatcaaggcttacatttatagtattaaatagctcaattgtgccattcatgcaaagagtcgatatgtccgagtggttaaggagacagacttgaaatctgttgggcttcgcccgcgcaggttcgaaccctgctgtcgacgcatttttttccccttcccgtagtagggtcttgtgctgttgtgccatatttatcccactttattatcttttttttcctttaactagacatgaattccagtcttcgtgtcatttatccttttgttaatattttttccctttaactacacagtaattctactcttgtgccatttatccatgcaatttattttgcttggactatatctccttgtattcttttttttttctatttcacttgcgatagatgtttagagtcttatttttagattttcttttcattcataga

SEQ ID NO: 24543 - DNA, 525 bp, Oryza sativa
gcaagcttctcaagtggcgttttttttctcggtgggtaaggtcctccttttatagttcaaggggataccacatgcaccgccttacacaatccatcattgggtgggggcccacatgtcttgggtcaagccgttgtccttgccttcaaccagaaacaaggtggttgctcatcctcaggtgggcccagcgccgtcccccgcctgacacgggggacacgcccgtcattcgcccttaattcgttggcgactttggtggactccatacaggagcagcacgctcaccgacgtgccgatgggacaggtcttatctgcccccactccgcctgacaccgggcgggacgtgggtacgctgctatccgtcccgtccgcctgttggccggtcacagaccgatcaagcccgattgacgcacatcaatcggacggcgcctcacgtccgcccacgccacattaaatgcggcgggggacggttggggcgatgcttatttaaggcgcttgagagcacccctctctccgcccactcggccacca

SEQ ID NO: 24544 - DNA, 1501 bp, Oryza sativa
  unsure (1)..(1501): unsure at all n locations
ttgcatgtgggtagcttactagcttatccgatgataaatatgttgaaggcagaagccatttggcaccatgtgtttcacaggggttaatctattagcaattctcttaaacaacttttactgaaggtatcatgagaatggtattgacgcgttcttagtgaaattggactgacaggtcattggtctttcanggttcaatgcaatgtatgtcatggggtttaacttgatctatggaaccactgattatcctgtaccaattttaacagaatgagtactagatgaaattgtcaaagagcaatatgtagagaatgctagtagtatgctagtcagattaccatacatgttcattttattcatgccagcattgaccaatactccaatagttactttcataatgtttatacataaatgataccactcatgaatacacgattcacatttccagtgtgatattctaaacccttgtgcacaagtataaaataatttataaatggaatcagagggagtactgaattaatacatggaaacctacaatgtcaggacagaaggaagttgtgtttgataacagcaatagctcatattaaacatggacaccaaatggatagttggaggcaagtcagcttgggaaaactaagctttacatctttttgtcaacatcttaaatcttctgatccaatttctttacttttcttgacaaccagctataatttataaacggcgaattaaggcatactagtgctgaacatgtcactatgcactggatatgcatattttactttcatttgtaggggttggttttaagtcagttagtgggtcttgcatcttttaaacagttccctatcaactatagctagcattcatgtcttagtttctctgtgttgtttttaagactcaggatgccctataattttgttgaattttctgtgctattgtgtatatctccttgctccagcaaacaatctgtttgttattttagctgtgcatcagaaacaatgtacattcgtgctttgcttaattgtctgtcagaaccaatctattatatggcttgaatgttttgttatactgtgaaacacagagaaatattgtgctccctaagaaatattgatggtgaacttgtgaggcctgctgcattcattggtcaaagttctacaggtatgataatgtgttatcggtgatcagctgagatttaattgtagatcactgatttcatagaagtatgattttgaaacatatgatctatagttctttactttttatttcaatatgctaagttcttcaattagaatatgtgttctggtctgattttcattctccaggagtttgtagcattttggatggtaatgaccatacgaaataaacatagtggtctcctacattttcctttatccaagtagtttagtggtagtaatattctatgaatggagcatttatgcatttaaacatatgaatcatatgatgtgtttatttatttcaagttttttgcctttaggtgatcaactgaagg

SEQ ID NO: 24545 - DNA, 953 bp, Oryza sativa
gtcctaaactctcttcccatcaatttatatttttaggttataaggccgtgccaaaattttaattttaaaatttaattttaagagttaattttgtgagtttttatcatagtttattgtttagtattggtttttaaatcgcaaataatatagtagaaaagttttgtctataaattttttttagttgtttgtatgttgttttacattttatcagttgtaagccaaccgatcagactaacccaaggaaagactcggagaggcttgacaaccatcttaatcgagtgatcaccaaccatctggtttactctgaggagccttgaacaattccgtgatataatcctgttcgtttatgtttaagatacacattctatctcaattttcgttagaaagtttttaaaaccactaaaaagtgtgtttcatgtgaaattttatagaagttgctaaaatatcaaatatatatttatttttaagattaaaataattaaaactaaattaattgatccgcttcttcatctatctctgaccgggtcacaactcttccaaaatccagaaagaataacctgaaggaacgacttggccattcactcgttcaggccggtcaatgcagcatcacattaacaagacgaggcaacagtaacaaaagagcagttggtgcacaacttttcaagcgatgtccccattccaccggaaagttttccctagcggacacaacaaaagacaaacatttactctgccccttttttcctcttcgttgtcagacacgtcaccagtgaaaattaaattataaacatcgaaccttgttgttcatgcatggtacagtatggaggtgagtcaagagatggactagccgtagaaactgtaggagaaaaaggaagaacagtgattgggaccaagatgactcgttcacccttatatttaattaatcagcaccgtttcttttatgaatcatgatgtaa

SEQ ID NO: 24546 - DNA, 376 bp, Oryza sativa
ttcctgcagccctattgttgtaccatgtttctttgtcagcttggggttataacatgactagagattggactagggattgcttagccatgcttagttcaactagtgcacaatggggagaatccttttaatgtttagactgttggttctaatggtcttgttggattagtgccaccgctttggtgttggttaattaaaataaatcacatggtgggctgtgggtgcatggttttgctggtcgcacccatggcagttaaggaccggttcgcaggatgccctggaagaacttatcatacttaccacaagccagcgtgggcaacggctgggcttgtagtgtagctttcctctagtcaactcatccaggcaagggtgggcgtga

SEQ ID NO: 24547 - DNA, 1047 bp, Oryza sativa
aatcgaaatcggaatcggaaaccccggatacgaaaacggaatcgaatattatcgaaatcgaaagcggagcgaaaacgaaccggcgcgaatacggtaacgaaaatttatcggaataaaaaacccctcaaactaataaatctaattaaataaattatctatgtttaaaagagtaatgttgttgataaatcccaatgtagcacaaaaaatattcttatgtaattttagatttgcataacaaatatttttttaaaaaataacagccaaacaccatggtattcactatttagtgcttaaaaaaggaattaagggtatttcagtcacaaaatttatggtaattccgaggaaatttccagaaattccgagaaaatttccggaaagttttcgaccgattccgagttccgatggaaactgcccttatcatttccgattccgtttccgagaaaatatttccaaattcgtttccgtttccgaaaaattccgaaaaaattccgaccgacatattccgttttcgaaaataggtccgaaatccggaaagtttccgtaccgttttcacccctagatgtatgtatgcgtttacaagggtgagtgtgcttacatgtttaagagcatctacgaatttgtacaatgttttaaaaaaatatttaaattctcaaccatttccattgagcagaaaattcccactgaaattctagctgggaaatcctactcctaataaatcctagtaggccaacaccaagtcaacagtcaactctgctacctcggatctgagtgagtgaagaggtgagcagcagtagtatagcaatagcaagcggattaattatattaagaggacgtgcaaattaattaactaattaattaaacacccaactaatctccactaataaaaccgtattactcccggccactgacaccgcagcgcagcataagaagaagccactcgccgccgcgctctctcgtcttcctcctcactctctccagcttccctctcctcgagctcgagatctcttcctcctcctcgatcgcgtccatccatggcggcggccaaga

SEQ ID NO: 24548 - DNA, 462 bp, Oryza sativa
ttgcaagttagatctatgcgtacacgaatctttgatgcaagattctatgaatgaaaagaaaatctaaaaataagactctaaacatctatcgcaagtgaaatagaaaaaaaaaagaatacaaggagatatagtccaagcaaaataaattgcatggataaatggcacaagagtagaattactgtgtagttaaagggaaaaaatattaacaaaaggataaatgacacgaagactggaattcatgtctagttaaaggaaaaaaaagataataaagtgggataaatatggacaacagcacaagaccctactacgggaaggggaaaaaaatgcgtcgacagcagggttcgaacctgcgcgggcgaagcccaacagatttcaagtctgtctccttaaccactcggacatatcgactctttgcatgaatggcacaattgagctatttaatactataaatgtaagccttga

SEQ ID NO: 24549 - DNA, 1501 bp, Oryza sativa
ctaaatgaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctatgacggctttggaaatgccttgtcatgaaagcttggaggtctcccgacgtggctgatccccacgggctgggtgatccgggttagtaatgtcatgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatagaatcagctaggcctgggtggccgtttgaaagttgttggcccgggtggccgtttgaaaagctgttggccgggtgccaaccttgtttcaattctaaagactgatacattacacatactctgaccggacgagacgcactgtctcatccgtgtcgtttgagaagcactcacttagttgtttttagaaaagagttcaaataaaatcaattgcaaaaacaacagcctctccttgaagcctgcattaaacacttatttcccctggcttgctgagtactcccgtactcacccttgctctatataaataatccccccccccagttgctgaagaagatgaagcggatcctgctgatgaggagttcttctaggagcaagccggctacgatgagttttagggtttcggcctagttcccaagtcgcgcctgtgttgtttggtcctagtcctggcttccgctttccttttgtaatgcagttgtgagctcggggcctgtccgcagcccaacatgactgtacctctactctataataaagagacctctattgctgtgataatctgtcttcctgtgataccagcactgtttcctgggactggtatcgattaacaggttaatttggagcgtcacgggctagttccggtcggtactagttcggggcgtgacaatgggttgcaaggtatttatgctcttagtgttattattagtatgtatctaatttccccattattttatcgttatgtgagtctgtcttatttattcgctctcatgcaaaatgatctatgcataaaatttcgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgta

SEQ ID NO: 24550 - DNA, 1501 bp, Oryza sativa
ttcaaggagaggctgttgtttttgcaattgattttatttgaactcttttctaaaaacaactaagtgagtgcttctcaaacgacacggatgagacagtgcgtctcgtccggtcagagtatgtgtaatgtatcagtctttagaattgaaacaaggttggcacccggccaacagcttttcaaacggccacccgggccaacaactttcaaacggccacccaggcctagctgattctatcagctacagatttttcaaacatcgaacccctttccacaacagcaatttcacaagcagtagttaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgtcataggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcaggttttccaagtcttttgtaaaacccaagttttacccaagttgttactcaaaattttaagtttgaaggcgtccgtcgatactcgtgcagggtgcacgaatatcgagacgcaactagatggttacaagggggacatggtatcacaattaacaaaggaaggatcaaatgcaacaaattgggtaggtccgccaatctgccttgcagatgggacaagcagcttaagtgcagtcctatcaatgcataatatttttcaagcaacataattaaatttcaaatataggctcaagatgttcaaaggtggcttgccttgctcgagatctggagcttgatcctcgaaatcagcgcactgcgggtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgagtttctaagattattggatttttggtctaaaggaaaaggatttaattaaatcctttttgaaaaagaaaagaaaagaaaaggaaagagggagggaaaatagacttccctcgggcggctagggcgcggcctgagagaaagggtggctcggccgagcttaacgagccggccggcc

SEQ ID NO: 24551 - DNA, 1501 bp, Oryza sativa
tccagaggggaatcccctgtcaccgagccggaggtgaggctccattagggcttcgcaacagctctgagggagaccagcttcggagcatctcccttccttgacggagcccgaggcatcagcaaggatgggcgttcattaaagcgcactagtagccgccaaccaccctcggacaccctggtgcggctggtgaggcagagaccagagctcgccatggactgggggagggatattacctaagtaatagcctgtagccgggccatcaggggaaccccaaagtgagccaagatgccgccttaatgggcgccatccctgcatttgtctcccaggaaatgactcagttaccccctaggtgggcctatctgctcactgggaagggtttaggtctgtagggttatgaatgtaatttcccatgtcttgtacagactataaatgtgtacataatccccaaattgaagaggaggaacgcaacagaaaaggctagaatacactagttggatttgctccaacaccattttttttatcaaaatgtgtgttcttggcacattttgatagcaaaacaaatactaacaaagtactattaaaagggtcaacaatttggtatgacttggcttcaaaccaagatggtccggagtacaattttgtttcatctattttgtgaaaacaaattcatctagtgatcgatctagtatgcgcctcagagcgcatgaagagcgtctgacagagataggagagcagtagtagtagatcaccctatagtctattccctccgtcaaaaaaaaacaacaactaatattggatgggatattttctagcataagattgttcgttgtactagaaaaatatttcatcccatacagtttggattttttattttttacggaggtagtatagcttagctgctttcaagcttcaacgactacttctaccaacatctgaaaccaacatccaagtcatcatgtccaagatgtctccgtcaacaagaagggcaaactatctgatttgatttgatttcgtacaccagtagcttcaacccagatcatctggtccctctgcaattagtggcaaagaaattctactagtaaaataatccatatgatccacaatgatcttagcttggtgatcagtttctttgacacaatctagaagccgaccaaccacaaaactttttccagtgtttgctccacaaccacaggcaaccaatcgatgcctccgtttgtgccattccaaaggtaaagccaacattgcatctgtgctcatcaaccctaccacttgtgatcttttctcttgcttccagtactacaaggtcacctggaatcaccagcctttgagaccaatcgccgcccgccacgtgtcgccttcccttgcacgccatagagctcatcacaccaagaccatggtggcactgctatataagtagctcatgagcttcacctgaacaacacatcaagtagtgacactcactcacacgatagcaagaagctagcttggttgctcacattga

SEQ ID NO: 24552 - DNA, 323 bp, Oryza sativa
cgctacccaataagcagccgtcatatgggccggaggcatctcggcccggcagcagcgcgcacccgcagacgggcggcactcccgtgccgaatgctagaccggcccattaggcccaatagacgcaccaaggtccaagtaccaggagaggcgcgcattggcgggaagagggggagaaaacgacgggatgcgcccccgtcagtggcgcgaaaaccccacccgctataactcctctccctcctcacctcaccacttctcccgccattgctccgctccccaatctccccaacgagagagagagagagcgaggagagggagagggagga

SEQ ID NO: 24553 - DNA, 746 bp, Oryza sativa
ttcaagaagattcccttgctctcctgacttctccaccccgttccaagaacaaagcagacagagagcgaagaagcaacaaggtgagcccatgcttgattccttgatccatattagcttattcttagcaaccactcgctgtttcttgattttctctgcccgattcgattccgtaaccatggggggttcgatttgagtatcatgagctgttgatttcatctcccacgaaccaaggtaggttagtagcggaagagaaagttttatgctttacgaattcgagcgtctgtagtgatgaaaaggaagtaaattttggatctttctagcgtttgtttcggtggggaagctgaatctggctgatttggtgcgcaactcgtgtatgcattgtttgtggaagtgtgagatctaatctagaaatctaatccagcgttaccgagtttgttgattttttttgtgcaaaaattggtcttgagatgggctgaaatccactgtattgggattctgaagcgttcctgtaagatctaacactagatttggaatgtgagagaggaggaagggatctatttgaggctttcttttggccatatggagaaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttct

SEQ ID NO: 24554 - DNA, 355 bp, Oryza sativa
tgcctgcaggtcgactctagaggatcccccgtgtatacataaacatacaaggcgtgcaaaggaaaaattacaaattttgcaaacatgaaaataatataacaccatgcatgaatatgtagaatttacagattcaaaatcagttccaaggagatgccatgatctgcaatgcaaggggcatcaatttatatagattctaccattctagcacacccatgcatgctcatatattattctccatatatacttcatacaagcttaattaattaagcatataacactttggtgatagtaattaaactcttccataaatatcactccatgaaaaagccacatatatatgcatatggtaaataga

SEQ ID NO: 24555 - DNA, 1501 bp, Oryza sativa
acatatcgtttagcaatttaaaaaatgtgttaaccgaatccgatgtataatttgcatcttaataataaacaatcggggctttggcctacaataacgtattattctaaaatcagtaaaatcaaagtgtttgattgttattttgtaatgaacaattggcatatgatattatcggttttgatatttggagattattgacgaagtggatttagagatgattggaattttcaggtgatgaacaagaattactaacaaagtggttgcttatcagaccaacgtatgtgagcggtctgaccgaccgacgttgtgttggtttcagtttaggatcgattctttagatatccatggataattcatatttatgatttctagatagatactagtgtgtaatattgttatttgctattagtgagtcaagttggtgagaacttgcactcagatatggtttcttggttggtgcatgtgtaagtgatttgcctcagaagagcgttgccaatgatgaatcgggagtcaacttgggagaagatgacgtccagacgatcaagatataatgcaagatgcttaggctaacgattaatgcacgtggttagtgaagattccatatggcatatgatggagatattgtgtaacttttagttctgctaaaaatttcagttttttggtacttcaaccattcacctcttctggttaacttagttcttacagtccgatcctacaaaatcctcaaaactaatactccttctattctatatcaatcatcattcatcatataaccttggactcttcgtttgacatgtagcttatattgcatttaggcatgcatgtatgcagacattgataggtagttaagtcctcgttttctatgcatgtgggacttaaagtctgcgtgtttcttagttctcttccaccatatatgctcacattaaataaatactaggacttttaggcgcgcttcgcggcgccctaccgttcattaattaagagctatgtagcttatagatggtaatagggaaacatttcattaagagctatgtagcttcaaagcagagcaaatagcatgactatgagagagacgctgagagcacctaatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatc

SEQ ID NO: 24556 - DNA, 1501 bp, Oryza sativa
  unsure (1)..(1501): unsure at all n locations
cccaattgacgctaagatcgattatctttaatgaacgaagccttgagaaggaagagtgaatagaacaagatataccgcactgagataagctaagaatctctagctgaggagtgttgtctgctagaataagtgaccaacttgatcggctgcttaaaatgttcacatcatcaagatggagctcccttaggttgcttagatttgccataacagtttgaaagcttggcttaacaaaatataacccataattacgggaaaaatcaagagtgacaagtttcttgagggaaccaattccaatggggatctgactgttagaataattgggctaggcccaacttaccctattaaatctcaaaggcccataataagtgttaagcataataataccacctcaggatttaagcgaggaatatctcaacctaaatagggagttattggaggccccatgttgactggttgaggtgggggtcggaatgccacacttgcgcgcgcgcgcgccgaggccgaggctggcgtgcgtcacgtcgctattcttttacagccactaaccacgttcccacgactgtctccgcaacagcgcgtccacgttcccacgactgcctctctctcctgatagataaggaggccgcgagtccgatcggttccggacgcttgcttctttctcggtgttagttcctcctcctccgcgccagtgctgttatcgcttcctcgcttctgatctcttgcgcgcacacgcttgcttctttctcggtgttagttcctcctcctccgcgccagtgctgttatcgcttcctcgcttctgatctcttgcgcgcacgagagattggaaggaccagtgcctccgaaaccacatcttcgcctgagatctgcaccgggtaggcgggtgatcaggtttttggggagtgcctcccgcacgactgctcgccatgtctggagttgccaccgccgctgctggagaagatggcataggtggtgcgccaggagctggagccggtgccgcgaacgacaacatcaacggagacaattctgcctcacaatccagcggaggtccattcttggggtatatcttctcctgttccctttgttagcgctatcgctttattattatgtgcgctatgttcctgttcgtgacattcatgatgcctctagtatgttattgcgtcactgtaatgttcctgtttctgacattcataatgcgcatagtatgctacttcatgatgcctctagcatgttattgcgtccctgtaatattcctgttcctgacattcatgatacgcatagtatgctcctggttatgttaagatcaccctacaccgcttatgccatgattattgttttacatttgggattaaaatatgccgattcatgactatatttccacaatcccaaaaccgtgataggtcattttcggtagttggctttgctgctgcactgaaaccacatgcttttgatggtcttanctataagagatggaaagcatgtgcactattgtggttgacagcga

SEQ ID NO: 24557 - DNA, 547 bp, Oryza sativa
agtatgtgactcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaaaaaggactagctgatggactgccgctaccctctctttagtcccggttgatgacaccaaccgggactagtcccggttggtgtcatcaaccgggactaaagatcgatctttagtcccggttttttcacccgggactaaagatagcgatctttagtcccggattggtagtcccggtttgaaaaccggaactataggggggttacgaaccgggactaaaaagcacttctccaccagtggtcgtcgtccctaacacgctcgcttccatctccttcctccgtgccgctcgtcccaccgcgcttcgcactcggttccccggccgccgattcccctcagccgttgccctcctagg

SEQ ID NO: 24558 - DNA, 1501 bp, Oryza sativa
gcagtgcatacttagctagctcttctggcatatgactaaccaaaactggaaatgatcagagaagtatgctcgatctactcatatatttttattcaggagaaaaatagagcagatctgatatgtgtgtgtgtgtgtgtgtgtttggggggggggggggggggtgttgaccatgtcctgttctctgcctgatacaccagcagtcaaccattaaactaataagagagaagaacacatataataaacctggatttaatttttcgaattctttactgagtagacttttttgccaccaccctgttgctctacattaaatcgcctcttcaatcgcttcctcctttttgctagctgctccatttttcctccttcgatgttcatctctgaacatataaacacgttcttggcattattattcctggttcttgatataatcgatccgagctgtttttatgatcattttgcatgctctccatggccaacctctcgtgttcgtccatggtcagataggatctcgtccgcatcatcacacggtatagtttttgagttctttgtgatcagatcatgaagatgagtcgtttctgctctgtggttggcatcgtttgcggctccccgtcgtcttcaggcgatgaagcttttgcttcccatggcgagcagcagcaggcgacgacgacgacgacggcgcagtcttctgggaagagctcgagctcgaggaggaagacggcgccggaggcctccggcgagcacaaggcgggcggtgaagcgccgccaccggcatccaagaagacagcattgctcgacaagggcaaagagaaggtatgatatctataggttactactcatgttcgtcttcatcttcttgtttgaagagcagatgctactctttcttgatgcttgctaattttgtggttaaaaactggatttgatgcagtggttttatgcattgatttgatttctttgggatgaaagtttcagaaatggtggtgttccagggagaagaatatgctagggcatcatcatgcatatgctgggttgagataaaaagaaacatcataaatgtgggatttaggatctacgttttaaacatattcacattttttttttgcggggaagacacattcacagttttttaatttgtggggaagacatattcagctttgtgtgtgtgtgtgtgtgtggaagacatattaatagattttttttttatttgtggggaagacatattcacagtttggttatgtttttgcggatcattcatgaaaatgcaccatttccttttaaaaggaacctatctatttcaatatttgtgatgtggctaatcaagaacaatacatcgtgcatcaattagactaaatctttctttgatcatttaggtatcagaaatggacacttctgtcaggagaaccagcaaaggaatatcaggcaatccatcagaggattccaacgaaccagtggctaaatctccgacactgaagaccgtgatcggcagcataaggaactatattgc

SEQ ID NO: 24559 - DNA, 1501 bp, Oryza sativa
ataggaacacactagaagaaccaagatgcatatcgacaaacagtgactacagatctgcaatgcagtgatgacacgttgacaccacgaccttaattttaatttctcaattattaaaatcttcaggtggcatatctataacttggatgattaattcaatatatctataataatgaaaccagttgatcaaaatgtaattaagcaggccaatcaccactgcatattgttaactccttttctgaaatcctgcatgaataatgttctcttcagtgtcaccaccatccaaccacccccaatgtctgaagaatcttagctagtcgcagtcagtctgccttaacaccgactactcccagttttcaggtacaaacaattcacatgcttaacattcttccctgctactatcagcctgtcactaacaataattaatagttgcttactaaataaatattacagcactataaagtatagcttgcttaattagctaatgagatgtgcacgcgtaatgcaatttactaacctgacgagtccacgctaaaaaagggtaacttcttggtggtagtggcatgaattgtactactgacactactagtgtactattaaggactaatcacctcattagtctatacacattctccgttttctaatgtgtgacgttaattatcgatttctgaacatagaattttactatttatcttgctaaaagaactatataagcattatttcttttgttgcgacttgttttataccacatccatcccaaaatattaggatttttagggttgaacacaattattaacaaaacagatagaattaaatagggaagattgtgattggatgcaagtgaagataagtgaggaaattgatttgtggagtgttgtaattagttgggaagagaacatggataaggatgttgttatatttttaaataaactttgaagactaaacgttactattttaggacgaatgaaatacacggctcaagtatatatgacttatattttctatatatttgtacttattttattttaaataagatgaatgatgaattgttaggtgttgacaatgtctcattaaaaacgaagggagtatatataatagaaaaaaagacagaataattaaacagagaaatgctaactataggctaattaaggagatgctaaatataggttaaatcaaggagatggctacttcacataccaaccccattagaaaagggaaaaagctctaccacgtgcatgctgcttcatcacttcatctcctacaccaaccactcccatcgcattatatccattgcttccctttcatcttaaatacttcatctgtcccacgaaaactcaacctaagaaaaaatatgatctcttttaatataacaaatttggataactaagatgtgccacatctccttctaagttaagttttttttaggacggaaggagtacagcagtagtagctacattaattatatattagcagcactcatcctctcactagctcctccttcagc

SEQ ID NO: 24560 - DNA, 1501 bp, Oryza sativa
gataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggccgggcggcgacaacagcgactggattttttttattttgtgaatttttgtagtgaatgatgaatggtttgtatattttattggatattttttttgttgatttggggatgatctcacaagatttgtagattgtggatgtgtatgtattgtggatgatttttgttgtgcttgatttgtggaaatttttattgtgcatgattgatgatttgtgtggatttggctgggggaatagatacaagcagcaaaaagaaacaataaataaaagaaaaaaaacagttgggatgtggcccctatccatctttaaagatggatttttaagcccggttatttcacccgagactaaagatacctatctttagtcctggattcgtccttcctgttgtaaaaccgggagtacaggggttccgaagagggagtaaaacccctttctccactagtgttaactaatttatcctccattata

SEQ ID NO: 24561 - DNA, 1501 bp, Oryza sativa
tgaagataacatcatcaaagggggcgatcacaatcgtcccctctacattgaaggaaacattggttctgctcatcttcgacggattctcattgacctaggatctgctgtgaacattctacccgttcgaagtctaactcgagcaggtttcacaacaaaagacttggagccaatagacgtggtgatttgcggctttgacaatcagggcaagccaacattaggcgccattactatcaagatccaaatgtctacattcagcttcaaggtgcggttctttgttattgaagccaacacatcatactctgctctcttgggacgaccgtggattcacaagtaccgtgtcgtgccgtctactctccatcaatgcctaaaattccttgacggcaatggagtgcaacagcgcatcactagcaatttctcaccatacactattcaagaatcataccatgccgacgccaagtattacttccctgttgaagaaaacaagcaacaacttgggcgaacaacaccagcagccgacatcattgttgaacccggcaccgagacaacccctgaggtgagatgcctcattatgccatgctccccaatcattagcgaatcatcgtcaaggaatcacaagaatagtaggcggggaaattcttcttcagcaaccaacctcagcaccaagctcccatctcccgctgaaaccagcacgtctaccccatctactacaccaatattgctcaaagcaagacgctctacctcaacactgatcaccttgggggcaacttctcgaggaagcgagaaaccgcccaaaagcaacggcgatgtgccaactaccatcaccttacaggcaagacggagtccaagcaaggaagccgcgcttgcacaacagggagtggtcaagaagagagttgcagagatagaggaggtaaaagcgggtgctcagtgcatgcagcccccagccctctacacttcagtttctaccccgctagagaagaagcgtgcacgaccatgaaggctgagcctagaatggctcgcctattggagaaggcgggcatcaatctacagcgaaacaacaggttgccaccacctccagcagtatgcgaggactggtgggcacaagcggaagagtttatcaagaggagatgtaaagaacaaccaaagtacggtctcggctacatcaacgtagatgaacccgatgatgaagatgaagtatttgaagacgatatatttcattgttgcaccataagtaccactacaagaggtgatgctttactccaacaacacccctttgaggttgcagctgttggagtagaagaggagctcgatgttgcaggggctcttaaacaacttgacgacggtggccaaccaaccattgacgagttggtggagatgaatttaggaactgaggatgatccgcgccctattttcgttagtggcatgctgacagaagaagagcgagaagactatcgaagcttcttgatggaattccgagattgcttcgcttggacatacaaggaga

SEQ ID NO: 24562 - DNA, 1501 bp, Oryza sativa
gaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtggatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagactcattaattaccgtgattttttatcatgtttggtgaatcattttaagagtttcttactcggattcctatcaaatatgtctatttttggaccttttgagtgtttatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcct

SEQ ID NO: 24563 - DNA, 1501 bp, Oryza sativa
gcaaggcgccaacgatagtcatgagagcactttcatgggccgaaattgctgaaaaaatgggctttaattactggaggccactaccgggccatcatgttacggcccagcccaaccagttggtagacttgaccccattcgcctgccttcatttttcacctcgtcgacgcctcatccctcttcgaactcccacatcgtgcaccggatttccctatagctcgccggcgagaaaacgtgacccgtcggagctagaaggcggcgacatggagctgagggcaagtctcactgaccatcctgtctatcatggagacgttgcaggagcgaatcaatcctgctactccgctgcacgtcgtcgctctctaccttccgcctggtacgtgttcgacggaatgcgcctgtgcggttgcacggcattggtgagagcaaattgcacatatcgtcctgtcggtttggtgcgtgactagttttgccttctctgtagtacattttcaggtgacatcatctaactttgcaaatccagcatgtgttctggctccgattttaatcattgatcttgaagctggagagatggggacaaagcaatcaagtttttccatgtgaccagcatcgtcttactcatcaggtgattctgccaccttaagttacaatttagacagtaattaaagtcgaattacattgcattgttcgttaaagagtagattcatacaagctcatacacaccgcatgtgcgcaatactaagttacggtattactggtggaacgagaaatgttccagttctagcgtttcgctctccaaaacaacggccactctaaaaccgattccaaacccagctgcttcgtgggagctaagctgctgaagctagatttcagcttgcttgggcagcaaatcaatcatagtatccaattatccagtgctattagttgacaaagcactacagcgttgtgtgatcgtgacgcctattaggctgtctttgagagaaggaggaagaagaagatacgcaaaacaagatgaatcattagcacataattaattaagtattaattattttaaatttaaaaatagattaatataattttttaaaagaaatataggaaatttttagaaaaagaccatatcgaagttaatatgagcacggaaaacaagtgacttctgtctgtatcatgtcctctccaacgctgctagtctgtcatggattggcagcacgctatcctggacgtcattgtttccagtttgaacttggatttgacgcagtcttttgactcactctaggctgatatttctcttctcaacagaggcgtccgtggaacaacatctcaggtgtgctctgtcaaaagcaaaattcgctcttgttttgacctgtaagcaaaaattgtttctttttgactagtataagcagatacagagatactccattgcctataaatcacacgtactaactggcggggttgtgtcatcttgtctatggtagttcagcaatcctctgcttttgtcagttgtagttca

SEQ ID NO: 24564 - DNA, 1501 bp, Oryza sativa
tatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttcgtctttgtctagagatttgtctagggagtagagacgacgatgacgacgacgaaatcatcgaactaaacacaaccaccaccacccccttgcctttttatgtagatcaccctatagctacctagctttaattatatcgataaattaactgtggagaatatggatattccatatctacatgacagttataatttaatcggatatacggtaccaaatatagatagaatatctttatgaagactcgggttagttttttacttgtatgtcaaggaaatacccgagatcttagtcggttacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcga

SEQ ID NO: 24565 - DNA, 250 bp, Oryza sativa
atctccggccgtgaggccaaagaaaaccaaagctaaaccgtcatcggccaggactccaaatccttggcagttacgagtaatctggatgaagtctatatattgctggtcatgcctgtgcatcgattatgcaatacggcgcctcaggtgtttaactccatcgcaggtatatatccattgtcgattctttagccgccggaattaggacgcttcttgatcatcctgtactttttcatcaggaaccatctcgaga

SEQ ID NO: 24566 - DNA, 1501 bp, Oryza sativa
ttgcatatcaactggatggtccaccctagttcgatacctcctgacctcctgtgcccatgtactgcaaaagcaagacatgcagtacaacatgtgcatatatcacaagttttcaataaattgttacctcaccaaccttcgtcgaatacctatcgaatagcagttgttcgatatgtaccctgtcgaattttggttgtttgatggagtagtatgctactgtgattttagtcagccgacctacatttttgtatttcccatttaaattgtattatttctaacaaaaaaattaaacatccttttgcttccatagatgctatcttttcctctcttccaatgacacttgatagaagtcgttgctgggtcaactcgagactgattggaattggatgcccagttgcccaaattgatccgtgtcgcgctatcctgccgaattttttgcatctaaacacatgcagcccgaaattttcagatgtgagcacgcaaattcaggatttaaatatgtagacatgatgctcacatgtacactggtgtttccatctaactgctattccaacaaactcatgggcctgtgaattgattcaaactatgatcaaggtaaggatgatagatggatgaaccattacgggaggcaaggaaaatagggcaaatttgccgaccgcttgctgccgttagcctcaatttttcttcgacctccatcgcctctctttactaatccaacaaacaatttttcctgagtttagatattgtttttttatgttggaaattagatctgcataggcagctgtgagcatgtgaccggtgagctccaaatctaatccatctgcttagtgtaatatgttcatagtaagcaaaaaaaatattaaacaacttcgattggctgaaaaaaagagacttactccctgcgtcctataaaaaaccaacctagtaccggatgtgacacgtcctaatactacgaatctagacatacatctgtccagatttacagtactaagatatgtcacgtccgatcttcgattttagatttattttttataggaaagagggagtatgcaactggggctgctagtagtgtacgttacggccagaaacaagacagcagaagggcaaaaggcccattatttacatggacatttagttaaatacatcctatttatttcgttgggcatcagctcaaccggatttgacatggtctaacgaacatgctgtttagaaatagaaattcaaacgttacgtgctcacatctggaattttggagctgcatgtgtttagatgcaaaaaattcgggctatcctgtctttagtcttcactactacccatttccctttttgacccagtgatgctccgagcgtacgtgctgggaaccattcaaacttgaagcagtgcgtagttatggcgactgtcaatctaccatgcatgactgcctgatgctagcaagaaaataaaagaacgcgtttcaaggcccttggtcgatcgatcatcgatatataacgatgaggaaggtctc

SEQ ID NO: 24567 - DNA, 1501 bp, Oryza sativa
tccgccgccgccgtcacggcctggaggagtagcgccgccgccgcgagcacgaaggacgacgaggctgccattgcttaattagctagattaatgtcgaaacaagatttcggcaataataaaaggggtggctatcaagctaggaaagtggatgagtttggagacaaggaattttatataggttcaggccttcttattcaacaagtaatatcctactcctgtccggagatgattccgccgagtacgttattgattgtataaattggaaaaaagaatcgcgccccgagaggcacacggaccctccttatataggggaaggagtccgctttacaaaatacagcccatatcctaacggaatatgggattatagataaaatacaatcgtaaccgactaagatctcgggtatttccttgacatacaagtaaaaaactaacccgagtcttcataaagatattctatctatatttggtaccgtatatccgactaaattataactgtcatgtagaaatgggatatccatattctccacagtagcccccgagaccttcgcagttgacaaaacaaccttctcgaaacaaaaaacagcaatccgagtgcttcaattcaacttgctccagtttgccgagtgctaaaatcaaagactgcgaagggcgaaaataaaacatggtgcatcgagtagatgcacctaattaggtatagcccccgactatgtaattagttgaaaaactaaacacgtagtcaagaaccgagtggttttatcaacactccttgaacatatcaaggataaaaaaatatgaaagggccgagtgataaacactcaaaaggtccaaaaatagacatatttgataggaatccgagtaagaaactcttaaaatgattcaccaaacatgataaaaaatcacggtaattaatgagtctaatagcctaggctgtgacccttacaataaccaaaataagcatataacatgctaaaagaataactattagtaaaccagtcatctcaaatcaacccaaacagcttttgcagcctaataaagcttacaaaaatggtataacacctttctgtcgggcaccttttgtttgcatcgtgttaattccaaagaattatcaaaccgcattaaaaagggttttaacagcattggaccacatcattgtgagcacaaattgccaaagcaaaaagtgcctaagtccctaaggatcacaatgggccacgctggaaataaaattgggctgaagtactgtgccggcccaggcctgctagcgctcccgatactctaatatcaccgaagtgaaaaatgtctcttcgtcttccccgccgagactctcaccattttccccatttcctgctacagtacaaactgcgccggccaagctagggttcagcaatccgctccaatccatcctcaaacactccacaaaatttctacccgcatccaccgctccaattccccatccctttccagccgtatctcggaccaaatcaaaccatccagtccacattca

SEQ ID NO: 24568 - DNA, 1501 bp, Oryza sativa
ttttttttggcatcaaagtgaacaggccctaaaatggatgttagtgttacggaataatatatgttgggaattttttttttaccaattctaaatcggagtaaagatagaatttatctccttctaagacctctatataaagagggacgggataagacatatatggttaacttgtactcgagaccagaactataatgaagaaagagcttcaccatatatttatggtaattgtttatttctgcaatgttcttgaaagcaaccagaagggtgtgggtattctatatctttactactgtgggagggacaaggaatggatgttaggactagacatactcccatcttgttttttcctcgcttatctttcaatatcttctagtatatattttcattttaacatagttagtttggtagcaactatttttaactacatattctatagtaacgccgggggttgcatctagttatgcaagggcactcgttgaatcaatgattgatgattacttgttgttcatgaagatctcttatgcttcttgaaaaaaatctcaaagaaaaagggagcataatgttgccttctcaaaccgggaaaagaagaggcaatttccatacgtaaaacgtacgtgacacgaccgtcattagtcgttggggtcgtgctctcaaaccagcgacgtctgcagatgtaagtatattttgctacttgtggcgctcaaaatttgtgtaatttactaggaaacatcgtaaaaaccttaaaaaaactaataatttgcaaaagaactcaattggagagatatattcttaagaaagacaagaataccctcagaaccacatgctttaaacatgacgttagagtaaaattttagaaattatgcaactccaaattaatttgccaccaccccaaatacatcatattacatctccactctagtctcaacttaaaagcttttgactctagtggcattctcgtcttttttgaagaattttgctcttcaatttgagtcgaaagtgtcctctaacaaattactatttttatggtgttttcaaacatgatacgtttttatgatatctatcataaatgtaactaaacggagttgatcaacgctcacgaccacgctgatgttggaacagccgaacaggtaaataaaactagcctagtagtatagccttggaattgatcggtcgattgagatcgttgtgagaatgtagggagctttgctcccggccgttgattattcggccctttcaacttggtacattaattttctccggcccacaagttgttctcgctgtaaacttccatcatgcggcccatggctgcaggaaggccgtgcgtagaacgttgcgtatgaatgttacccctgcatgctgattgggataattaccgtttaccgtttaccaagttgctaaacttcaggaaattaatcaggatgacgaccctttgaaaaatttgatccattacctcgtgttgattagttgatatttcctgtaaatcattctcactagatgtcct

SEQ ID NO: 24569 - DNA, 1501 bp, Oryza sativa
cgcacatggtgtcaccggtgccaacaggctcaacacctcttgcttggcgtcgaggacccacacggcctcgccgtaggcgctaagctcggctgccacccatgcatgtacaatatcgtcccctgcctccaagaagaccaagaagagaagaggagggaggagagagagaaaaatagaaagaagaggaggatgcactgacatatgggtctcacactgaatcagccggtcaaactaagtcaatgagctacattagcaaaaaaaccgctctcaaaaccatcaagggggtcattttgcatcgattttaataattagaggagcgattgagagataagaattagattaaaactatatatatttgaggaagccaatgtgaacttatgccaaagtggaatatatttgattgggccgcatgcgtagcccaaaatgtgtggcatctgatgtgggttagccatgccggccccaagctgcagcaattgtagtagggagtacctatgcatctttcgaaagatttttataatcatatcacacagatttttaatccttggattaaaatccaatagacacagtaaaatgcaaaaaacaactaagaaacaccataatggacactatatttccatatcttcagaaaaaaaagaccaaatccaatataaatttcaaaacttatatgcgaagattcaaaaattacactgtaaattacaaaagttacagtgtaaatttcataaattacattgtaacttacaagaaaacacactgtaaatttgagtgagaaaatcgagtgagagataagaaaaaatctttcgagtgagagataagaaaaaatctttcgagtgagatatagcaaaatcgattgtagtaagcaagcgaagcaactgtggcatctcttcttatattcttagagcaaggctaatagtatagccaaatactagcttcaaattatctatagccaatttatacaattgttgcttactatactattaatacttagtctcacctgtcatacacacattatgtcttggagtccgcgctgcagctggctacaaatctgtagtccgctgctcttctttcttcgcttttatatctctttaaaatatgtttgtaactggcttatagcctgctattgtacatgttcttaagttagctcacagtaaattgtttccaaggaaacccattaaactacaatatttgatcttgatttcttaagttataattttatatattttttctaaataaggaacatgtgcaatatacttagaaaaagggatttataagattatttggcgaaacttattttctttatggtgctctctatcgatagtaaaacttcatccaaaccgttaatttattttctatatgaaaaggttagatacttttattatactaacacctccattaagtcgttaacggtagcagaaattatcaacggaaaaatcgttttaacaaataacggcatggaggggtaaaatcttttgtcgctctcgttcacaatcacaactcctggggcagc

SEQ ID NO: 24570 - DNA, 311 bp, Oryza sativa
tacaagtttaaggaccgcccgtacattttactcttatgaatattattggtcaaatgagcaaatcagagaccgtgcactctgccgagtatgtataacatttttttctcaaactgagcaacaaatagacctgatcacaatcatatcgtagcacacaatgagattgagagtgcatgccctctcgggatatcatcagctccatcctcggcattgggagacgactcagacggtcaaagattggtgggaattgttagccacttcggctggcatcctcaagaagggattgcgcaccctgatcctcatcgttgtttagg

SEQ ID NO: 24571 - DNA, 436 bp, Oryza sativa
tctctatttcatgttctgtttacaatgagtaaacaatatacatatttaggaatgtgctagcaaatcatgcattaggatatatttcctcaatatgcatcaatacaatatcctgctaagttatatacaaatctcctttggatacttaagcacatacaggagcacactataaagtgctccatccaaggtaaaatattagaatttgatcgaacttcggaaatagttacataatatattattttattatgtttatagtactatagtatgttaaaaggaagtgtcaaaattcttgcactggggaccagaaaaatcaaagctaacttcagaaaaatcaaagttaagaaagtgtttcgttataggatgaataaataagaaatttttggggaaaaagacgtgctcagatgcttgtttttctgatatactgcatttttatttaagg

SEQ ID NO: 24572 - DNA, 733 bp, Oryza sativa
aatctttggtggtgtggaataggcaaaatacgttgggtggcataatgttagatgaagtgattgatacacaggtggttgtagaggtaacgttgagtgatcaagtgcaggcttgctggagcaaaaagaagatgatgcctcactcagtcgttgacggcacaatctagctaacctgctgccattgtggtgattcatgcctcctctccgaagactctttgacttgtactaatggagtggactgctaccaaacacgcatgaatagacgaccagatcatcatacaattcatcaaaattagcactcctagtttcaaactacttaacaaaggaaattcaacaaacttcattaaaatagtgtagtgtatttttttctttaaaaaaaaattgccaacgccaatcgcggagtttcacatggaggagggaagaatggaatgagcgccaggcgtcgcgtcggcgcgcgcgtgagtgcgtgatttgtgttggttgtcttcctcttggcttcgcttcgctgctttgccgcgccttcgccgagggaggccgaccaacgcatcaatcaaacacacaagcacaccacgcggacgcagcagcaggggaggagacaatttcctattcttcctcgccccgcgtcgcctcgcctgagtctgactctccaaacgccgaccagtgacgccgcgagccttgccccttgcccgcgcagatctcaccaaaccctaccagatctgcgccccgccatggactc

SEQ ID NO: 24573 - DNA, 1501 bp, Oryza sativa
  unsure (1)..(1501): unsure at all n locations
ggggaggggcgtaggtgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatttatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcttcttattcaaaacctcaatcatcacatcccctctctcccacttcacacctcggaacgcactattcttatagagagaaaggggttttcccatcttcttaacccgaaatgaaatggctgaggagagggaggttccttttgagggtaccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagaaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcactttctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgcca

SEQ ID NO: 24574 - DNA, 1501 bp, Oryza sativa
aacccaaggcaaatttattatgaaaatatattcgatcattgatttgatgaaactaatttgatattgtactatatttttctataaacatagtcaaatttaaagtagtttgactttgactaaattcaaaacgacttatataagacggagggagtacattatagagaaaattatcattttgtatctaaatatttagctaattcgtttatatgtttgagttttgtcgaatcccttttatatgcagagcttctatgttgatttctacacctcctttcctttagttgatcatttttttcctaaaatgaccatattaccctaatttatgtattacataatgttgagtgttctaattaaaagaacaattttcattttttttatatagtgcctaaaatacatttgaaaatttcaaaatttttcacttgataagaaaaacaaaatttcaaatattaaataatttttgaaaaaaattgcatgaaatgacagtgacgaatactctcttcgttctaattcgtgtcaaaacgtttttgtcgttctgatcacacttgaaaacatttctagagatctatattccctactatccttcatcaatatatatatatatatatatatatatatatatatatatatatatatatatatatatatatatatatgtatatatatatatatatagaaagatgattaggaaataattaacgagggtagcaatgtaatttgccaactactaatttattgttagatttttttagaacgacatgtcaattaattaaaacagagagagtacatggctatgacaaaattgacaattttcaaactgaatattgttcattaaaaaatacatttcaaatttgatttgatgcagagtttcacaagtttttgaaatttcaatgaaattacttccatattatgtaattttgccctaacttttttaaacccaaaactacatattcggtaaattgtcaaacttttagtaataatatgccaagggaaatatggccatttctttaaaaaatataaaactaacaattaactaatgatcaactaatgaaatggatgtgtgagagatcttataaaagttcaggagcaagagattgcgtgaaatttcaatggcatgttgttaattgatcatatacaatattctagatagcttaattagtagtttgacaatacatggatactttaactagggaacatatcatgtacacacaagtctcttctcgtatacacaccgtatactctaattaacaaatttcacccgaaaaaatctaaaataaaattatacaagtacttccaataatatggcacatatgtgtaaagtcttaacctcaaattcattatattttagccataacaaacatgataaaaattatgatagttttgagagtatataattttgtttttttgtctctgtataatatgaatttgaatatgagactttacgcatggatgtaattcccctttaactatggctctcttggatttaattgctcgtgcatatgttttc

SEQ ID NO: 24575 - DNA, 1501 bp, Oryza sativa
aatttttctttgagtttttttacggtccagctgtaccgtgcggtaccaaatgctagccgttggatctggtcagatccaacagctggtattgcgtggtaccacgaggtatcaaaattgtccctgagacagcaccgcagagagaagagagttagaagggtaaaagagtaactttgcgtgcgatggatggttctggagggatggatcgggaagagttgatggttagctagctcgaaccctagaattttggttgcaccagcgctggttgcttttcgccgccgctgtgttcgttttcctctaccgccgccgccgccgctgccgtgttcctcttcctctgccgctgccgtcgtgttcctcttccgctgctgccgccgtcgccgttttcctctgccaccgccgccatgtcccacttacgccgctaccgttttcctctgccgccgttgccatgttcttcctctagcgccgagacttcgatctaaacggcggaggcggagtccatgccggacagggcgcacgcgtcgggggatgaaggattgggggcgcaccacgcacgcgcggctgtggaacgataccgagcacatttttctctcccgatcctacccatgccggaatgaacggctcgatgcgtaccggtaccgagcggtactatgtgctggactataaagacgctccttttcttttcattaaaaaaattaattagttggctatttttgtttgggtttagatcattatattggcatagagttttaagttgattttttgatttttatggtttaatagaaaagatacccgtgcattgcaacgggtgaattaatgctatttcaatcttattattgctatacggtttagctattgtgaaattcattatgggaattcgcttggatattttttttaataatcatgagctgcaattatgagtccgattttcaactcaaattagttatgcaagtttttttaaaaaagatttcttatacaactcctttcgtatttccaaaagcaaatgaatttaaaatctgattcaaacacggatatgtatttccaaaagcgaacaaacttaaaaccgcaaacaagaatgacgtactaaaatactagtaaaaacatattttatttttataatagtagagataagcgggtgtcctcaagtttaaacataaagtctcaactctaatccacaaaagctttaaaaaattacttaaacctagtctttaacttgatagcacaagagtagtttatgatttaaaaaataaaaggcaaataaaaaattgttaaatatgtgatccgaattttaggcccacgatatattcggattgagatcacctatacatttgtcaacaaattttcttctaaaaatttgacagatgtaattatagtacaatcgtagtttaattacattgtaacctacatgtaaatactgtgtaacttgtatgtaagtttcacataattttgaatcgttagatctattacaagatttgttctggtgaggaagataaaaaatcacagcaca

SEQ ID NO: 24576 - DNA, 1501 bp, Oryza sativa
aatgaccgtaaaattgttcataaaaataacatacactacacttatactacacttagtagaaatgaattttatagacatataagataccatagagtttctatatatcaatccctacacgttcattttttcagttgatcggtacttagttactatgaggtacaaaaaattagtataaaatttggtatctcatagtacctcctcaatgactgtaaaattgcttataaaaataacatacactacacttatactatacacttatactacacttagtagaaatgaattttatagacatataagataccatagagtttctatatatcaatccctacacgttcattttttcagttgatcattatttttttcctaaaataatcatattgccctaatttatgtattacaggacgaaaaccgctctaagtaaaaaacaattttcagtttttgaaaaaagatatgaatggctaaaatacaattaaaaattttcaaattgtgcactttataagaaaaacaagaaattaaatattaaacaagttttaaaaaaaatcatgaagtgataataatgacagaattaggtgaataccagcttaaatttacgtcaaaatatatacttcttgttctcatattccaaagcattcttagagatgcgtatccttcttacccttcatcaatacgttcgtactaatactagtacttctcattgccggaaatcctaatcaaaactattagatagttcccatccacactataatcataatcataatcataatcataatcataatatatagacactaaatataaaaactatataccgagtgggtggaaaataaattctcatccagtcacgtcttttctatctcctttcgatcatctccatatcctcttgtcttcgttcttaatttctacgtagagctggtttcttccttgagcaacgtgtttttcattttttttttatcttcattaactctcttgtcaagttatttttttcttacatgatagcatttttaattccatagaaacttgctgagatggaaggtggagctgggactgtccataaaaatattttctccttgctttggaaaagatgatcaagatgtactaattaatggatagcaatgtaatttagcacacctcctagtttagtatgagatttgctggaatgataggtaaattgaaaccgagacagtacatggttatgagaaaatcgacaattttcaaactgcatattcattcacaaaattacatttcaaattcgatgcaaagtttcataaactcattttgagtaaaatacatggccggtccttaaagttgagcgcgggtgtcacttaggtcaataatcttgtaaattgcaaatctagatccaccatcttgtttaagtgactcgttgaggtccaaaccccacttgaccaactctgaccgtcgacgtggcacgccacgcaagcatcaattttgcaaacaaacccctccgcaacagtagcgccatggacagcacaaatatccccaaatc

SEQ ID NO: 24577 - DNA, 1501 bp, Oryza sativa
caatccgcttccactcgggaagcctagtctatgatgcccgcagacatcctgaatcacacagatccgtttctgaccactcaggtcatccatctgccacataggctgattctagttacgatttccaaaccacaacaacttttcgcaaagcacaggcaatcaaatctacgcaaagggaaccacctcacatccgcccatgaccgtgggcacggctgttcgaacagttagttaacctctgcagaggggtacactttaccctcaagacatagacttactccaaacactggccggtgtcagaggtttgcgacaaagcctttcccaagccgacccagggttacctcataccacatagaaggatcaaatcctcacataaaaataggccattttaggcattcacaaatcaactccaaccaccttgatcggtaagagagcaagcttctcgtccttgccttaccaggaacccggtttgtcctgaccccgccccggcattcccaactattggcatgcgacgtttccctgaaccgactagttacttagccagggtgtcccattccaccttgtggttacactttgattatgttcgatgagtttcccataggaatcggtccttatatgtgaatacgggacagtgccacataggtacaacccccgcatcgcgagttttcacaattcattttattttcaaacacaccgacaccatatgtcgggttttcaaggcttcacaaacccatttcccaagttttcgacaaacaacggtgtatgtgggatatttggtatacgcgctcagagagcacgaataccgaggtaccacaagggcggagcgacaaggaatcagggtagtacgacctacaggaattagtgcgactactgggtaggtccgtcggtttggcacgcaaaccgaggccaagcaagttgagtgtgtgattctaataatgcaagttgcaaacaaaataataatgatttttcaattataggagcaattggtcaaagggtgacttgccttgctcgaggtcttcacgaagcttcacgaatcttcaagaaaacccgcgatcgacgaaaatccggtaaccgcaactatacgcaaacaattaaaaacctacacaagacccaaaataaagatcctatttagactagataatagtaccattagatagatctcaattttacggaattattgaaagttgaacggagtcaatcggatgagcggttgagaagatatggatttctaaggattaaggaatttctatctaaaggaaaaaggatttaataatttattaaaacctttttggaaagaaattgaaggagggatatgatttagacttcctcgggcggcttgggtgcggcccaagaggagaggcacggctcggccgaactaatgggccggctggcccggagaggcgtcccaatggggcgcggggagagtgagggagagagagggccggtgggccgagtccaccttgcggtgtcccgagtggggcctgcttgtcggtggcgcggctcaccg

SEQ ID NO: 24578 - DNA, 1501 bp, Oryza sativa
  unsure (1)..(1501): unsure at all n locations
taatattgaatgtatactttgtttagaggatacaatttgtgaaatgcacgtggtgagtacagcaaatagagacagcagcgatcccagtctattcagttgcaggtctgtcactgttgcaacacctacaccaaacaaaagaactgccagtgccatttggattctccggctgcatgaagtgaaaatattgttatagtctattcaatttatgatagtactacaagttattgttttatgggagtatgacattaggattgcaagacccacaggtattgaggaattcaaatattcaagtaccatgcttgtattcacaaggataccaacaatcatcatatatttagtagttaatggtttttttcagcgtgaattgacaaggcaaattttttttttttacataagacaaggcaaaatttggacagacctgaatgttttcctgaacaatatagtctccaaagatacagtgcatggaattattgccagcttggttacctgatgcatttgatagagtgagatagcttagacaaagcagtagactaattacacaagcacagttaggtctgtagacaaagaacatgaattggctgaaactagagactgttgaattgtgtcattccatccccaataaaatcagggcaacatattgtgtgcatgttgattttcagattgggcatgaatcaaggtcaactactaaatttccagcaagaatttaagttttaaagtttccaacaggtgtcgtttgctgaagatgaatatgttcatctcaaaataggaaaaataaacaaatgcaagattggcctgatttctgaagagtaaaccaacctgataaaagccaatagagttgaatccaaggctcagattaagcaacccaatagatatgccatttagtattccaaatccaatgattgtcttggggtctaaatctttgttctcgaaaagcttcatctgaagagccacatgaagggaacaaaatgtcaccaggagatgccagcttgtcagcgtagtagctgaaagaaattaggagagtgctgtgatttttgcatggttatatagcttaggaaacagttagttttctcaggtggtattgttcgtcatattgtactcataaagtagtatagaatttgtgtgccttattaatgaaccgtgtccatcaggcaacttgtgtttcctgaattttcgaaggatgtcatttttgttcaacaaatacatgaataggatagcagtaacgttgtgcaatttccaattgtcccatggagccatgaatttgactcacatatgcagcagagcagagatgttcagaaaatggtcatcaagtctgcactgaggcaattcaaagaacacctagagtgcatacttatctagtcatttgcgttgctctaagctcgtattgccgcagtccaatgtatgcggacagagtgctagatgctagcattaaatagaacaatagtattaggccttccttggaatggaggaatntaaaggattnttttgcgggaattgaataaga

SEQ ID NO: 24579 - DNA, 1501 bp, Oryza sativa
gcatgaacaaatttctagctgtaagggtgtacacactagtactatatatgctccagggattatatttatccaaatgaatcagagatgggagagatgtgtgttcaaataacaagctttagatcgaaccttgtttgatctttgtcgtattttagaattcatttagtgtttttttcaccgtattttttttcaacctcagtttttggactgttatatactgaatttatttccattcttttgattttgtgtcccaatttatacgctcctagctatcaatgaaaatgtcttctaactgattcggcaattatattcattctatatcaatatgtacatatatataacaaaatattctcctacaaaactgcagagagattgaattatactccgagttacctgcagataccaagaaaccatgctggcgaagtagacgaaacctaagggattcaaggtggagcaagtcagcagcagcaacgctgtcggcgtgctccttatggtgcaataataatacatgctgtaacgctacggtgatctcgtcgcggaagtggtcgtctatgtggaggcgttcgagcacgtccactagcatcaccgtgtaggccatactcgtggccttcgacagcttgcagcgcacctgcctctttagctgatccacatgttccctcatccacttctctgacatctgaaaacatatgcacgagcaattaaatccaagagagccatagttaaaggggaattacatccatgcgtaaagtctcatattcaaattcatattatacagagacaaaaaaacaaaattatatactctcaaaactatcataatttttatcatgtttgttatggctaaaatataatgaatttgaggttaagactttacacatatgtgccatattattggaagtacttgtataattttattttagattttttcgggtgaaatttgttaattagagtatacggtgtgtatacgagaagagacttgtgtgtacatgatatgttccctagttaaagtatccatgtattgtcaaactactaattaagctatctagaatattgtatatgatcaattaacaacatgccattgaaatttcacgcaatctcttgctcctgaacttttataagatctctcacacatccatttcattagttgatcattagttaattgttagttttatattttttaaagaaatggccatatttcccttggcatattattactaaaagtttgacaatttaccgaatatgtagttttgggtttaaaaaagttagggcaaaattacataatatggaagtaatttcattgaaatttcaaaaacttgtgaaactctgcatcaaatcaaatttgaaatgtattttttaatgaacaatattcagtttgaaaattgtcaattttgtcatagccatgtactctctctgttttaattaattgacatgtcgttctaaaaaaatctaacaataaattagtagttggcaaattacattgctaccctcgttaattatttcctaatca

SEQ ID NO: 24580 - DNA, 984 bp, Oryza sativa
tcctgcagcccttcaaaaaaaaaatttctttgatatgaagtttgttttgtattgcaaaatgtggcttgactatccaggctaagtgtataactattctgttcacgtatgctgataaaacaccaggtagactgttcaactgattggtctcacaccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtg

SEQ ID NO: 24581 - DNA, 351 bp, Oryza sativa
agcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgccgccgccgccgtcgcctcctccatccgccgccatggtaaggccttgcttccctatgcttaacgcctagattgctttgcgggattcagcgctgaactgacctctcttcttgctgcatcggcgc

SEQ ID NO: 24582 - DNA, 1501 bp, Oryza sativa
caacctccaccgcaccattgttgccaccccgccctgcagtcgccctcgctgtccgtcaccgaagcaccagggagaccggtgcgtgcgtggacgcgtgacgcgggactccaggcaccctctccttccccttccccggcccgaggccggagagctcgccccgcaccgccgccgcccatcactgcgcccggctcggtagtgcctccctccgttctccttcctcgttctccctcgccctctctagcttgcatgatagctcggttagcccctcgaacgcgcgtacacgccgccccgacctccgccgctgctcggcatggccttgccgccgtcggcgcccgctcccggaggccgcctctcgtcgccggacctccacagcgcctccccaccccatccaatcccacaaacgaaacccttgagccccggagatgctcccgccgcctttaattgagtcctcgtcgcccctcggtgatttcccctttctctcgccgccggccgccgctgtcgaattccaccgccgtcgaactccctccggtgaatccgagccgttggctcgctccttctcgacgccctcgtcactccggtgtgctccccgaagaccaaatccgtcgtgcttgctccggtgaacaaggccgccgtccgcagtccatctcggcctccccttcttcctcctcctgccggcctgcgtggctgccacgtaggcgccacgtcggcgccacctcggctttgaccaagccgagccggtcagccacctcctccctccccccctccgcgcgcggtccacggtgcgccaaccggccgcgcgtgggcccgccgcatccctagtccatccggtgcacgcgcgtgaaccgcgctcacccgaaaccctagcgccgccctcatgcgccgctcccacggtgagccgcgccaccgacaagcaggccccactcgggacaccgcaaggtggactcggcccaccggccctctctctccctcactctccccgcgccccattgggacgcctctccgggccagccggcccattagttcggccgagccgtgcctctcctcttgggccgcacccaagccgcccgaggaagtctaaatcatatccctccttcaatttctttccaaaaaggttttaataaattattaaatcctttttcctttagatagaaattccttaatccttagaaatccatatcttctcaaccgctcatccgattgactccgttcaactttcaataattccgtaaaattgagatctatctaatggtactattatctagtctaaataggatctttattttgggtcttgtgtaggtttttaattgtttgcgtatagttgcggttaccggattttcgtcgatcgcgggttttcttgaagattcgtgaagcttcgtgaagacctcgagcaaggcaagtcaccctttgaccaattgctcctataattgaaaaatcattattattttgtttgcaacttgcattattagaatcacacactcaacttgcttggcctcggtttgcg

SEQ ID NO: 24583 - DNA, 235 bp, Oryza sativa
gatattatttagtaccactataaatctggatatgacatattcgtattactagatatatcatggatcctgtttagatttgtagtatcacatcttgtcttaggtgactgtaatttgggacggaggaagtatcacaattttcgaatgactattattggccgtacactcgtacttatttatcacctgaaatgatcgttctacgtcctatgctcaactcggttgcttttctctacacagt

SEQ ID NO: 24584 - DNA, 1501 bp, Oryza sativa
ccgtaaaattgagatctatctaatggtactattatctagtctaaataggatctttattttgggtcttgtgtaggtttttaattgtttgcgtatagttgcggttaccggattttcgtcgatcgcgggttttcttgaagattcgtgaagcttcgtgaagacctcgagcaaggcaagtcaccctttgaccaattgctcctataattgaaaaatcattattattttgtttgcaacttgcattattagaatcacacactcaacttgcttggcctcggtttgcgtgccaaaccgacggacctacccagtagtcgcactaattcctgtaggtcgtactaccctgattccttgtcgctccgcccttgtggtacctcggtattcgtgctctctgagcgcgtataccaaatatcccacatacaccgttgtttgtcgaaaacttgggaaatgggtttgtgaagccttgaaaacccgacatatggtgtcggtgtgtttgaaaataaaatgaattgtgaaaactcgcgatgcgggggttgtacctatgtggcactgtcccgtattcacatataaggaccgattcctatgggaaactcatcgaacataatcaaagtgtaaccacaaggtggaatgggacaccctggctaagtaactagtcggttcagggaaacgtcgcatgccaatagttgggaatgccggggcggggtcaggacaaaccgggttcctggtaaggcaaggacgagaagcttgctctcttaccgatcaaggtggttggagttgatttgtgaatgcctaaaatggcctatttttatgtgaggatttgatccttctatgtggtatgaggtaaccctgggtcggcttgggaaaggctttgtcgcaaacctctgacaccggccagtgtttggagtaagtctatgtcttgagggtaaagtgtacccctctgcagaggttaactaactgttcgaacagccgtgcccacggtcatgggcggatgtgaggtggttccctttgcgtagatttgattgcctgtgctttgcgaaaagttgttgtggtttggaaatcgtaactagaatcagcctatgtggcagatggatgacctgagtggtcagaaacggatctgtgtgattcaggatgtctgcgggcatcatagactaggcttcccgagtggaagcggattgctttgctgctaggcagctggactctaggagtccgagaaaatgaaaaaggctctgggagccgcttaatcaagtgaaatggctctgggagccgagaagcaatgatctgacccgggaggtcggtacattaccaattgagttgttgaaaagcatctcttaagtcgaatcgagacgcaagtctcttttcgacccaaacctaaaaagaaataaatcacttagtggtttcaaaatggatttcaacaaaagatttacaaaacaacctcgcctctcttccaagcttgcattaaacacctaagttcccgtgacttgccgagtacgaaagtactcacccttgctct

SEQ ID NO: 24585 - DNA, 324 bp, Oryza sativa
caccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaaagacagctgaaacgtgtggatggaatggggcttcctgggggtgtttatatagcggaggaagcttagcttggatttactaaggttgttgag

SEQ ID NO: 24586 - DNA, 849 bp, Oryza sativa
ggagctggcgattgatctcggcggttcgaccggtgttacaacctcggtcagaccgacgatatccaggcggtcagaccggcgctactacttcggtcagaccgcgatccatcgatttcgaggataacttttattttcgctaaattttttttgtttttgggtataccaaccattcactcctctctggttggtttagttcttgtgatttaatcttacatatagtgagttctcgcttgctgtttttgcttctcttccttttgctggagcttattggtttcttagccagcgtttctagtttctctttcttttcctgttcccgaatcccgggcgatggttgtccggctgccgtgtcgtgtaaaaacttgcttttgcttattctaatagaatgacgtgtaattccttgtcacattcataaaaaaaatgaattaatcatcgcttcaccgtcaaaagttgtatggttaatcctaccgaattgtcaaatcgagcatggcatacgttaaaaagctcaaacagcaagtgcatcttgcagactacaccatcacagagtccagaattatcagaacgatcaaacgtctggtaaaaatgcatcccccaaaaaaccctcctcctatttcagtcaaattctgaccacacacacggccatctgctaccagctcgcgttcttaactcctcccctaaatgcactcaacaaccttagtaaatccaagctaagcttcctccgctatataaacacccccaggaagccccattccatccacacgtttcagctgtctttcagtgttcacgtaggttgtagagagcacaacaacgtacgtacacagcagcaaagactgagactagctagcttagctg

SEQ ID NO: 24587 - DNA, 1501 bp, Oryza sativa
cgcgcggtgcgcacgctctctacggactactcgcgctgctcggcgcgtcggtggtggtgtggtccgtcgccggcaagccgcccgccgcccacgccgggcacgcactcgccggcttcctgctttggctgctggggatgatagcactgctgctgtccccgtacgccgcgcagccattgttcccggttgcaactactgccaatctcgccgtggagaaactgaagcatcgcttctccaacccccggacgccggcgcaggcgcaggcgccggctttggcttaaaaacccaccgacatgtacgcgacgcaacgcaagcggcaaagccggtcctacgccgaccaagccgcgccgtcgtttactactactactactactcgtacatagcaagtgaagtggtttgagactttgaatctgctcgtctgtgtgtgtgtgaataaaataagttcagtttggcgataattcgactgcaagtgcaagcagttggtttgatttactgatccagttctagcattcgcagctgatcacgcgttgtaaatataaagctttgttctttccttcattttcagtatacaagtttctgaagctactgtaacttccaaaaaaaaaactaaaaataacgaaaaaggctggacgatactagtactactcgttattactactaataatttactgtactactactagtagccaaacaaaggggacacattcaatttacatgcttctcatttaggagatttggtgcgaaaagaatagacatattttcagaagcaacgaactttcaatatcacaactagtgacaaaaaaataaaataaattgtatgtggggcgaaagatataacgagaatagcgccttaccatgtcctctgatgtagtttgttttccttctcttttttggttttttctcttcacccttggtgattgtgtacggtttactcccctacctaggctgcaatccatattgtagttcgtttatttatgttcctaaccttcactctcttgttttcacgtgtacaccttctaaccgtaaatgatgtgttttttaaaacgttctatggaaaaagttgctttaaaaatcatataaatttattgttttaaaattttaaactaatacttaattaattatgtgctaactcaccattacgttttcagaattagtttcgaacacaatcttaatattaaaccagtagcgtctgtcattaaaattactagtagctcggtttgagaaaccagaccattgattaagggcatgtttggagaatttaagattttgagaatatgaaaattttaggtttgtcagcttgtgtcttttaattcattttctgattctaggcctaaaacggtttgaatccaaaaagcccaaacccgcgaagaaatatcccaacccccttcgtcctcccctccttatccgccaccaccaaacccaaaaccccacctccacatctcatccttcccatccatggcgccaccgcgctaaaccccccaccacactccatccatggcgctct

SEQ ID NO: 24588 - DNA, 1501 bp, Oryza sativa
aggctcattggctgccggaaattctagccttgtggatgtgattagagggggtttcacggcgagatggaaagttggggtaggttggtgtagtgattgtaaggcttctggagggcattgtgggtttaatggcagttttcctgatcagtatacatgttactgtcctgatggtcaggctatcggatcatgttcttcatcaggtaccgtttgtatcttctaacaaacttgagggcaagtcaaggttggtgataaggttgtttttttagttaatttgtttcgattaggacaactatgtttgactcaagatgtctgtttctgctatgtttgggtcctatagtttaatctggtgacctcatcttagacaagtttaggatagtgagtggcgattttcgtttctttctttgattaatgtgccaattttttggtgatgttctagttttgacggggccttgatcaacctttgatttgcgtgcatttgacatggctcaaatgacaagtattcgcttacgttctgcaagtctacaaaattcagacttacttgaattaatctcttcacttaaatttatagaattttctcttgttgatgccgactgttaacctataagcattatcaaaattgacaactaggggattaggtagtatgaactgaattagttattttttgaccaaaacgtttaaataattaagctcgtgttgaatggcaaaccaagtagaccattttcttgtattccttgttttctcaccccataagatgaagatgtcttaaaagaaggaagaagatgaaaaataggaccggtatcatgatgcacttttagtgtgatattgtgtcttttttttcctaaaggagcatgcatgcattctatttttttatgacctgcaaaaacattttttttgtcaaataattagctaatgttgtcgcttgctgattgtttcgttgataaaattgtttcatgattttgcaggatcaaagatatcgaagaaaaaggctattgcaataggtaaatatatgaaaactctgcctcctatatatttttccggaaatctgaatctagcaacggaaaatattaatgacaggaacccattacgagtgtaattagtcaactaattgcacatattgcgagtacaaaattgtaagcaaaaaaactctcatgagtaggattgccactaacatacagtacattcttttccctatgaataaatggagaaactattttaatccctcgagggaatatcccttgttatttgcatgtcacctaaatggttatgaaaaaatttgatgaaggttttgcacaaaaatagagagtatataccagaaccacgcattttcaattgaaaaaggaatagagtaattgaaatttctttatccttggtaatatgacattgtcttaaaatgttactgtaggtgtatcagtcgtttcaggtgtaattttattgttcctgcttctcatgtgcaccttgtgtgttaagaagttctggcatggtctattgtcctcgatgggaaaat

SEQ ID NO: 24589 - DNA, 1041 bp, Oryza sativa
  unsure (1)..(1041): unsure at all n locations
tcgtataacctcgcgctgagagcgaagcggaatcgaaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactannattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgata

SEQ ID NO: 24590 - DNA, 1501 bp, Oryza sativa
cctgccacgtccggctgcgtggcgacgaaagacggcgccgtgtctcgccgccccgggaagtcgaaggtgctgcagttgatcgggcggatgtacggcggcggccgcagcacgacgttggccgtggagttgcagtcgaagaagaaggtgatgctgtcgttgccggggctcgggaacgtgagcacctccgggagggtgacgttgtgcttcaccctcgggcagtcgccgccgtcgagcgcgtcggagtcggccaccgtgacggtgtggttgccgtggttgatctccaggacggtgtagttgtaattcccgagtcgcaggatggcgcggtcgtggtcgcagatgatgcccagccacgggtagccgcagtagcgggtgttcccgtcgacgacgacgacctgatccgtggtgttggagaggtagaaagggtacttgatctccacctgctcgccgcaaaagatcggcctcgcgcatatggcgtcgtcgtacgttccgccgccggcagtggccgcgccaccgctaacgacgacgacgacgacggagagtacgaggaggtggaagagtagtggcggcatggcgacgactgcgcacggtgcgagcttacaccggctgcttaaatttttttgtgacatcgtgttggcgaactactagcttggtcctatactaaaacggacttcttgagctgcacgacagcacgagcacgagtttgacctgagggggttggtgtgcgtaggtattgggggtacgtggcgtgttgggattggttggggtaggggcagttggggttcgctgcctgcttcctcgatccggttgctggtggcacgccaccggaacgacgacctcgtgggagtcgtgcgtctgcgtccggtcgggtggggactcggccaggctgcatggacgcatgctgctgctactgtcgttttctttctttctttctttctttctttttttgaacggaagcagtgctactgtcgttttcgtggcaaataaacatgctgcttctcgtttcagattctttctcattgtcttttttgtgattttcgattgctcctaacgcgatggaaaggaagcatccgcacatccggtccgcgtcaaatgtgaaatataatgctctttacaaacaaacaacccaggtataagaaagtgatgagcacttaattaagcagtcgtcttttgaatggcagatgctctttatttggtctgctcccatgaacttattagctgccgtaccaactgcttccagaacggattgatcctgcaatttcatactactccactatgacataatacctccgtcccataaaaactcaacatatcccaaaagagacatatccatatcggaaagtgttttctacaccttcgttttctacggatgaagctgctgattttttaacacacatttaatcatttatcttatttaaaaaattacgtaattatcatttattatgttgtaagttgttttattattaaaaaatactttaagcatttattatcatttaaattttat

SEQ ID NO: 24591 - DNA, 198 bp, Oryza sativa
tccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaa

SEQ ID NO: 24592 - DNA, 265 bp, Oryza sativa
cctcaatcaacaaatcaaaatccacccagtatcattttcttcaagttggatatccactctatcacgtattgtttaacagcaacaaaatctgaatttgaaaccacagaggcaaaaactcaaactacctgtcatcaccgccacccgtgcggtgctctcccccacgattaatgaagaagtacaggaagctaagtccaagaaaagctgtaaaaataagccttctaggacacttgacctcacggcttcgttgccttgacaaaggagggca

SEQ ID NO: 24593 - DNA, 1501 bp, Oryza sativa
tatcgatgtcgaaaacaacataagaaagaacatgaactaaatttaccaacgatcaacaactaggtggtaattgacatgaatatcatcatatgctcttgcaatcttttatcaggtttattgaataataatttgttaataccgtgtcacagtacaataagccaacttttatcaggtttattgaataagccacgattttttttatagccgagtggaaatttctcgaatcacgtgagatagtgtttcctccttccggagtgcggtttacgctttgatgaactgaatggcaatttaggagctaatctttgctacttactccaagaatgtccaagaatagctctagcagtcaacgatatacccaagaatgtccttccataagacttaaaaatttattgatacggttgcatttgactaactggtcttgaaatcttttgtatttgtccacttgcagatttgatttacaagtatactagtgggctcagcactcaagttcagccgtctcataactaaaaaatgtcagcttcttctttgttgtcttgtacaatttgacgctagagtctcaagatatcgtactaaatctgccattacgaaacactaggcgcatttgaaaagtgtaacacttgtctgggtcatatatgtagattaggagtaccatccatttcaaactgacggacagaaggagaaaacaatactgtgaaactgtccaaatgtcaccttgtcctaatcagcagtactccctccgtccaaaaagactcaattcttgggttttcatatccaacatttgaccgtccgtcttatatgatttttttataattagtatttttattattgttagatgataaaacataaataatactttatgtatgacttatctttttaatttttttataatttttttaaataagacggacggtcaaatgttagacacggaaacccaggaattaaggttttttgaatggagggagtacaaagtatactagactttctacttcagtttacttgagctgcccgtatgcaacaaccttgcttctctttgctttgaccccacaactaaacatcaaccaaaaggtagatacaccagctctgtcagtacaaagcctgaatctgggagtgctagataatagacacggtgattctaattaagtactatacagagattgccttgttttggtaagtagaatgttacaatctggtcgtgcaactactgttaccatccaacaagacagcaacattatttccctttttcttgcttagaatctacttagcctcagccgtatacaatcaaacataccaacaatgacagctaggaaatgaaagtgggcaactactccaagcagaatttttccacaaaaaatgtatagtttctttactcgttcatcttagacttttaggggccgttgtgagatatggatttttttttcatatttctaaaaaaatacttggaagattcatatgaaacggtatcgaggatactccctctgtattagaaaaagctactccctca

SEQ ID NO: 24594 - DNA, 416 bp, Oryza sativa
cgcctccggcaccgtaatctcgtcaagctcgtcggtaagctctactacttttctgaacattcaaatcttagctcgatattgtttatgtttttgttcgatgcatgatagtatctttttgtgatttagtgattaagaatagctgagtaggacattgatgccgccctgatgaactgctaatttcgtgatgaaatatttcctcaagaacatcaccttaataaatgccaacccaaatcgccagattatcttttgatttgatttgatttgaaatattttcgcttttattgaaatggatgctccgataagtttagactttgtactttgtacttgttattagaccgcgtagatgttgtctactcgtgccaatttttaactgttacattctcagcaacaatttccttcgtacggttgcgtgaaaa

SEQ ID NO: 24595 - DNA, 353 bp, Oryza sativa
attcctgcagcccgtttgactcgacgggatagatagatatcagtagatattagagcagttacaatagcagctataaaccggctataaccacatatcgagaaaaaaaagtgaagagagagaataaagcgggctacatatttatagccagttacaacacagactccgaaacgttatgtgtgtatgagaggtgggaccgggtataaatagtgtagtacattttatagtaaactattatatgaatagtctattagattagctatagatgatttggagccagtagttgactatattattaaacttgctattaggaacagtggttctaaatttccaactctccttcggtcattttcagt

SEQ ID NO: 24596 - DNA, 1501 bp, Oryza sativa
ctatgtgcatgcatgaattcgtacggagcccaggcgtaatctcacagttatatatgttaacccaggtggatttcaattgaaagttgcttcaattcaaaagttcaaaacgtgactggaagttattctcgttcagttttaagtttgagctgtcaaacttttagttgcacattgtacacgaatttagggctagttacaagtgtattttgttccattccaaaattacgatttacaaacaagacaaattttgctactggacattaaaaaattgcataatttgctcatagacatcgaaaaaggtgtcatggctaaaagactttaaaaaactgataatttgttagagtacactttcggctcaattgtattgataaattcttaatgatgataagaatgtccctaaagaccacatgctttaaacatgatgttagagtaaaaatttagaaaccacgaaactctaaatttgccatcaccctaagtacatcactagcatacattatattcaatcttagctccagtctcagctcgaagcttttgaccttaggggcattcttgtctttttgaagaattcctctctccaattgagctaaaagtgtccccagcaaattactttttttaaagtgtctttcagccgtgacacgtttttatgatatttaccagtaaattgcacaaattttaagtgttatgtagtaaaatttgcctacaaacaatatatgcttaattttcaagttgggccggaagcgaaagtcattggtgtgtgactgatatacatggtgatgtgtataaatatactcttttgccataaaataaaccaatctaatactagatatgataaatctacaagcgaattataatttgtgccatcttttcatacctactggagtaagttttagtttggaccatatttatctaatatcttcgttttggactatataaatttattttatctttgttaccctttgaactaccctaacgtttttatctagccacatccaatctcttctctaacaaagatgttaactgcacgtcaacagaggatatcatcggtatgatggtgccaatgtgcttgatgctaatgctgtgcttgtgaagatactttgggtggtcaaaacacaaaaatggaaaaaaaaacctaatccaaaataaaaaagattggagaaaaatagataaaggatgatccaatctaaaacttgaggacaaaaacaacaaaaacacaaattcactctaagataatgagaggggctaaagtttaatccctctcgttaccaagcaccacctaaatctttcgtggcatcaagaaaagaattaagagagtgggggcccacaaggccacggtgtccactcgctgttccacctctcatctcattggctacaaatacaagcagcccacagaggcagagagaggagcgcacacagacaagcggaggcgaaaagtggcgcattattttatccgagcgagcgagtcagacgcgcacgcggagcagccgcctccgccgccgccgacgac

SEQ ID NO: 24597 - DNA, 1501 bp, Oryza sativa
gttaaaaaaatttcagtggctggggtataccgtttgatatgattgattgttccaggatatactttgtaacgattgtgaaagaaaaggaaggtctcggttccattggctgtatcacaaatgcggcttctgcggttcatataacactagagttatcaagattgatagagctgattgttcaacatcagattaaccaggcgagattttccctctcatattcgaaattccttttgaatatatatattgttgtaaatatacatcaacttaaagaaatccatgcgtcatgcgtgctcttgtgtgttgctgcgattaacaagtcataggagatgctaatggtgggcgcttatgaaattgtgtcacagtctaaggtgcgcacaatctctagtttaatattcggggatgtttggtaaattggtagagctttcagcttccggggccaaattctttagagaatcaagagaagcccaaccaaatgggcacaaagggtgttagttcccaggggattggtggcatgtggggcaacaaaattgttggtacccaaatatggaagtgaccactgaggctcctttgaaatgcagggatggtaaaacatgaatagaaaaaaatagactgcaacaaatgaaaagtacatgaatgattatttggctagagcttgaaaaggaatgggataagagagatggatgcaaaggaaattttgtaagagatttaacttgtgctaactctcctctaaaatctctatgggcctcatcgtttggcatattcatatgcttatcagccaaaatttgaattttcaacgttaaatttagagctgattttagggttttttcatcgaagtttatttttcagcctttgcttttagatcgctaagaacacatatataaaagttttattcacaaattgattttcgtttgtaaatatgccatttggcatattcagaaaatatgccaaccgatgcggctgtatgcatctttgttatcaattctaaagaaatttcatgggtgtcaactgtcaatcctttgttccagagtaaaaaaaaacaacaacaaatcatttagaattcaatcgctgcataaacatgaacagctgggatagattccttgtgcgcaaaccttcccacttggttaaaactaaagtcgcgtacggcaacgagccgatccgcatcggcccagccggtcttggaccccccaccgccgtggcacgggcaatcagcacgcgatcaccgattggatgcattggcatcagccgccactggatcgcgttagcgcgcggtgggcacccactgcccagcccatcatgcatcatcgcatctggccgccaggcacggccgcacggtacgtacaggccgcctttgtcatcttcacgtgtaagcgtcgcgtcgcgtggcgcctagcctggcgcctcagtgatcgccccctcacggcctcactcggtcactcccggtcaacccccacggcaatctcatccctcgcctttgtcaccgcacgcaacgcacacggcaaaaatg

SEQ ID NO: 24598 - DNA, 265 bp, Oryza sativa
aagctcgttttgccgtgttggtattgtcgtgttgctgttttatttatgagtttagtagtggagcgtagcaacttggaataaacagtagatggattgattcgtctacagcaaccatggacttttctttttggactagctttcacggtcctgtgttgtgttgtttacttttgtggtgacccatgaatcgctatcaaatcgtaagactttctcctgtttagttatgctgtttgactggtggctggatcggatgaattcatgataattt

SEQ ID NO: 24599 - DNA, 1501 bp, Oryza sativa
atatcaatgtgtcaaaatttgacgatgttgtacccaacagctgcgccttataggctgaggtggctgtgtattcgccgtggttgttgagcttccaggtgatctggtcttcatgttccgtgaagtgtacattccgaacggcgctccaaatagtgatgagctcgtcaatcagatccgttgtccatccttcgtttgttggtagagcaaggtcgtgcagccattggtatgctaaagcggcatgtttgagggacctgctctttttcctagaggccgcgtggactagcggtgcgacatccttcaatcttctcccttggactcacgtgttggggatcagagaacttcgggtgtgtttagtttatatcaaaattggaagtttggttgaaattgaaacgatgtgatggaaaaattggaagtttgtgtgtagaaaagttttcatgtaatgaaaaagttgaaagttttaaaaaatattttggaactaaacacggcgtccatgttgagttgagctccgtttcgtttccttctcacagctcgggggcagccgcagcgcgtgtgatgctgatgccacgcaacggcgcgaacacagccaaagccaagccgcgtagccgcttgattaacagtgcagtgcaggcaaggggtaaaaatcgagaaaattgacatttagccattctcagggtggggtttcgccagaatgccatcgccaaatgtggcttcgttataatgccatcttcaaacgaccccatcttgccatactgccatttcaaccaattttgattatttgcaaatattttccactgttttgcttatttggtttgacccaaatgcccttgcctcagccgtggggcccacttgccaggagcgtcttccacctccgtccgccaccatccttccctctctccggtgaactcatgccccaaattgacctccctcctcggttgctctcgccccaaattaaatgcaaaaatcggttcctctcgtcctcctcatcaattcccccaacaaatcccactcaaatcggcttaactcagtggtggattttgaagtccctcttcaatggcgagctccaccatagccagcgtcgatctctctccccgacgaggttggagcgggcaagcggctggacgccgtggagtggagctggctacggctgcacgcgcgagcaggttgcctcgacgaggagctccgccgcgagtcgctgcccacgtcgaggagctcatcggagaaggaagtgacgccgtggcgcgcggtcaggtcgagcgcttggtgcgccacgccgccgagccgaaccgtcgtcctcgtccacgccgacgccttccccgttcccagtcgcgccgccgtgccgccttccccgttcccggtcaccatcgccaccgccggaaacctacgcgcgaacccggtgagctacgccgtcgagctggtgagggcgccgaagggcggcgtcggtgccatccccggcgtggccagctttctcatcccgtagcggttcagcgaaggtcctgagctgcgc

SEQ ID NO: 24600 - DNA, 473 bp, Oryza sativa
attcctgcagcccataagacggacggtcaaacattgaacacggaaacccaagaattgagtctttttgggacggatatctacgaaggagctcaggcaacgcttactcaacctaatcgtagctactcaccatcaacttctcccttgcaacagcttgtggatggaggtttagcttgagagattgcaggaccaggagggttgagcttgatgcagggatgggtgcgagcgagatcgaccgagtggccagagctgacgaaggtcgagctcaaacttgagctccagtgcgcaggcagggatcggaggaggtcaagctagattggtggcgcgatctggatggtctgctcaccgccaatagtgagctcgagtacgaggcaacgctcaatgtagctccagtgcaaggtcgagcttgatgcagcgtagggcaggggcttgatcgccagccggcagcagctcactcaaggtcctggtctcccaga

SEQ ID NO: 24601 - DNA, 224 bp, Oryza sativa
cctgcagttcctctcggtattgatctccctgccttgacactgatttgcactaacttattcgagtagattatgagcacattttgataccaccgtgaggatttgcttgctagcaagttactgcagtggtatctgtggtatgattgtgttgccttctgcaaacttatttgatcggttctacattgtgtttgctctagaatttagttacccgcactcgtcctcctaga

SEQ ID NO: 24602 - DNA, 1501 bp, Oryza sativa
cgcccgttcaatttagatatttttttcagtagttttatcatagttttattgtgttaatggattactagaatatgtcacatccaattttaaattcgtttttttgacgatggaagtatctgtgaaaaatacagtgcggatcaaactatgaaaacattgaaaacaaggtgcaccattcaactcagaatttcaagtgatgctgtgtccgttcaattttttttttaggataggactgttcaatttggatgtgagctgtgagagatagtgtgaattgaaatttgaaaaatacgatgcaggcttgcagtatcttaattttctttccgaaatatcgaagactttggtggaccaatgagttcttctgcttgggctcattgggccggattggtgaagagccctatgtttcgccgtgaaacttttttttttttttgcggggttctcactctgaccgtctgacgtcactctggagcttcaattacaatccggtgcaacacgtgtggaataatacacctagataaacactgtgaaatcatactagcagtagaagctgcaagagaatcctcgcttttgggattagatatacgtaaataataataaattcctaaaagccatagagaggcctaatccaccattgaacatctgcacctgtcaacttctccactatccaaaccagcaaatcacattgcaaaagtgatgtcaaaattcagaaagaaaggcaaccgaaagatgtatcagaatcaacgagttttttttattcttttaactctgcagttgtaagataggtttgcgttggtagagggtaatcctgagccttaggcaaatggcaatatagtatgacttgatgatgcaaaccttcccctgcaattgtggtcaagtgccttcattccttgagttttgctcgaaaagaatagctttcttgagtcaataagcatcattccgtttttgctgtcaaatttctctaatgcttttggttccctttctgcatgaacaactaaagcatatcagaagctaaagcataatcaggaaaaaaagaagtctcagaagcaagcaaagaggcaataataatacaggcaactactccatctcttgcttctctctatacaatctcccaatgtttcagtcttcagatatccaaatcccccattgcaagcctcctcttgtagctgctatttcctcctggcctttcttggcctctgcatttgctcacctcctcgaattgtcgaggaagctcatgccttgatttttctctgttttgaactgcaattgcaggtaatgatcgtttgctatgctcaattgctcacttcttcgtgaaatggaaaagaatcatcttgagccgtcagataaacatgttcagatacacaatttgctttttttttcttgcaaattacattcatatttgtatttgtaaacgatgtgttctgatttgatctttattgtgcttggattttcttaactttctcagggatggcggaccactttgcagtaatggccggccggttgctaacgg

SEQ ID NO: 24603 - DNA, 159 bp, Oryza sativa
agaatgggcctacgctgcactgcacgtaggatatactactacagtagacaggatatgatatgaaatctgaagaaatttcgcttcgctcgcttgtggattgtggttacgtcctttgcctggctgccttcaattcttttctttctttctcatctcatcagg

SEQ ID NO: 24604 - DNA, 1501 bp, Oryza sativa
agttgtcaaggtctgccggcgatcctcttgcgaaaacaggggtcggagaagaaaactccgccacctcctcaaccgataaaactgaaaaggaaaaaaaaattacatcagattaacgggctcggcccaatgcaaactagacctcccttacatggcctctgccgtccaacggcgtccgacggcatggctcagcgtctacagtagagctgccgcatctctttatatagaagggtatgtttagtatttgttcaaaatatagaatgggttatttagtaatttgaagttgagatttatttgcaccggggggagttaatctggaaaggtttgcttagttggtatttgttttggatctcgtcgtccgttcgacgagcagcggcgcttcttcggaatatatcacgcggggcggcggatcgaaagattcccaaacaccggcacgccatcatccagccagtgtccggttgtgcgactacgatgcttgtatacatgattgatcgaaacgaatatcagcatttgctagcacatacgaagttacgaactctaaaagaccctatgaatcttcgactgctttcagaattaatttgctgacgtttcattgttttgctgcgcgtggcggcccttgatcgccgtggctgctgggggcgagccagggacgcgtgcagcggctgtcaccggcagcgcatgggactagcccctttctcacgatccgatctgactaaagaaggaatcatgaaaatacaaaaataaccttccgcaaaaatatagaaagacaaatataccctacataatttatactgtaaaagaaagatcagataaatccacaccgttagattgtttatactataagtatatattacaagtgtagtgtattagattgtttatactacaagtatatattacaagtgtagtgtaccgtaaaagttctcaaactctgaccacctcctcaacaagtaaaaatgaaggaaaataaaacaaacaagccaatagccaccgatcgatagcatttttgtgaatcgacatgctgcacgaatcgacaagccaaacgtgcagggtttatcttttcattttcgatgtgaaaactagtaaaaaccgatgagtttcggtcaacgcaccaatatctttttgttttgaagtggaaactagtaaaaagtgataactttctatcaacgtcatatgaaatccaataccggtcggctttcaccaacaaacagattgtatgaaaaccaaacagtcgaaaaccaataaatttggtgaaacttgttcacgtgtcttctgtgcgaagcatattgcacactcacttttatttttattgtttgacgtacacttcagtagttgatacgagtagtacttagacagacagataaacaatgacgttttacggtgaaaaaggccaacaggactgaggaagatataagaaccagatcagcattacaagaacaatcaccttaaaacttacaaagaacctaagtataaacatgtcatgaacaatgcgtgcaaccgtgcaagg

SEQ ID NO: 24605 - DNA, 415 bp, Oryza sativa
tttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccaga

SEQ ID NO: 24606 - DNA, 1501 bp, Oryza sativa
aggagtatatataatttttttacttaactcaattgacaggactcaaggatgacgatcaagtatcgatctggatatcaaaagtttagcactatgaagagctagtaatgacaaatttatattgtaaattgcagtgatgttaacatgtcctcaccacagctgccagccaacgttcccaatatactagtcttattcatcgtaagttatcctaattttggtgatgttaactaaccctccgctatttatctcagagatttcgtcgaaggaaatactacttttctcaatttgttaaattctatagtagtgaatttactcgtaaaaagctaggggttgttcagattgtagccaaaataaaccttactggcattttggcaatattaccaaaattttggtaggatttcttatatatttatcaaagtttggtaagaaacaaaatggatgcacatatttgacaactttaccgaaaaaatgatagggtttgaaatgaaatcaatctaaacaagcccctagtcaagaatgagggttttttttattggttctacataggcgcacttgcgctgacaggtctcccccagacggatattcgtacattttcatagtgattctatacaatcagaatagtctagcttctggaatagggtggtacagttttcctgagcaacatcgcgagttgatatgattacaatccatatgttctaatgcttcagagtttgattaatctttacattaatactacaaacaaagaagatttggataatggaaacaatttctatcctctgcaaactggttgcttagtggtggggaagtgcactatatatgatgcattatagagctaattaagaccatggtcaaagctatatagcatctcacaataatgatcctaccccccaaaaaaaacaatatccttaagctatgcaagtgtctaactaatctccattcaagagtcccattgaccttcaaaagaaaaggttcttggaaaaagaagaacaaactaaaaaaaaacattaagtgaagagttggagggaacaggtcaactattatcctggatagaaggtcctaatatactatattagtctcagcaaagagtggaggcagccgtcaccttcgatgtgttggcatgtctccggttttttaagggtttaaccctgcatatgtgcggctgaacataatacgtccaaagttggagggttgaatggttgatgatgaggagcagtccaagtgatctgagcagtagtttaagccaccactacaaccaaagcatgtcttttagcagagagacgttgctgagttgcttctacatgcttggaccattgtctttccatgtccttttgtgactgcttatcaacaactactatcttgttagcttctctccagaacaatactagtactagtatatcacattatattctaccatttggtcggtggtttactgggtgtgtgctcttgcagtcaatcagtcatgtggtttaccgtcctgctgccctatcatttggcttattcatgg

SEQ ID NO: 24607 - DNA, 1159 bp, Oryza sativa
tcctgcagccccgcagggtcgtcgtcgtcggagtggcggcgaggtggccagatccggcctgggcttgccggatctgggcttcggcagcgacggcggcggctcgccggcgaggtcagcgccggtcgccctcctcccgctcccctctctccctccagccgtcgccgacgaagctcatcatcatcgtcgccgaccgccctctcttcgcccgcatcgccgccaccttcgtcctcccgctctccctcctcttcctcatccacatcgccatctcccacaccctcttctcccacatcgactccgccctcgactctgccgcccccggcacctccgcccagcgccgcctcgccgacgactggctcgccctcctcctcttcaaggccgccgagctcctccctgccgtcgcggacctccccgcccgccggtcgatggcggccggtggagcggatcgacgagtgggcgccgccgtgggagagaggcgagggggcgagggtaggaaggggatttggggggagcggtgaggagacgggagttcgcagcgggtctcctcgcaggggcgagggccggctctccgcgaaaagcgagcgctccttgcatagagccgcgtctcccaaggagtagacgcgctcctagctggggagacggctcacgccgaaaagaggacgggagggaaacggccgtttgtgaggggacgggtcgaaggtacccattgctgatggcctaatggatagtacagaagagtaatgtgcaatccagatttacacacaaaacaacaaacactgcatgtaaccccggagggagatctatcaaagaatctactgtaaaaaggcagggccataagtttacagtttacacagatctataataacagatgtgggggtaaggagaaaagagaaaggagaaaatggagcaaaaacagcagtgctcctgtagagaatggcatgtcaataaaaagaaccaaaactttacaccacttggaccaacccacttgcaagctcttccctctgcttaccagccagacacggtggcttgcaacagcagaagcgtgagcccgtctcaactctcaaccaggcatcctaaacaatatcatcaggtatatatgtagactgtagttatgtaccggcagtcttcagtagttcagttgctatgtgcctatgtatgagca

SEQ ID NO: 24608 - DNA, 689 bp, Oryza sativa
atactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacata

SEQ ID NO: 24609 - DNA, 1501 bp, Oryza sativa
gaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgc

SEQ ID NO: 24610 - DNA, 1187 bp, Oryza sativa
cacatcgaatgtttggacacacgcatgaagtattaaatatgtaaaaaaaaccaattacatagtttgcgtgtaaattgcgagacgaatctttgaagcctaattgcgtcatgatttgacaatgtggtgctacagtaaatatttgctaatgacgaattaattagtcttaatagattcgtctcgcaatttcctgacggaatttgtaatttttttgtggagtgtaatttgttttgttattagaccacgtttaatacttcaaatgtatatccgtatatcttgtgtgactcctaaacctaaaatttttccccatctaagagcaaggataatactgggatataaacaagctatatgcttacgtggaagagaaagataaataaaagtggagagtgttggctctcatgcaagagctaactacacacaagctctagaaatatgcattaaatttatagtgagagaaagagagaggacgaagaaaataaagataaccttagagcaagttcaatagcagagccaactactagctccagttcatctatagccaatgtaataactcattcatacaatagttacatactatactattaatacctggtcccacctatcatacacacactgcgtcttggagtccgggctacagctggctacaaatatgtagcccgctgggtttctctctccttatttaacttcttaaaatatatttacagctggcttatagcctgctattgtacctgctttaatatagccaacctactatacatgttaattttaacattgactaatagtaagtagtgagctatactattaaactggctctaaacaaggcctccacctgattgatatccctttgtcatcatttccaagagagaatttcttccacaaattaaacacatatagggacatagctgaaaatgccgtttggcaagagaaaaaaaaaatattttgtaacggtagtggtgggctttcacacgagcacggtagaccagcgagcaaagacccactccaccacacttccatattaccaccaccccccaccttctcgctttcctcttcctctccacttccatttccaagaatcgaacggaggcgtctcgctatcgccatcgccatcgccatgggcaggaaggaatcgtcgacgacgacgacgacgacggcggcggcggcggcggcggcgacgaggagcatgaggctgc

SEQ ID NO: 24611 - DNA, 181 bp, Oryza sativa
ggaagcttttcaatctctagtagaaagcttagtctccaaaagaaagttttcagtaaccagatgaaagttccaggtgaaagttttcagttccagatgaaagttgtccaatcaaaggtttttagtagcatctttttttttttttgcaatgagaagttgaaagtttcccttttcgggatgcaga

SEQ ID NO: 24612 - DNA, 274 bp, Oryza sativa
ttgatcatatagaaaactttatatgatcttcatatttaatttgatgcataataccttactcttttaacatctcatgggtagatgttaaatgcttttaagcatgattgcatgagaacatagaaagaagcattggttatcattttatgtaatttactattccaaataactttacaaacttaggaatccggttaaaatgggcatttatgagttgagattatgaatgttgtgattatgaatgttgatgaagtttgtgatgctggtgtggggagtttgg

SEQ ID NO: 24613 - DNA, 857 bp, Oryza sativa
tatatggactctatactctacttctaattttccttatttttaaattccaaattttagctatttcctaattgtatttctatatggaatctagtctactcttctaatattccttattttttaattccgaatttcagctatttctaaattgtatttctatatggactctgccttttctttttctccgattaatgtgagaatttctagaccatttgagcgaacgtggagtctcttttttctattcctttaataatataatagatagattttggcataatccaaacatattttactaatcgctcggtctcacagagagatttcatttataacatggcacaggcaaattagtactacaagcgaagggaagagaaatgactttagtgtacctcattaacactcttaattaattatagtatactagtactccctccattttaaattgatctacatatttcaaagatacaccaagaccaaaaaaagctaataactctctcatactatatttactcaatgtatgcaccatccccactatttcctagccaatagcaaatcaagatattccatgtgggttataaatgcttgtgtgcatggatttatcaatgtccatttattccaatgcacaaataacgaatagacctaataaatgaacacaaatatgtagatcatttaggaataaccttaaaaaaagactatgtagattaatttggaatggagggagtatttcttaagcttcaattaaatacgtatgccagtctaattgattttagtctcttgaagtaaaatctttgctagagatgactcagatgaggactgcgtcgtcttctcgttttcccagctgatgactgatgttgccgcgcagg

SEQ ID NO: 24614 - DNA, 1267 bp, Oryza sativa
tacatatgcatgaatttaaaattaaaggaactttggtggtgaccagagttgggttggatgatcttttggactttccggtcaaagagcgcatcagaacagatcggtgtgaccatgctagccgggttgttcgcttggggacaaaaaatggttggactaaagtgttgagggtgcagctctcctcatcaactaaaagtgcactaacactacgtccatttcttttcagtaaaataaatatttaaagtgctcatttttttgaacgactaatttaaagtgctcatgattttactcaaagaaacataaacacaataatgatgcttatgtgagttagcaagcatggtgagaccctatttggagcaccactaaggagacgaagggcatcgttttgcatgatgagaaggtccatgatttgattaacacaatgatgataatctggatataagcatatttgcactgccttgtatgcgaagtcattttccttcttgattgggtgtctttattatcatgagatataacaaaacgcgttttattttttgggaagataaaattttcatccatagaaattttgattggatatacttagatttgatatgtaaaaataaatcatagtgtgtctatatatatatatatatatggatatatatatatatatgtatatgtatatatatacacgcatatgtatatacatatgtatatgtacatatgtatatgtatatatatatgcatatgtatatatgtatatgtatatatatgtatgtatatatatacatataaccagtaaccagtaaactcaaagtggtatcagagccagtcatcataaagtggtatcagagccagtcatcatagagaaatcaaattcagaagctaatattggaaaggtaattactatcaaagataatctgaatataaggtgttaaatcacattgaagaccatagttgacactctaacaatagtcaattaattttaattgttgatctgatatataatttttatataaattgggataaaaagcaggaagatttagagcgaaggtttgaagatttgtttaaagaacgaaagcaatctgaagaacaatatttgcttgtcagtaataaattaaattcagtgctaaaagagctagaggaatataagataaggcagaataagatattacaaaacagtgactatatcaaaaaattattagaaataataaattctagtaaaggaaaagagatagttttggcttcaacaggcataattacctcgtctcaagctattaattcagaaaaa

SEQ ID NO: 24615 - DNA, 434 bp, Oryza sativa
catgtttgaccgttcgtcttattcaaaaacttttgtgagatatgtaaaattatatgcctacataaaaatatatttaacaatgaatcaaatgataggaaaagaattaataattacttaaattttttgaataagacaaacggtcaaacatgtgataaaaagtcaatggcgtcaaacatttcgaaacggagggagtatattataggacggatggagtatgctggtatttcatgtttgaccgttcgtcttattcaaaaacttttgtgagatatgtaaaattatatgcctacataaaaatatatttaccaataaatcaaatgataggaaaaaaattaataattacttaaattttttgaataagataaacggtcaaacatgtgataaaaagtcaacggtgttaaacatttcaaaacagagaagatatattataggccgga

SEQ ID NO: 24616 - DNA, 1501 bp, Oryza sativa
aaaggctctacagccgacaccaccaaccgggggcacggagggctgatccccgcgtccgtgttgaggtgacactccggacgaggaggcgccctccgttgcgtggggagcacgccgaccattacgccggcgctcgatatcgatgcgggcatctggccccccacgctgatcttcccgggtcggaggcgctgacgagggagtggcagccgaatggcgagcaacagccgccgctcgtcgcgccctccgccttgacgacacggagccggtggtagcagcgccagaggtcttggtggcggaggaccgaccaccagcacctaggcgccgctgtgccgtcatgaccaagttggccacgtcgtccagccatcgttgggctggagactccgggtcagggacgacaggcgggtgacgcaggagcgcgcccgcagcttggagcgcgccctggggcgtgctgccgtcgccgtaaacgaggaggcgacgctccccatctcggcgcccttctccatcacccgtggatgtcgaagtcgcggatccttcgaccctctcgagcacctcctccctcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcacacgaaagagtgcgagagctcagaagatcactcgcagaaccccctacctggcgcgccagatgacggagcttgggggtcctcatcgggagaccgcgcaggcccccctttgccggttcggccgggggccctgggtgaggttctaagctcttgatctgtggaaagttcgcgagagtgaaggcgatgtatacaggttcgggccgctgagaagcgtaataccctactcctgtgttttggtggatctgtgtatgaagaagctacaaagtgcgagccagcccccgatcgttctgggatccttcatcagattattatatctaagtatcatgttgacatcataataatattaactattcaattgaaacattgctactccctctgtcttacaatgtaagttattctagcattttccaccttcatatttatgttaatgaatctagaaatatattcattaatatcaatatgaatgtgggaaatgttagtatgacttacattgtgaaatgaatgaagtactattttgtaagaatatttctacgaaaaatgctacaggatggtgccccgtattctcgttcagacggaatgatgcctctgagttatcgtcggatacttattaggtatcgatcgataccctatttagacaggttgatatctctaaggtatcgtgtgatacctaatacttataatatctctgagatgtaatctgatatctgataagtatcaaccaatacattaaaagtatcatttcgttcaaacgaggtgccgttctacagcattcctatgtaaaacaaaacaataccctccgttttag

SEQ ID NO: 24617 - DNA, 1501 bp, Oryza sativa
  unsure (1)..(1501): unsure at all n locations
ttccaaacctctaattcgtctctttcctccctatataaaaaagcaaaactcctccttttcctaaaaaaaaatactaattgctatactattaaacttcttctaccctttatatatccnnannatacaggcaacagaaaataccttgtgattctcatgggcaagggggcagcatttcacaaagaacatgatcctatacctaaatattattcatattccacatgtatcttctctgatccgccggaagttgggacgacgcgctgcgtgtggtgctgctaataatttccagcctccgaattagctggatgatgcatgatacatcgagtactaaaatcatttagatagcacaaggccaccaaaatcatttatgccgatcaaacagtgccatccgtgcctgcgggtgcatattatatgtcactgctattctttttttcatggaatctcatgtaaatttatctcttctcatgtgcagaaaatcatgatagtttaagaaaattttgaagagtgagcgtagctaatttagttaggttcttgtggtaaaaccagtttatccaaattcaaatcctggatttaacatgagtgttcgcatttatggctaattattctttcaacggtacgtgacgtacccgtcgacagcgagtcgtcatggtgacttcgctaatctcaaaatatatcgatccaattctttggatgtgttcataggggtagaatgtgcgtgtgtgtattcatagtggtgagtgtggatgcgttgtggacacctatatttttactatgtttttcatcaaaaagaaaaaaaaataaagactacccaccatccagtccacaaataacagagagatctatacgatttttcattactctaacaacgatgatcatccctcgataggagtattaatcttatattatatatatgtggttgtttgtttgtccgcgaaggagcatatatgtacattgtggctttggggacctgtgttttggtcttttccctttcaaaaataaattgctttcagtggctgggacccacatgcagataaaccggcctctgccccgagaaaatatagtgtgaatttagtaccttttttttaaaaaaaaacattgttcataaccacaattatctgtaaaaaaaaaatcgtgcatgactagctgtaagcttgtaaggctgtaacgttgttccaagtcaattatgttccgtgcagtatatattattcaacctgcggtacacatcgatccatttccagacgtcgttgtgcaattgacggcgatttgttggtcatatcaaattattagctgtaatattgcaactgaaaagttcagtgaagatgtgaacggaaaaaggtcgatattcaaatatctttattaccacgtccttgtcggtcctccaacgtgttccttgggattgtgcttgctatgggcagtcctaactcttcgcttagaatggtgtatatgatattaactacattgtcatataagacttttaacttatgtggcactatattaattaaga

SEQ ID NO: 24618 - DNA, 1201 bp, Oryza sativa
aaggtgggcgccagcagctagaacgccatcatcgttcccgtcgggagcaggttcgctaggctcgccgtcggcgccagcgcctgcgagaatagcgatggccttgcagctccggccggacgacgaccaccgccgtcgccggtagcagcgctctctccttctccagcttgcttacctaccgctggcctttgcctgacgacagcgggagacaccatgatcgatcgaccggattgttcttggataggcagctagctagctcgcgctcgccccgatctcaacccaccgcacgcgtttttggcgaagcagaaaacgagggaaagagagggcaatccgggcatttagaaaaatatctcacctttttttttacccagaaataataaaataataagactagtgtcttacagccaattacacaatttttttagtgtacatcagccatatcacgttttcgcggtatctcctagctaattacacgttttaggtgtctcctgtgataaattttgcctaatcaaaaacaggacaagaggaaatgagcacagaccaaccaagaggacagaaacttaaatatcaaacttatccctaatcaatatgctagtagtaaaatagtgatatgtttttaagaactagtaactgtttagatcatttctattcctattagtattaaagcaccgtaccgtttctcgggttaatattagtatatgttcgaaggtataattggggacttggctgtgttcggatgcctgagtttccaacactaacagtacgcacgaaaaacagagtggttcattagcgtgtgattaattaagtattagataattcattttttaaaaatgaatcaatatgattttttaagcaacttacgtatagaaactttttttaaaaaaaatgcaccgtttaacagtttgaaaaacatgcgcgagaaaaatgagaggagagtgttagaaacttagagttctgaacacagccttagagcaggtacaatagcaggctataagccagctgcaaatatattttaaggagataaatgaggagagagaaggccagcgggctacagatttgtagccagctgtagcacggactaaaagacgcggtgtgtgtatgataagtgagatcatgtattaatagtgtagtatgtaactattgtacggatgagctattagattggctatagatgaattagagctagtagatggctatactatta

SEQ ID NO: 24619 - DNA, 371 bp, Oryza sativa
cagtgctgttcctcagaaacagttgttcgccaatcgccagtcatcaaagaggcatgtactgtattattctctacgcaagactggtcaaatatctgcatttaatttgtttcgtctgagagcttccggatacaatacaatgtacattgtatatagtacgaaaacatatcagtatctgacggcatggcaagtatctttctgctaagtactgtgggcacacaagcacaactgcacaagggccacatgcagggagacatcagagatggccacacacccctagttgcaaaattcagaagatatactcctacacaacaagcagctaagcaccgagccgcagctgctgatcctgctagctaatcactgatgtttgtagg

SEQ ID NO: 24620 - DNA, 1501 bp, Oryza sativa
ggctactattagctctagcgcggctgccacctcctccctcctgtcacctcatttctttccctctctatcagccagcggcagaatcaactaatacatcattacttaggttaattaactaattaattagataactgtgtattaaaaattgttacagagagccagccaccggccgtccccttgtctctgccactgttgccagcggtgcctctcagtggagctgtgtaggttgttgctgctagggtagagaggagggaatttttttagaaataatattattttaatgggaaattgcaaaagtagaaactggtcggctaaaattgcaagtttaacatcatgtcaaactacagttgttcgacagggttgttgttcacttaaaaaaaaagaaaaggactataaagagcatggcagggggcctattgaacatccaaagttcgataggtctgcatgcacagaggtgcacagtagtgtatattgcgcatagtgattgatctctttttttctatcattttttatctcctgtcgaacagggacagttcgatagggtattttttatgccctgtcgaacaaccgcagttcgacaggtaccctgtcgaattatggttgtttgatatgtccccctgtcaaactgtggatatttgacagggcggccgatcagcttctacttttataatttttcattaaaataatattatttctaaaaaaattaggaggaggtgacaaccatattagcgtcaagtaggatttctaatgggtcatgacaattttagactgagatgacacactttaataaggtctaggatctatggatttggatttttcaaagtataagaacctatatgacacaatataacaaatttaggagctgttggtgtattttacttataaatttatatgccactaattttatcatattggtacggaaagaaaggagttatgtctacgtagttagtataggacacttggtaattcccgttctatatggactcattcatgatccacaagccgtactcgggaacaaagcaagagcacaacaaacttatattgttggaactgaaacggccataataaaattagtttgtaattgattctctattaatagtgcaaatcggatagctaaatggtgtcaccatgcatatgtccacctaaactcctggtatgtttgaggatcgacaaaaaaagggcaggcgaaaatagagaagagatcacgaaacgcccacacctgggtacgcagagagcgaaatcaaccgcatggcggcggcttttcgacacgcggcgaagagtgtcgtcggagccggcggccgtacgtcgcgtgctacggacggcggcggcggcggcggctactatcctcaaggaggaagaatggcgggtgttgctgctgccgaggctagcttattcccccggcaccggcggcgccaggtcgacgtacgacgccgctcctccgctcattcacctccgcggccggcggagcaccaaaccatcacacgccgcgcacgccgtctca

SEQ ID NO: 24621 - DNA, 261 bp, Oryza sativa
ttggttgggattagcatattagcatatcatcagcattagggatacaaagctctctccggtttacaacgaaacgccaagaaaacgaaggccactaggagaggagaggcgaggcgaggtggacgcgtccaagcagaatcccaaatcccaagccctctctctctctcgctcgctcgcgcaggagcgagagatcccactctctccccaccatttccccccccccccctctgtgtcccctcctcctcctctacacctggttgggca

SEQ ID NO: 24622 - DNA, 281 bp, Oryza sativa
gatacgcgacactgtcgaaagaaaaggtgctacactaaaagcaactgaagaaatgcactgcaagttcgcaacgtgcagatcatgaatatactcccaagcaaaccggtggaagagcgcaccaatagtcccattccttgagccactaaccaacatttcctgcaggccgatccttacaggaggcacgaggttacatcgataaaatcaggatcagagtaggtttggagcgagtcagcgagagacgtgttattgcagccacctgtcactctgccacatgtcacagg

SEQ ID NO: 24623 - DNA, 594 bp, Oryza sativa
tcctgcagccccttgcaacacgtcggatctcaattagtatctgcactaaccatattgatctaacaaaacatgattatagtgtaagatcaatgtgtgttttgattcttattctgtgatgaacaattgacatatgtgattatcggttttgatatttggagattatcgtcgaagtggttttggagataatcaattttcaggagatgaatagggtttactgatttgtcgggaccggtcagaccgggcggttgttgccggtcagacaggagctatgtgagcggtcagaccggcttgcccgcggtctgaccggccgacgctgtgtcggtttcggtttcgggttgtttctttggatatccgtgattgtttcatggttatggcttatagatggatactatacgtatataatactgttgtttgctacgaatgagttaagttggagatagcttggtctcgaaatatggtttctttgtttgtttcatgtataggtgactcgatgcctcgggagagtatttgcggtgatggaccgggagtcggcttagtggtaagacgatatccgtggtggttagatatcatacgagatactaagactagagttga

SEQ ID NO: 24624 - DNA, 335 bp, Oryza sativa
aaatttgactaagtttatagacacatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcga

SEQ ID NO: 24625 - DNA, 309 bp, Oryza sativa
attcctgcagcccatgtcaagtgggatcctatcatggcgcggtgtgggccgcgcgcgtaacgacggtgggagaggcttgcgttcttcccagttcggaccgttccgttcattattggctcgatagcgcccggcccaaccgaaccgatggcgccgtgcacgcccccccgcctactcatccatccatcccgcgtcgctctctccggcgaaaacctgccctgcgtcgcgcggcgggtggttggatggagcccgcaccgcaccgcgcgtacgtcaccccgcacgcacgcgcgcgatcccggaggatgagacgga

SEQ ID NO: 24626 - DNA, 353 bp, Oryza sativa
aagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaaca

SEQ ID NO: 24627 - DNA, 552 bp, Oryza sativa
cccctgatgctccaaataaaggggggagagatactatgacagtatggcactagcttagtatcccggatttggagaggcttgaccaccagatattggtgtggggatgctctggcatctgatctccaggactccgagaggacaaaggttgcaaagctatgagcaagttccaaagctctgggccttctctctccccccacaaattatgcgaaagtgtgaaacgtccctctcctctttatttcccattaagggaccgagaccctatttccagatttgtacttcgagaatgcaagatgcatgatagtacaagtaccatagcagatggtgagaatcttgcagctagtgtcaattttgggcttggcatctcatggccagcagctttccagattttgcagctctgccctgctggttaaacggaacctcactgccactgccttgctacagctttgcctgttggttaaacggaacctcacctagacacagtcttaagtattgctatatatactacagtattcaatcacacatataattccaagcaatgaaacgccaaaaaca

SEQ ID NO: 24628 - DNA, 287 bp, Oryza sativa
taaatgtagaaaaaaaaatcactcacacagattgcgtgtaaattgcgagacgaatcttttaaacctaattgcgccataatttgacagagtggtgctatagtaaacatttgctaatgactgattaattaggtttaataaattcgcctcgcggtttacaggtggaatatgcattttgttttattattagactacgtttaatacttcaaatgtgtgtctatatattcgatgtggcacataaagccaaaacttttttttttactaactaaacagggcctcagtgcaggaca

SEQ ID NO: 24629 - DNA, 1162 bp, Oryza sativa
  unsure (1)..(1162): unsure at all n locations
cgattggttatgctgctcaactgtagtgtaagattactcaaattcggatggaagatggtaaatcaaatgattcgaaatggaaattgggtgactagtagcgcttaggtcgatcttaatcttgtaagttcagtttaacccagaactgtaatgagttgcggaaggattttgtgcaatttaaatctattcaatcagtgaatctcgcttgccatagtgtactattcagtggcagtggcacggatgatttagatggtgcaattagaggtggttttggcatgacatttcttttctttgtccctgttgcggctagagcagctagaatacgtncnaatattgttcagctttagagaatagtttccgtttcatattgtaagactttcgagcgttgtgtagaatcatatagatgttaatgaatccagacacatatagatacctagattcattaacatctatatgaatgtgggaaatgctagaaagtcttacattgtgaaacgggggaagtagcaaagaagatgaccaggactcttaattaattcggagtctggtattatagagttattgtttcagtaggatatgaagaatgcagcatttagagttattttgttgtctggttcttatcttatcatccctataatagtactaccacgagatggtctgtattcaaatttatcaggttgattccagcagctaagtaaaagcaaacttcatagggcaattgcgcctttgcatttgcatcacatattcacatggcaacccttaaaatgtatgtatgtctgtacttatatgttgcggtgggtanacttaggaagtagtcagctgctctatacttccatattgcatatgtgaattaaaagatctgtcatgtcataagtaatcggttttgtttgttctttggttatattagcatcacgggtgtgcatccaattaatattgattactgccttcaactgtaacatatgttcatggctgaattgctgcaatcaaacatcatctattttacaagtgacaggagatgttacaacgaattctgtttacttgatgtgcttctcatctacacagcccagaattatatttgaatttaacttctttgcaagtctcttctttatgtatttgattttctagtttcttatgtaacatatactgataccaaactttcttgacatca

SEQ ID NO: 24630 - DNA, 324 bp, Oryza sativa
aattttggcatctttgtttactactgctactatctgttatatactgttatctctgccatgctagtaggattatcattctggattttatgatgttctgttcaatgggcaaacactgtccggtagtatgggtgcttattttctcttatgcgcttgatttctttgaattcaatgatttaggttttgctgacatgatgcgtacatgttatctgtgctttacatctcaataaattgctttattaaagtttcttagcatccttgcatctttccatactgcactaatcaagtgtctagacctttggatcttaacaatcttactttctgaac

SEQ ID NO: 24631 - DNA, 216 bp, Oryza sativa
tttatctcattaaaatatgtttgtagctggctaatagtttgttattgtacctgctcttatattgactatatatgatttggagttagtagtgtgctatactattaaacttgctcaaattgtttttcgggtcagaaaagaagcttcggatcattaatctttcatgtaaaaatcatgtaaagaaataccgctaaggtctattcaaccgggcatcaacca

SEQ ID NO: 24632 - DNA, 268 bp, Oryza sativa
tcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaaca

SEQ ID NO: 24633 - DNA, 290 bp, Oryza sativa
atacagctttacaaaatgtggaatctagagatttagttcaatattgaaacctttagttgagaagcaaatgccagtataatattccagctagctgatttgcgatacatgagcaaacatattcaattccttacttggagaacttaatctgaccaggaatcatatttctgacctcaagataccatattatatcatcctgcttccgttgcctatccgattatccgtcggtggcccgtacgggcgtcgtgccgatcgatctagataattcaacgcgtagcggctcaccttgaaaa

SEQ ID NO: 24634 - DNA, 174 bp, Oryza sativa
gaaaatcgaggtcacatatgtatcttataagacagcggaagtcattcgaatttttttagtgaatatcaacaactaattcctaactacactaattcgaaagtagaaatcacagattcagaggtcgggtggaccgacacgggaacagatgaggcccgtggtggtggggcgacgcca

SEQ ID NO: 24635 - DNA, 194 bp, Oryza sativa
tttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatgg

SEQ ID NO: 24636 - DNA, 599 bp, Oryza sativa
tagacttgctaatgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcga

SEQ ID NO: 24637 - DNA, 155 bp, Oryza sativa
  unsure (1)..(155): unsure at all n locations
tgctagcatctagcactctgtccgcatacattggattgcggcaatacgagcttagagcaacgcaaatgactagataagtatgcactctaggtgttctntgaattgcctcagtgcagacttgatgaccattttctgaacatctctgctctgctgca

SEQ ID NO: 24638 - DNA, 428 bp, Oryza sativa
gcagtgtgctccttgtggacagagctaacaaggaagctatcagagatggtctgtcccgcagacttggaataatcaagttcactgaggcctctcacattgcaagctatgggtcccgtacccttagcctaaaaagttggcccaaaaacactcaccccagagtgtaagcacccatatatgtgtggcttaagccctgtttgattcagtttaggattattataatctaacttattaggagtaagcttaaacaaacaagtagattattatagcagattattataatctataagtcagattattataatctgataagctgctctagaggagcttttttcagattattgagtggcttaagacccactacctctacatacttgagaaaaattacccacctatatcattaactgaacagatagctgagggcattatag

SEQ ID NO: 24639 - DNA, 816 bp, Oryza sativa
tactagagggttggtttcatcaacatatgaaacgaatataagacacagctacatttaatcgaaagaacaaaaacaattattatcatctttatcactctaataaatacaatatatgcacccaatacaattagaaatcttaagggtgaaggatttaaataataataatttaagtggagataaggtgtaacaaagatcaattagtgtatgcatgtacgcagccaatgaatattaagatgactcatcgggttccgattaatcatttaatttatctattcatttaagttttaaatacatgaaaactacaaatgtagctaattcaaaatatgaaataaatctaatatttttggaaggattccatttaaaaaaaggatatttttggaaggagagtactaacaaatcattggttcatctaaagttagcatagtagagaactcacatcaatactagctagtagtagtatcattccatcttgaaacataggagtacaaacgaaaaacgactagagaagactgcacgggaacagatatcaagcaagtcgacaaaatacaattattttagcgagatatccaaggtaaattttcacattggatccgatacagtgcatagtgtctactggctaaggcgcttggacatactcgtttaacggaatcgatggggactaagtcttggatccatccgcgggagggaggccaccgtgctcacaggccacgccgccgccgccgtcacgggcggccggccgcaccctgctccgcgcgaggaggaacccgagggcgtggccggcgacagcggcgaggagcaccccgacgttgaacgaca

SEQ ID NO: 24640 - DNA, 1501 bp, Oryza sativa
actgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgatcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatac

SEQ ID NO: 24641 - DNA, 415 bp, Oryza sativa
ttttctctaaaaaatctttatctgcttcagtttcaaacaggatcaacgtatcatcattccatccacgatacagacacaacttgtgaagggttagccctttcgtagttttttttttctttgagctgagcccatccattgttggcgtaactgcaactagcacggaaatgcctccaagtcaaaggaagccagccagctgatacgcactccatttgcctgcatggctagtgagagagacactcttaacatttgataataagcagtttaggtaactaggagcccggaaaagaaggcaagcaaatagtgtcaccacgcatggcccaggggaaccaagatgctggcgcgcttttgtttccgcgcggttaacaaatcgatcgggaaggacgtgtagccgagtaggtggagacggagtcggcga

SEQ ID NO: 24642 - DNA, 264 bp, Oryza sativa
gactctcttgtagctaggacaaactagttacccaagaaggagagaaggaaaattcctgaaaattcactattttcaatgtgtacttatggttctaaccttcctttatctgtcccatggacccagctcgacttggccccacctgtcacagacctaggctctccaccaaaccccaacccacctccaggtcatccacccacatcagatccataagacaagctaaaccctttcatcttcttcctcttttctttctcccgtgcctgttct

SEQ ID NO: 24643 - DNA, 746 bp, Oryza sativa
cggctgaaccctttttaaattaaaatttaaatgaagaaattcgcaaatattcatttaaagagcatataaacttcaaatggccataacttggccatttgaactcggaattggaccgttcaagtctctaatttttccttaggaagtcaagaacccatttttgtgctttgttcctactggttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttatgaaattattttaatttaaattattgcattaccgctttatttaaattcctgcgttatcactgttttatttagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggattattgtggaattggattcacaccgccccctctattcaaaatccctaaaatggttttaggctgggctcggggtgcatagtttcgatagtagcacctcggccatataaggaccggt

SEQ ID NO: 24644 - DNA, 212 bp, Oryza sativa
gatttagattatgaatggattattgcgcagattatctactctattatagtgataaattaaatattttaagaaataaatttaacaaatggtttgaaataagtggtctaggcaatgcggtaaaagaattttaaagaaactgtgttttccgaagcgtggagcaaatgatctggtgaataagctgaaaagaacagggccaatgcgtaaagtacact

SEQ ID NO: 24645 - DNA, 1501 bp, Oryza sativa
aagattttctttccttctaaattgtgtgtactcatggtttcatgggaattattgtaactgcagcacaaaatataccaaggaagcttttaaggcagccctcaatgaatgatgcaaaaattgaagatgacccatgtaaaaacatgggaattcatggacataatcaggatgataatgattctttggaagggcaggatcatctactagctgtgccaggtgtgattctcctatgctgtggtctgatgataccgtgctttcatgctgagaaaaaggaagtcagcaggcataacactacatccattcagcgcaatgcaggtgagtccacacatcatgagtaccttgcactatattactgctgaaaaaaaaaaccatttggttgtcacccactcatgctgatggtggactagaaattaaatacacacaattattgatttttcatatcatgacagttgaagtaaaaagtgtgttgaagacttactgatgtcgtaaatgacaagtaataagagggagtatatagtatttctgttcttcaaactgtttcacggcaagagtcagatgaatagctattttgtaaggattaaaatccacatgtattctgtgcaatttgttgtcatagggaactggttgtctaaagctttctctcatcatgagttaaatacatgctcaaatgctccctgttctagtatgttgagtatgtcagttcaatcttgtgctatcctaaccatcttctgcatggtatagtttgtgatggcacattgggacctttagagctaactctgatggattactagtatgtgtttacaaatttcttacctaccatttacttaccaaactagcaactcccggctagtatgtggatttacagagaaccatagtggatcatctctaccaattcctaacttggtctgtgctacttaggaaggagtggcatctagtgcagaaaaagaacttatataatagtccgtaactaatagaacaaaatctgtttgtttgattaactgtcatcctgtaatttttaactcatgtgctgctattccttccagcctcatttgtgtcgttagctctatacacacagcagaatgaaataattgctacctaagttttaggtgtgcccatctctctgacacccctactagttagcaattaatagggttattgagaactcaatgtttcctagaagaaccaagaaaaagtatttgtaataaaacttctttgcaaagccatttatattttgcacattatgtattttaatatatgttgcagaatatctcaattctggtatgcagctctgactgttaagctgtttgcaagattaatgttctcctaccgtactagcaccattttgattcagtgtcaaactcaaaagcattgttgggatcttgtccttaacaaccaaacttcttttttccagtcgaatcgattgcatccttggatgtaagcacgtcatctgagaaggttccaccaactccacaccgaatacccccaagtccatctagattcgcac

SEQ ID NO: 24646 - DNA, 364 bp, Oryza sativa
tttttttttgaaaatgttatgaaactaatgtttttcagtcagctgacttgtcttttattttaatctactatagagcatgtgcgcccctggaaagcatgtttttcagctgtttgaatcttgttttgcagatcttaatgaacgtctgcatttaatttttttaaccatttatgcttccacacaacagctgtgcattttccctgactttcagaatttcttttttttattaaaaataatgctatcatgtagatactgagcgcttgtttttcaacttcaaaataaaattaggacttaggacaaggaaaaatttagaaccttaccttcttccactgcaaataatttatgttgacatgcttgattctcaagg

SEQ ID NO: 24647 - DNA, 210 bp, Oryza sativa
tcaatgtacagtactagtagtacgtgccaggtgcaacttgctaataataaatcgcttaatcgagcatgcgcaacggcacggcgagacgagacggacgcgcagctgcagaggtcgtgcgccacatgcatgcacgttgcaaccgcgattattttgtggcgtgctattcgatgtagttttccgtgctactcctatatttgttggagaaatagg

SEQ ID NO: 24648 - DNA, 463 bp, Oryza sativa
gcaggtaacgggtacccatacccatataattgactcataccatttatagttttgttctataattagctatttttgaaccgtaacccatcaataattcttctggcaacaatgctattaacattagcgctaaagtcgagtaaaaaaaatctacaaccatattacataatcaagaaatcaaataataatttcatataactagaatagaacttaagataagaaagaagttttatgttactcatggatttaggcttaatctacaggttttttcaccctcgggttggtaggtacgagtagataaagaatagacccatacccatgtacctaataggtaagaattttcgcccgtcggtaaactcatgggtataagagttaaaacataattagcatataatagataattagcttctaatagagtaaaaaccagtcaggtgtcgggtcatagcaccctgttgccatctctaga

SEQ ID NO: 24649 - DNA, 1005 bp, Oryza sativa
tttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtctcccacttccacgtgaaaattgcctggatttgaacaaagtaatctttacagctatccttaggttctgacgatatctagtcctccacatcttcgcctgtcctctcacaaaagccactctcaccgtacttttaactccactcgggtgcttagctcgtccctcatctgtcccaaagtcttacccagccgccgcacccgagagcgagatgcgatccgatcaaaaacgaaacgggctgactcatcatcactcatccaattcccatcccggccgtccatcgcgccacatccaacggccaccatgcgacgaccctgcccccctttccagccaatgcatcataatacattaatactatagtatgcatataagataatcctaataccatcacaaataaactaagcacatgatgcataacaatcacaatagaaataaacggaaaaaggcaaaatcagtctaggggattccttccagctctcaaccaactcgtcacgccacgcctaccgcctccgaagtttataaacctctctctcttttcgagctctccgctgcgtgtccaccatttccgtttggttttactccactaataagctaaggattttttcttttggttgtggttactgcgccaa

SEQ ID NO: 24650 - DNA, 207 bp, Oryza sativa
ccaaagataaccatgttctaatcgatgtgagaaatggcccacgtcggtcggccattgtagttgggagcggacaaacatgctgattcccgccgcggccaaatctattcttatctagcatgtcttgagagcaaacagctttcaaaggaggaaacaatctaaatgatgattgctggggacatgtcatgaaatgcccaaaatcatactagc

SEQ ID NO: 24651 - DNA, 1501 bp, Oryza sativa
tgactgaacaaagttgctggtactgaatctgctactttgtctagcagcagatcagaatatccagttagattacagtaatcagacaacagttaattgcttccattctcttcctctactgaaccaacaggagagaaacagaatggaagcgcggtaaaatgaagtcaacaactgccaaatctaactgagagaagatgcaacctcgttgctcctagtaactctcaggacctgaaaagaaagagatacagaacttgtaataatattaaggaaaaaagttttgccgtaccttgctgttcaccagtcttcctatccttgatcaaagcaacttcaacaacatctccatgctcctcaaataaaggacgtacctggagaaaggagaaatgtcttttacaaactggatagctcaagaagaaaatagaaggcaacaaaagagtgccaaaaatcaagtagtgaacaacaaattaaatgggtaaccatatgaattacttataatggatatgagatcagataaacccgaaactaagcaataggcaaaaggtagcttcagctagtttctaagtgagctttttctctcaacgtagatagtttcttagatgatttttgaccaacatgaatgcctatatttatattatcttctaagccaacttgtagaacttgtaagcattaagcctacggattgtttcagatacagcgatagctacgataaaacaacctcaaataacagattatagtcaggcagaagaatacaaattgaaagcagaacataaagagttaactaaggacgaaagagcagatacaacatcaagtggtgtaagtgtaacactcacatcatcctcagtcgctgtccttggaactgacccaataaaaagtttaacatagttgtttctgttatcatgatctgcaccgaaaaattagatgtaaatcatattttgcagatgaaagggtgtaaaacataagctctaaataattctccagtgaagcccacttagataaaacagtacatcgagatgctctagagcattgtattcattactactatcacaatccctacattggccctggttggctttgaactggaaaaaagaactaaatagtatataaaacaagaaacgtttagctgaacatgctataactgaatgctgaacctagaataaacagactctcaagtttcagaacgagacgatttcctagcccctcctgcaaccattaggccatgttatgaagtaaaacattctctacaagactaaaaccaatcaaaggtcgtcctccatgcaaaaaaagttaggtggtggctttgccatctagtacatacgtcagagccatataatggaactgtacactcgtgtgcagtgcgaatttcagcaagatatcccacatgcgaatattaattgcttaggttttccaacatccacagtaaaagttgatttactaagataattttcatacataagctaaggtacaaatcgtgaccaaaacacctcgtcacgtgtaagcagatcccaat

SEQ ID NO: 24652 - DNA, 556 bp, Oryza sativa
tatttattatgtagtatttattttgcaaccggattataactatcggctcgtttggttggagggagtttttaggagggattgggagtttaaagggatgaggctattaactgctttgtttggttgtgatacatgggaattttggtgggatggggatggggaattgacctgggtaggggtggtaattgggagggaattccttctttactttacctaaacaaatctcagccatccgttttgattaatgacctaatctccaactaaactccgtatcaattttcaccacatctaccaaacaagatactgggattaaaaattaaatttccatcttaatctcaccatcaattctctcgtgtaaactttcaatcccccgcatagaatttttccaatttgctggagtcttattagtttattttttatattagggtttaacattttgagtagatccgacggtggttaagatgcctagtactactgcataagtcgggtagaaaaacaatcatcaaaattaaaaaaaaaagaaaaaggaaaagaggaggcgacctccgacgtctatcca

SEQ ID NO: 24653 - DNA, 266 bp, Oryza sativa
tgcgccgaaagtgttattgaacatgtgttaattgattacatgggttcaggtcatatttatacccgagatacaaaatatgtccttgccggacacgactcttatctctaacaaactctaagataccataagtctttgcggcagacttttacccaaacatatctctaaggaaattaaataagatatcctaattaatagatacaattacctatctgagagctttatctccatcgtggcaatcctcatgaagcacgtccatcgattctaga

SEQ ID NO: 24654 - DNA, 1466 bp, Oryza sativa
tgtttaggtaaccccaagaaggaattccctcccaattaccacccctacccaggtcaattccccatccccatcccaccaaaattcccatgtatcacaaccaaacaaagcagttaatagcctcatccctttaaactcccaatccctcctaaaaactccctccaaccaaacgagccgatagttataatccggttgcaaaataaatactacataataaatatatggttataatattattacaacacaataaatactagaaatattttagagtaaattgcattgccgataaaaaaacttgtcaggtaggtgcaatctactgcacgaacttgcaaagtgctcgctttcgtgaatgaacttgtctggtgcatgcgaaggaaggcgaaaaggacacaacatggctaatcttattgatttaggggctggttaggaaattatgtaaacatatactatatgagaaggttattattagacatacacatcttcaataaaaaatagaataggatatagtgatagttgaaaaagataaaggaaaagagcaatgatataatggttagaaatatatgaaattcattatttccatgacaaaggataaagtagagaccaaatttataaatattacatgtcttatgcatgcatactcactacacgtaagcacgtcacatcctaatcaacgtcatcttcgtaaaattaacatggtcaagttattttggtcctcttcgcacggactagacatgttcatgtactgaaacaagcattttacaagtttatatactaaattgcacctacctaacaagtttgtgtaccaccaatgcaatttacttcatatattttattatgactcctgagttcataagagattttttagatgctggaataaaaccccggcaactgctcaacgagctacaaccaattattacaaaattcactcaacgatgagcacacactaacaagtccataataaacatacaaatcggcgctcatatgtgagtgtgatgacaagcaaccttgtgtgcaacggatgctacatctcgcctcgtgaatgtaggggtgaatgaaaagctcgtgactcgttagctctcttaactcatggttgactcggctcagctcgttgcggttttataacgagctgagttgacattttagcttgttggaaataacgatcccgtgcgagctaactcgcgagctaagaatagcccaatcctgccacttcatacgagcccaacaagagtaaaaatggcccaacaaactgaccactcctcaaaataaaggccctaactcttagtctccctcccccctaattccttgctccagtaactaggcaccagttgcataggttctcggagcagcatcgccacccactggcatttcgcgccccaagcccctagagccgccacaccgccgccccagcccttgagccctcgtcgtcaactttgcccattgctagtagcctccactgggaagtgaggtca

SEQ ID NO: 24655 - DNA, 660 bp, Oryza sativa
ccttctgggtcgtgccaatgctaggccgcttaattttgagctgggggttgaaggaataagtctatttacctccctcgttcttcctcctgattgaatcgcatccctcaaccgcaaaaccgggtataatgtctctcccatcttcgaaaatgggtgcaaaaaatcaacttttttgatggtgtgggaagcattatttgctgacatgactggtgggacccacataatcagagactctttctcttcccctcctcactcctcttttccatctttctcaacagcattgtaccgaggacgaaggcccaccacctcgggtcggcgctcgtggctctgtggcaaacggcgactgcggtgtagaccacgcgtcatcgtagcaggcagggatggggtgctctagcgcgaggcagtaattgaaggacaacacgaggacgcgtgccagggtgtagaggcggttggcgagctcgtgctcgagcgcatcctcaaccgagccaatgacgagcctaccgttatggaggtacaggatgatggggatcaacttcctcttgcagccgcagctgtcgaggttggggaggtagaggtgtgtccatagttttggtggccggggttgatggtgatgtcacggccctcatgccgagtcgattcatcctggccctggcgcctattagg

SEQ ID NO: 24656 - DNA, 1501 bp, Oryza sativa
gtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttc

SEQ ID NO: 24657 - DNA, 1501 bp, Oryza sativa
atgtcacgacatgaaaaataaccaatatgcgtcatacaacatgtaaagggtgaagttctagaatataagtatctggcatataacttgctggtaattattttgggcttgatgagtgccttctatgctcatccatctaaaaacaacatatttttttaggttcgaaagcaataaaggtttaacaatatcatataaacaatgtaattttaggttcaaaagcaataaatgcaaagcaataccatataaatatggttcgaaagcaataaatgcatatcaataagcaaggttcaaaagcaataaatgcatagcaaaccaatataaacaaggtttgaaagcaataatgcatatcgatgacatataaaacaaagtgcaaaagcaataaatgcatagcaatcttttagcgattattaatgtaaatgagtgaatcagcagaactctaaacatgatggagaaggaccatttatgatattttttggaaatcgtggtgataattaatatggtgtgatgaataattgatatgatgtatttattgtgtttaaagtgattttgtgtctgaattgaaatttccaaactagtgaatagcaatggtcaaacggtgaatagtaccatatcagactatgcatgtcttttttgcttttgaggttaaggtgagttttgatatttcaaagttcgatttcgatttcaacccctccctccctcccctctttcctccggtagggttgatcgccatgtttcaatcctacaattttcattttttcagtgattcaggacaagctagttcgcataaattttgcttatctatagtattattcttatatgcctgaagtgtttgtttctagtttagatcttaagtattttacttgtggacatgttggctttattcctgttatgtaaattatatcataacaactttgttacttctctttgataacttcaaatctttgacatgtacattgtaagatatttatacttgattcgaatgtaggctagattgccttgtcccaagcttgccacaaatggttccctgtctctggtttttcagttacccgtttatctttaccttgtaatccttgggatggagggaagagaaagcatgccactatcttctgaagtgtaagagcacccgatggtgatgccagtgcggagatcagtaggatgttttatatgtttgtactgaatttttttatgaactaaacaaggttactgttattttcatagcagtgaataatatacatcgcacttgttatgaaaagttcagtttaaacaaaaccaaatgagcaaaaggattatttacattggtggataagataaacaaaagaaggaaccaattgaatgctagtaataagctgagaatttagtgccatatagtatgttttgcttccctccatgtatgtaattatttgtactgtttattattgtccattttatcataagcattgtgctcctaaactacacctataatgggcgacatgttcacatacttcttcgcatcgtcatgttagtt

SEQ ID NO: 24658 - DNA, 306 bp, Oryza sativa
tcgaatacagcacaacatatgttgggccaacaagggttgagacccaacattctccatggaccaagaccaaatgtgtgcagttatacaaaataggaagcagtaaaataccttcctcataaggtcaattgatgataacttatttaatgtcaagatttaccactctgcctgcccaagtgtccatcccccctccctccctccccccgcttatttagtaccagcgcacaagcagtatccacaggtaaatcctttagccagagaaaccctatctcttaccagaatcaatcccctcctcatcggcggcgccca

SEQ ID NO: 24659 - DNA, 1071 bp, Oryza sativa
ttaaacatatcgagaaatcaaatcgcaaacaaagaatgcaccatttcgtcataaaagaaatatatgatgcctagataaattagcttgtacttaaaaaatgaaaattgacatttcttctaacattttggtccaatcaaggataaatcaagaagagaaaggagctccctgtaccaaaagtactacctaaccaaaagtagcataatgagaatatatgatgcctagataaatcagtatgtaattaaaaattgaaaattcatattcttctaacattttcgtccaatcgaagataaatcaagaagagaaaggagctccctgtactaaggcccagtttatttcagcttaagattattgcaatctaaattattaaatcagattactctaagctagattataataagctgacatagaataagctgcgagctatttgtttctttggattattggaggcatctaagggtagtgggtctttagccacccaataatctgaaaaaagctcctccaaagaagattattatattatagtaatctggcttatatattataataatctatcataataatctacttgtttgtttcagcttactcctaataattcagattataataatcctaagctaaatcaaacagcgcctaaaagtagtacctaaccagaattagcataatgggatggttttaatgtttcacaaaatgagacctggtaatatgcacatgagtagtatatttttcccaaaaggcagaaccagacctggtcgtcgataatcaaaaaaaaatattccttcattggattgactggcacatacaaatagaaaggttaggccctgagatttagtagcattgaattgttgatcctagaaagcaatggggaaaaataggtacaaaagggtcaggttgacatggagttgatgccatggtgcccaattatgcatgttcaagttttgaacaggagatctagttttgccaaatcaattttaaacctaataacaaaatacagccatgtcatatcggataacctccatacagtaattttcattacacaaaaattaaacttgtcccttattttttttaaacagg

SEQ ID NO: 24660 - DNA, 557 bp, Oryza sativa
ttcaaagatcggcctgatcaacatcagtaatgagcacagcaagtcttaggaggagattgttaagaataatccttgtgtgctgattagtagtagctctatatggttagttgtgcatgtctgcttgttttggcctaattggaggctatggttgctttccttgtaatagcttattttaagcaatggaatagtctggaaaagctgtcaattcagcagcaccaaacaagaccgtgttcctctgttcgcatgagttttttttttgtgtgtgtgttggccgtgatctcatcggcgacgtggtttacatcgtctctccggcgtgattatgacatagaacaccacctaaggttggtactactgcaaacaatcgacaaatggctcaccgcttgaacaggaatcgacgacgggggggctaggtcggagtcggagaaggcggtggtcgatctccctcctcgctgcatagatccgtgagattcttggggcattttgtagaagacgatgaggcaaaatcagtggcgcagcaactcagccggattcagcttaaggcgacgggaatggcgaca

SEQ ID NO: 24661 - DNA, 361 bp, Oryza sativa
tgagagggcaagtccaacccctatataagggacaaggccggttcattgtaaagatcaatctacaatcaatcaatcgaatcgttcttttcatattgctttcagttttctcttagtttgtccatctttgtcggtttgcgccgtaaaccgtacgccaccgctgcgagtgtgcgacacctctttgtaggtttgtcctgaaaaccttccgttttgcccacgagacgggtagttatctagaaatcagctccgctagccggtttagttatcaaaacccatctaggtttagctctttgctagatcgaggtggctggcgactctaggatcaccgcaagacttaaggtgatacgatcgtgcttgtcaactt

SEQ ID NO: 24662 - DNA, 351 bp, Oryza sativa
caggtggcacgattggcaagtccgcaagtgggagaagtcgacaaccactggaccaattccttcccgcgaatacccccttgactgtacatcagtacatcaccaactccatctccctttacttatgcatcgccaactccactgctccatgttgcttctgcgccgtctccgccgtgccgccatggccgtgctcatgctagtgtggtgcgtgtccgttttcttgctcctcccatctgccaccgcgcaggccaccaccttcaccagcaacgtcgacggcaaggagttcaccacattctccttccccaagttcgacaagcccctgttgcagctccccgacaacctgaccttctcagg

SEQ ID NO: 24663 - DNA, 1501 bp, Oryza sativa
ccggccgtcgggtggacctccgtcctcagcacgcctgcatgcatgccatcacccacaattaaagcgtcaaaaacacaaagcttcaagaatcaaccatggcagccaagatcaatggccgagaagacagttaatgccatttgatagatacttcctccgtttcggcttataaaacgttgtaactttgattaaaatcaaactactttaaatttaactaagtttataaacaaatatagtaatatttataataccaaattagttttattaaatcgataattgaatatattttcataataaatttgtctttggtttaaaatattattattattattatataaacttagttaaaattgaagcatattgactttgatcaaagttaaaacgtcttgtaatctgaaacgaaggtagtacctttaaggttgagggctttgagcaccttgctccggcatccgtcgcagcagttgacactcaccttcagctcaactctctgcatgaacaagtcaacagtaacttcataagattacatgaaaatcaatttgatgcttattattactaggtaagcgtttttaaaatgtattatcaggtagctttgctctgttacggtacataccttgatgagctgatcttgttccttggccatgaaaataacaagccctgtttgcaaacagagaatttcacaggaattagttcaatattcatgcaagaaacggggtgtttcatctgctcagtgacaaccgatggctagccgtgttgatatcttgctcaatatatatggatgaagcagcctgatgattgaaaattaagatactatctttaaaacattactactaatcacaagacatggattcgctagctagctgtatcagcatattattatacattattttagagtatttgagcaggtatatacctgggacaactcaaatcagctcaacatgtagttttgattcagagaggagagtaccctaagctggcttttgatctgtatgattaagtacaactgggagcacaaatgccagtattaatcattgatgcttgtttagggcaaagtattagtgccagtgtagagaaaaaagtggagccatctgtgcggttatgcatgataattaactagctttaattaggtgaagcacatctagcatataaaagaaaccaaagaataaagcaacttttctccatttgattaaactaaagaaaagagtattaaaaattggtacaattcaaaccagatgaaaagtagccaaaagagggggatgaacatcttgccggtcagggcctcaggggcagagccagagatttgcaacccctagggcagagtaatgtatttaatcctagacacttcaattttcagtatattttgataagatttcagtacaattttgaggcaagtctacggccaaagcccaaggtgcccatctttatctccgcccctgtttgtctgtctgtgcttcttaatttcttagatagtccatctccatattataagtcgtcattttttcaaatc

SEQ ID NO: 24664 - DNA, 215 bp, Oryza sativa
aaaacctgctgaatttctgggctatggtacattcatgttctcgtaccaaggtttgcagtcactttacttagaacttacctctactaaaatctgcttcacttactagaagaagtcgtttcgctgactggccgaaccgtgcctgtcggggtttgagtggcactattttcttagagatagtaacagctatgcatgaactcatacaattgacgccccca

SEQ ID NO: 24665 - DNA, 1501 bp, Oryza sativa
aaatgatgattaagtttgttgaaaaatataacaatatttttaatacaaaacaaatatattattaaaatatattcaatgttagaattagtggaactaatttggtgttttggatgttgctaaatttttctataaatttgatcaaacctaacaaaatttgatttgaaaaaattttttgaacgactcgcacaagacggtgcgaagttctattgatagagcaggaaaaaattacaagattacaacccaggagggttgtaaccaggaaaaaggaaaaaactataccaccacccacacgccgacatcgctaacacacaagcccaggagaaggctaacaccggaccggccgccgctaagcgtgaccgaccgccactagaccaacaaaggaacacagacgagaacgccccctagggaaatccacgtttgaggcaccgatgctccaccaccacacaagctttgccgacatgtgagacccctgcaccggcgtcccccgctggccagccttcgtgcgccgaagaccaccacacccaccggcagctcctcctcacacctaggtcgcctcctccaccgccgaccgcgcctttttgccccaagccagcctcctccaccggacgcgcctctcgagccgatccggcctccctccatcggctgcgcctctcgcgccaagccggcctcagctgccatcggctgcgcttctctgcaccaagccggtctccgacccctccaccaaacgatgccgcgccgaccagatgcagccgtctcccacgccctcggctagttgatttgaaaaaatgacgacttataatatggagatggactatctaagaaattaagaagcacagacagacaaacaggggcggagataaagatgggcaccttgggctttggccgtagacttgcctcaaaattgtactgaaatcttatcaaaatatactgaaaattgaagtgtctaggattaaatacattactctgccctaggggttgcaaatctctggctctgcccctgaggccctgaccggcaagatgttcatccccctcttttggctacttttcatctggtttgaattgtaccaatttttaatactcttttctttagtttaatcaaatggagaaaagttgctttattctttggtttcttttatatgctagatgtgcttcacctaattaaagctagttaattatcatgcataaccgcacagatggctccacttttttctctacactggcactaatactttgccctaaacaagcatcaatgattaatactggcatttgtgctcccagttgtacttaatcatacagatcaaaagccagcttagggtactctcctctctgaatcaaaactacatgttgagctgatttgagttgtcccaggtatatacctgctcaaatactctaaaataatgtataataatatgctgatacagctagctagcgaatccatgtcttgtgattagtagtaatgttttaaagatagtatcttaattttcaatcatcaggctgcttc

SEQ ID NO: 24666 - DNA, 1501 bp, Oryza sativa
ggctgatgggcacatgacttagcccagcattctcgcttacatatcttatgttgttttttttattaagacgtggattttaccaaggattttattagtatgttttctaaaccgctaaacaatatgtttttcaaaaaattatataaaaataattttaaaatatcaaataaatttatttttaagtttgtaacaattaaaacttaattaatcatgtgactttttcattttacgtatgctaacttaatctatatccaactctattttaattatatgttaatggcttttttattttaggtagactatcttaatcttcgtccaactctattttttaatttttaagtttgtaataatactgcccaacacggccaggatgaagcgtcgatctgaatttctttttcaattttgagggcactctccttctagagacactcccttatgaacggagcatcgaatttgggattgtggcaaatggcaatgcaccgttgctgtgcacaggtgccggccgggcgcgcttacacggctacacctaacacgcctacactcttttttctcatcagtcatcagaatacttacacgtttacatttgtgcttttgacaatcctagtaggttataattagtactaagtgcttagccgatgaacgaaatgatgaccaacaccaccgacacaccaccaaaactcttgtatggatgtttttctgttgtttgcatatcatttaaatagttacaaataaattaataaaaactagaagatatattaatatgtgatatatcacttcataaacacgtaacttaacatttaatttctacttgtaagtttaatttattttttgttgtcatatacagaagttaaattttaagttgtatgtttgtagagtgatatatcacatgttaatatattttttaaaagctttttataactatttgagtagtatgcaagtaaggagtggaagtaaggagtggacgttcaaaactagtactcgctaaactagtcgagatctctttttctctaccgctgcgcaacaacatttgattgaaccatcttacgatgctttttctcaggctcatgcagccatgcttggatgcttgcgttgttgagacttgagagcacggcacgtatgcgaacttgatcaggtaggtcgtcacaaacgcggcgcgcgtcgacgagaggccgagacaaccacccacccactagcgcgcgcaccgagcgagctatctctccgctcggtctcggtcgatcgccgcgcgcgcgggtggccgagcttgcacggcgccattggccgacgcgagccggtgaggcgatagtgctcgctccaccactctccccgaccatcatgggggtgtcacctcacctgctacgcctgtatatatataaagcaccagcagccatgaagcccatcaacgaaaaactacgtgacagcgtgacacagggggtagttaattactagttattcgcagtgcgtgcgtgtgtgtgtgtgagcgatcgattgatcgagatcgacatgg

SEQ ID NO: 24667 - DNA, 1501 bp, Oryza sativa
ttatataaaataaaataatattatcaacacaaaataaacaatatcaaaatatattaactgatagtttaatgaaacaatttgttgttttagatgatagtaatttttttatcaaatctaaaagaaaatttaattaggaaaaagtcgaaacaatttataatataaatcaaagagggtacatgatgtcatttatttttttaatacatgttttacaatttattttattttaaaattttatgtaaatatgagaaaatgtattgtgcttagagattatgcttagagtttctttaataattaaatcaagacataactaaataaataataattatgtattttttaataagatacattattgaacgttagtattaaaaagccaaccacgaccatctattaaaaaccaaaaatagtatttcgaacattatgaaagttcttttcttgtacgaaaatctctctcctatgagagcgattgagcgaataaaaaaaattcgccaagaaaataaaatatagctagttctgcacgtaatgatcagttgatcacggtcacgggatctcatttttgtgaatctgaagaagaagaataatggtcaccatggattggaatgttgcgtgcacgaaacacatccgatgcccgtgccctattgcgcttcctcgcttccatttgtcaactcccaaattataaatcacctcgtaatttctcgcttaattattccaacttgggcccatgattccaatccaagcccattaaatgcccactcataatttctcccttgatttgtaaagaaataagttcaccggaggtccctcaacttaacagcgagatttttttaagaacccttcactacaaaaccataaatgtgtgcccttaaactcacttaaaccgtgcactcaagatcctatggcagtatatatgggtgatttcactgacgtggcatcctagtcagccaaaaaaaagtatgtggggcccacatatcagctgcatattttttcttctccttctcttctcttctcgagcgtcgaagcggcagcgacgacttcacggcgctccaagacgcggagcttgagctcacctccgcaaccaactcggcctccgccgtccttttctcccgccgtcgtcgtcgcgccggccggctctctctctctctctcccgccgccgcgccaaccacctcctgtcccgccgccgccgtcgcgtcggccgcctcctctccttttctccacgtcagcgaaaccacctatatatatactgccataggaccttgagtgcacggtttgagtgagtttagggtacacatttttagtttgtggttaagggaccttataaaatctcgctgttaagttgagagacctcatgtgaacttattccatttataaacatgggcccctaattccggcccacatacatcacaaggcccacttaatcttcggcccatttatttattcttacaagcaaacggttaaccccaaaaaaacccccacttctcccaccgccgccgccgccgccgccga

SEQ ID NO: 24668 - DNA, 326 bp, Oryza sativa
tacttgaatataaaattcgtgtgattaaatgttaaaggggaccaggatagttttctcctactcatatttctttcaaccaatgtagtgcttttatacatccttataggatattgaaatatcagatcgaaatcgagaatgcgatttcttggccatctcctcgactcaggctgagcttaaatcagcttctccctacgttttccgaaaggggctgtctatatatcatgtgatagaaaatcccacctcctatcattcaaattttggaccattggatatgctttaagattcatgcagccccttaaccctactcctcctcctcccatttcagt

SEQ ID NO: 24669 - DNA, 1501 bp, Oryza sativa
aaatgtccgaagtgccctccaaccgtcatcaagaatgtatctgggacgtccacgccaaaccacgagatcaatggtggagagatgggttcggccgaaccctggcatggcccaacaggcccagaatttggcctgtggatgcttcttgctctaattatctgtttcttgcaattttgggctgattctctagtattttgatgtagtctaaagcccatctcttgtatggatgggttctttcttcactttagtctgatttccctcccaactttggtggtttatgacctgcatcaaataaacaccaacacttgtggaatatgttagaaataaatcctatcactatgttggatgtcttattatctgagttttatgcaggtattagccgtatgaatttagcacttaacagccgccaacagatcccgacatgtggttgttggcaacagtgtccaggacccatgtctctgcatcgcgctccttctcctcatccaagtgggcaagcaccttttcttccccgagcaggatctaggtgccggatgccaccgtcgtcgcctcaggtccgccggatcccgtcgccgccaccgagttcctattctgccctccgcatcactaggtcggcctacaggagcggaatcaccgacgagttgcgctggggaactccaaggggcgatgttaccactggtgcgggcagcgccgacgcgctcatgtcttgcagggataccgccaccgcaggagaaggggatagagttggcgacgatttcaggagaagcagcgcggcctcccctttcttctggacgacatgggccacttctttcttgggcttcgagtggcactcgcgagcccaaaggcccaacttggcaaaccgcctacactcgttgcatgtgcacttgctagagttggatggcccacttgatgatgagccttttccattgccatgaccacgcccacaactgtgttttcctcctccaccttgccctgtgccgccgttgaagccgttgccggagtggttctctgcttccagcttctcgcatcgtgcgtcccattgctcctcagtgaggtacagcaacgctggtggctcctcgtctgcatcttccactgccggagccgcccggtaaggccttcaacggtgagcatcgacacatccagcaaagttgtgatcacgaccacgatatgcttgagatgttttggcacgctgcggatgatcttgttgacgatcatgctctcctccagcttttcacccaaagtagctagagtcgcggccatgccgttgaagtgtagcacgaaagtcttcaatggcctcgccatcgttgaatgttgccagatcgaacttgtgtcggaggttctgcgccgccgtcttcttcacgcggtcatccccaacccgcatggtcgctatcgaggagtgaccctctctagcgggagatcgtgagacccccctttcgtgagttcggccgggggaagaggctcgcttcgggagataatgtatccaccctgaaccctgcaaaaacgcaca

SEQ ID NO: 24670 - DNA, 1501 bp, Oryza sativa
gaatggcataatatagggctcatttgcaaaagcagcatttagcaaacatttgagaattataaaacagtagagtaattaatcatcaattttaatcaacactaaacagcacacccatgctgctcaggcccaaccatcctgaacaaccatgcccggctgtacagatctatctccaaaccaggaatataccattccaaaccaggagctaaacaaattattaccagttatagcatcttttattatggtgagaagtgtgaaactactcacgaaagacattgttagacccgcccataactgcgggcacggctattcaaatagtttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaggagcaaaacaccaaaacagcacataaacaagcatgaactgtacatgtggatatttttaacatgtagatctcaattttagaaaaatttagagacttgaaccaactaaatccgagctagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacagaaacgaacggctgaaatctttccatccaaaacgaacggccgagatcgaccggtccacggccggaccacgggagacgacgacga

SEQ ID NO: 24671 - DNA, 723 bp, Oryza sativa
tatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagccaaggaggtatttttaataaatggaattgcatttcatgagtaatttaaattggaaaaggttttaaaagtctcttttggctttgggcctaaagtcggcccaaaaccttctctctctcctggcccagtccggcccgaagatgagccggccgctcgcgcgcgcgcgttcgcccgctgataggtggggcccacctgtcagggccgtcgtcttcctcgcgccgtcgcccgcccgaaccctagcgccgcgtcgccgtcgtctccttccaaatccagccgcccctttccatttccggtgaaatcaatagaggggaaatgatcttcgggatctcctctaccttttctcttttggaatcgtcggctaaatcgtttggaaattcgcggattcgatctcgaatcggattcgtctctctctccttcgaaccctaatctttccttctcgtcgccggtcgccgtgggccttcgccgccgccttccaacccctataaaaggacccccccaagcccgccgctacctgccgccaccctcgccttcgcctctcgtcaccggtagagccctagc

SEQ ID NO: 24672 - DNA, 1497 bp, Oryza sativa
ctcattttgtgaaacattaaaaccatcccattatgctaattctggttaggtactacttttaggcgctgtttgatttagcttaggattattataatctgaattattaggagtaagctgaaacaaacaagtagattattatgatagattattataatatataagccagattactataatataataatcttctttggaggagcttttttcagattattgggtggctaaagacccactacccttagatgcctccaataatccaaagaaacaaatagctcgcagcttattctatgtcagcttattataatctagcttagagtaatctgatttaataatttagattgcaataatcttaagctgaaataaactgggccttagtacagggagctcctttctcttcttgatttatcttcgattggacgaaaatgttagaagaatatgaattttcaatttttaattacatactgatttatctaggcatcatatattctcattatgctacttttggttaggtagtacttttggtacagggagctcctttctcttcttgatttatccttgattggaccaaaatgttagaagaaatgtcaattttcattttttaagtacaagctaatttatctaggcatcatatatttcttttatgacgaaatggtgcattctttgtttgcgatttgatttctcgatatgtttaagattgaagtatttccttgttgattccttactcacagctgaacaaaaaagactccgagatgctatattgagaacggcttgtctatatgatggaaggaatcactatatatgtgatgactgacttccaaatatgcattacctgtttctattgttgacccatgactggcttgtacaattagttcagctgaagttgtaaaacaattattacagtttcactccatatgtgtctataatcattttctgtgtaatctgtaagtattactatgccacttgtaagaaaaaaaaagtgatgtgactgtaaaaaataaaaccaatgcttaattcagctataaagacaaatagaattgcaccgtagcgtttagcacgggcatattactagtaaggagtaatggataaatgattgaggactgttcagaagccaaacagacgcgcgactcttctcgggaattcacttattgtgacttttgagctagcctatgtccagtaaactcccaagacctttcattcccatctaggagggttgttcctaatataaatatcccctatattttataatttagggacttttgacaatgagaatatgaacccctttgtttagctgtgtgctaacaaattcagagagagatctttacccctttgctcttttaatttccttatgagattatagaagcggcgttcgacgccacccaattggtgctcctggtccctttgaggatttttcctcaattgattctaggttgtgttggttgataacttagagtgtggttgggcgaaccctcgattcaagttgccgtaatagaggcggta

SEQ ID NO: 24673 - DNA, 278 bp, Oryza sativa
ttaaatccaagtcttcatcttccccctcgattcccttttctgcttctcggggtttggtggtgttctagcaggcagttcgttccccacaaaattctaagctcacccttgctttcttctcccccttgttcttgactaggattttcttttcatttccgtaaggaaaaggagatcacgagttagcaatcttgtgctcgcgttaatttcattcgatttgtggattccgaagatgatatctctgtgaattcgaaagggtcaagaagattgtttatcagtatcga

SEQ ID NO: 24674 - DNA, 1501 bp, Oryza sativa
tagatttatatatagaaaaaagaacgtgctacgtgagccttacgttctgcacgcgcgacgaaacaacgactacatatacgtcgacctctttcactggtgatcgccctgcaccagaagatctgcgccacaaaaacagccgtgagtgccatgagtccatcgatgtggatccatccaaactcttgagtccccaaacatatactgctccggtgcaatttatcaattaagatttggttcaaactttgatctgcaaactacttttgctgttttttatttaagaaaaatcccgttcaaacttccaagttgtttcgtttctgatatgaaacgacatcaactaattaagggctcagctaagccatcggatgacccctaagttcacttgcaccaaggtagatcgagtaacttttgttcacaacgcaagcaaccaatatgatttagcatggcactctataaacactcataagtcgaggaatcctatagtatcaatattatagcccgtgcaatgtaaatttgaggaatcgtctagccaaaaaataaatatattattatatattatatactaaaggtcgattaaactttctacaaacactctcaaaccgccacgtgggattcctacaaaagcttctaaaccgccacgtgacgctctaataatttctgagaaaaaaagaaaaatatctaaccgtttatttttaagttaaaacagttgacccggtaatactaaccattatattaaatccaccgatccgatcacccttttatcttagagctacaggtacgtataaaacgtacgaaccaccacatctgctcctcccactcagtattctctttcttttttattttttttattaaggttatgcaccataatttgttactataaaaattattagatctatttttacgtggaactttaatttatatatgaatgatcttggtgacataaataaataattacttttttaagccaatctacacattcaatttatgacacgcttaagcgaagccatccatgacaaatcatttatgatagctctcatactaatgaacggatcaaaacgtagaatgtttgagatatgtctgtagggataatccatcaaagaagtaagatcatctatgacaagtgtagttttgatgaattacgcatatgacctaacagatgataagtctccgctttcctcacttcctctctcagttttctagctaaaaagttaaaaaaaatcaataattagatggctaaatattttttaacatatttgattttttttgtttgatccatattgaccatgttttggtacataatattatacattaaaagtccatgaaactttctagaaacgcttctaagctgccacgtataccctataaatgctcctaagccaccacgtggcactctgataaattagagaaattcttaaaatctcttagaaaaaggcaaaaactattgaatttcatttaatccagtggacccaatatttttaaccattagatcaatctctaaaagagacgt

SEQ ID NO: 24675 - DNA, 683 bp, Oryza sativa
atgcttgtgagagcaacatcgtatgttctcctaaatcccgagtatgttactttttctttatattcagccaagtgaaacacaatggatgctcaatgtacgttcctgaccaaaatccagaactctaaaggccatctttgtgcacgaaactctgctgatcgggccaaaccgcttggcttttggttcaagctttttaaaaaactgtaactgaattttacattttttgtccagatttgtctggcttatgtcagtttatctcgcggaatccgacgatagcgatggattgtgaatctgatccggccgtccaacttgaatcagacaccatataagatgcctttttgtgggtgggaaatcatttccatttccaatttagccaaacattgcctcaggctgtgagcctgtgaccccaccggtcagtcggccaccgccacctttgcgccatactgcctcccatctctcttgtcaagtcgtcagccagccagcctgccccgtcgtgcctccactttcccaccaatttaacacgattccaaaccacggactccatctggaccgtccaccagcgcatcccacggtcacctcccgtccccacgtttttctttacacccacgcaaccaccacccaacctcaagagagcacgtcgcgtcgcgggctcgcagccgagttgatctgccgatcggccggcggca

SEQ ID NO: 24676 - DNA, 1501 bp, Oryza sativa
ttgttttgactaattattgtacctgagaatcatttgcttctgaaccactatttgtaaagaatatttttcccatttcccttgcagtgaacatgctgagaatttcattagcaagatcctgaaattagcagtataatcatcaagattcagaaaccaccaatttttaacagaaacaagggaactactaaatgtgatgtaatcaattgtagcatcaaattttattcctatttggaagatggtgaaactaggaattatcaagtaaaataacaagcacactgttagaaatataacatcaacaacctacggttttaactatattcctgtaaagatagtgagataaaaaaggtaccaatgagggtttggtagtacggttccaaaaggagtggtagaagggtaatttgttcaattgatcagttgcagctttgatcaatcgaggctcattaccacctgaaagcaaagggaattacgcaaagaaaacaagacaatatacaaaggacaatagcaaagtttagtatatatgcaatactacatttgttacatatgcgggaaacgagttttactagaaagtaggaacaactttttggtataccacaaaaatctgaaaatacagcttgaactggtgcacatacccaatgccgtagaccacaatcctgcaagagcatctatgtacttcttcccattgatatcataaacgtaagaaccctgcaattcgttgaatatgatataagataaagctagaaaccaccacattatgaagagaagtcaacatggaaagctacatgttctaaatcttgtgctataatctgagaatcaatggaaaaaaattttaagacaattccaaattgcagaacctcagatctgtcaataaccagaggatgcaaatcggtgctctgccatccagcagtgaatggggccagcatgccatgccccttgaacctgatacaggtaaaaaatgttgcagcatcagtggtagataacaagaaatttagactagatatgtctatacacataattatgtgataattctgcacataaaacatacccattttcttctgtcgagtcgacctgaagagacggttcagagctgaaatatctggctggtgcctctgaggaatattttggcaaacatccagtggcagctacatgttttactatgttgcttgcctatgtgaggaaatagatgaatgcagaatttaggtacatgagctgtaagaaatgctgactttagaataatgttaagagttcaaaatcgcttcaaactactcgagctactctcagagcaactgttttgaagaaaactctaatcttgagcaaaaccattactgcttaaatctgtacattcaaggttttttttttaaacaaaacaaagaatgaaggcaagttgctgataacagcacaacgaaatgatcaggaaagcagggtttagagagttgctctataattgctcaaaaaagcataaacatcttaaatctgactaaacataacatctgcagcaggcaaatta

SEQ ID NO: 24677 - DNA, 704 bp, Oryza sativa
agggcgaggtccgggacgcggagggaggcctcgaggaactcggcgaggacgagctcgtcggccgccgcggagcgcgcgccgcgcgccgtccggatcggggtcggcggcggcgcgcgcgcgggggcgcggacgcggggccgccgcggcgccctggacgtcgccgtcatgccgccggccgatcggcagatcaactcggctgcgagcccgcgacgcgacgtgctctcttgaggttgggtggtggttgcgtgggtgtaaagaaaaacgtggggacgggaggtgaccgtgggatgcgctggtggacggtccagatggagtccgtggtttggaatcgtgttaaattggtgggaaagtggaggcacgacggggcaggctggctggctgacgacttgacaagagagatgggaggcagtatggcgcaaaggtggcggtggccgactgaccggtggggtcacaggctcacagcctgaggcaatgtttggctaaattggaaatggaaatgatttcccacccacaaaaaggcatcttatatggtgtctgattcaagttggacggccggatcagattcacaatccatcgctatcgtcggattccgcgagataaactgacataagccagacaaatctggacaaaaaatgtaaaattcagttacagttttttaaaaagcttgaaccaaaagccaagcggtttggcccgatcagcagagt

SEQ ID NO: 24678 - DNA, 1501 bp, Oryza sativa
tgtaaaataatgggtccaccagtttaagtgaaaaccgaaggctagatgttttgttttttattagaatttctagggatttctctaatttattagagcgccacttggcggtttaggagcgtttgtaggaagtttcatggacttttagtatataaagatttgacttaaaactaaaacatcttatattttcgactggatgaagtaacgctaaaaaattttcaggaaaattgatgcatcattgtactcgctaatccttgcaaccactgattcgttattcaatacaagcaactttatttctttagacaaggaatagctccaaaaatgaacccagccacgatcttgggtcacattcagcttgttcacatgcaccctgacgtttcctgcggggtgcacgtatcaatttgcccttcgttccccgcacaccggagccatcactttcaagaacggacggataatttccaccacgtcctcctctccacatccttttcatctcccacctcctcactcctcgtcagttcgtcacttgcttccaagaaccccgtgacaaggcgggaaggaatccgaatcgcagcgagatgatttgccgcagtctcctccttctcagatctaatgcggcctccaaggtgatgttgattaaattctgcatttcttggaggtttttactgcacctgcgtcactgcttgtaacaagaagtggaacggttttgatgtttccgtcttcttgttttttttgaatatttggaggtagtattgtatattttttgcactgtggaattgatttttgatccctataaaggctcaagaacaacagggtgttgctgttagtaagcactaagcagggttgggtgggtctgtttgattcgttttgcagccttagaaaggtgcagtcttttgttaatcgagaattggttaataattggagcagtcgtgtgtttgtgatttcatttattcttttttaatttgcctgctgcagatgttatgtttagtcagatttaagatgtttatgcttttttgagcaattatagagcaactctctaaaccctgctttcctgatcatttcgttgtgctgttatcagcaacttgccttcattctttgttttgtttaaaaaaaaaaccttgaatgtacagatttaagcagtaatggttttgctcaagattagagttttcttcaaaacagttgctctgagagtagctcgagtagtttgaagcgattttgaactcttaacattattctaaagtcagcatttcttacagctcatgtacctaaattctgcattcatctatttcctcacataggcaagcaacatagtaaaacatgtagctgccactggatgtttgccaaaatattcctcagaggcaccagccagatatttcagctctgaaccgtctcttcaggtcgactcgacagaagaaaatgggtatgttttatgtgcagaattatcacataattatgtgtatagacatatctagtctaaatttcttgttatctaccactgatgctgcaa

SEQ ID NO: 24679 - DNA, 1001 bp, Oryza sativa
cggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgc

SEQ ID NO: 24680 - DNA, 513 bp, Oryza sativa
cagatccaggggggcggtgagccagagtgagtagaggcggcgcgaggagaaggagaaccaagacccctatgcaacttaaaaaaaagttactacttacatgtgtgccacaaaaaagtttagagtcacctgtatgtcatgagaaaaactttcgttgacccgtgtgccattccgtccaccttctgttagaacttaacagttccatagctctgacatgtggggaaaatgactaatttgcccctgaaggattttcagctctattcctcctttaatcctcctcttcatctcttctttcttcttgcacacagggagaaggagagagggcgtgagcagaggagagggaggagccccggcggctggtgcttgtcggtgacagcggccggaggtcgacgccgggaatggaacggcggcggccggggaggcaaaagagggaggcggccgggaggaagagagagagagagagagagagacgacggcgggcggtggcacggcgtcgtgcggcggcggtggaagcaa

SEQ ID NO: 24681 - DNA, 1501 bp, Oryza sativa
taacaagggagtagaggttaggaatcttgagttaaagattatagcctaataatggggaaaatcaactcttggcctccagcatctagttttaattatccaatatgatttgagataaaatctctaatgtataaattcttactcctattgtccttttattaccgatatgatctcgtatctaatttttactgaacatttttatctgtaaggaaatgatattggttgtgtttagttcacactgaagtttggaagtttggttgaaattggtacgatgtgatagaaaagttgtgtgtgtatgaaagatttgatatgatggaaagttggaagtttggaaaaaaaactttagaactaaacagggccataatatagcacatatgctgctctaaaccttagtactactgttagggactactcctagatagttctgtggggaacaaacagaataacttaaacaaagtcaagaacaaaatctagatctcatcaataaacaaaggcatttttcttctgagatgaaggaataaacaaatttagcaacagtacaatcaccaacataataaaatgattactcctactagtacaatagtagcagtggcaggaccagggacttgccagctgaggaaagacagtacacactcatgggcaagaatccaaagagaaacgtttacttctcatttccatagcaccaaaacttgactgccgcttttgatttcagaagaaattcggttggaaaaaggtactcttttttttgtttgaattttcaattcagatggcctaatttcaattccaattccaatttgtgtgctcctccacctactaccatccagtccaggcatatgctcttcctgcaacttcttttatgactctgcatattgccttctcttcccccctctctctctctctctctctctctctctccgcaccataaatcatttctcatttttttccccatcctcccactctcttctgtcaagatttctgcgcttttgccaattggacggcggcccacctcggcggctgtgctgttggtggcgactgtggcatcaaagcttgatcttggggaggctttggggaggaaagattgagattttggttggttttcttggttctagaggaggttttcttggttgatatttccgggtagctcgcccaatcagtcccaaatccgattttctgggctctgatttggagattatttttctttagctgtgattattggttcttcgctcctgtaccaaagctcccgtttttggttcttgtggggatcaaagagggagggagttcgatcttggaaagagtttaagtgtcaagattcgaagtggcattctgatttggattatgcaagctcatgttcttggattatctcttcgaagattagcctttgcgtagaccaaagtgacaagaggttttggtggtggatttgaggattcgggttggaattttccggtgagagagagttctacgagttgtggttgatctttgcttcggtggagaagctctggagttc

SEQ ID NO: 24682 - DNA, 374 bp, Oryza sativa
ttatataagcatatcaagctttagacagtgtcggctagactcctgcccttcatgcctgatttctatttgatatgtttatatggattaatttgtttatatagatttgtactagagtattagctagtactttatttttcatgctctaaatattatctcatcgtctactttcataatgttgtcttaaatcaatctattaaactccatatacagtattatagccttttgggcgtgttgagagtttattattctttgatatatccagtccatagccaatttggtttaactctatctgctgagaccatcaacgatacgctatcggccgattggctattggtcgactgattctgcttttattctttcttgctgattgcagg

SEQ ID NO: 24683 - DNA, 196 bp, Oryza sativa
ttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctagg

SEQ ID NO: 24684 - DNA, 1393 bp, Oryza sativa
tatcgttgatggtctcagcagatagagttaaaccaaattggctatggactggatatatcaaagaataataaactctcaacacgcccaaaaggctataatactgtatatggagtttaatagattgatttaagacaacattatgaaagtagacgatgagataatatttagagcatgaaaaataaagtactagctaatactctagtacaaatctatataaacaaattaatccatataaacatatcaaatagaaatcaggcatgaagggcaggagtctagccgacactgtctaaagcttgatatgcttatataaaaggatctatctatataagtggggaatatacatgaaacagggagtgaaacatgcatattaggtaagattggctgaaaccccgatactatcgttattatgcctaattgcaggctagtttgcatggttctaagcacaactagggatgatgcatctcaaagtatgaaaaagaaacattcaatctagacaatcaagcaattagacacttttcaggatggtagatgcctcaactaatctcactcgccgcggtgtagcgtctgttgattaattgagataggggcaaattaatacttttctcgttgtttctctttcaatctgcactagatataataaaataaggggttcggtatccggtagctaattaccaggtttttgcggtatcctatagccaattcacgtatttgcagtgtctgacgggtaattacacatcttttaggtgtcctgtagcaaattttgccatcattattatgcctaattgcaggtgtttgcatggttctaagcacaactagggatgatgcatctcaaagtatgaaaagaaacatgcagtctagacaatcaagcaattagacacttttcaggatagtaaatgcctcatctaatctaatctagcatgccaatttaaccgaaaccaacataaaccctcaagcgagcagcagccaatagagctaaattgagaaggtaagattagattaactaagacatgctagcaaagactcgcgatatcgagcctaacacgtctaaagcgacatgttagccctgatagcgcaggccattgagacgggttacctcttgcgaagaactcgctagaaaacgagaaaaataaacgggtggcgatgcgtcgtagttgtgttggattggctctcctattacaatgctatggggttcatatttatgctccgagtacaaacttagtccattatggacacgactcaatcatttctaaagttaagatacaaacaagaccatatacagcagtctcttaccaaatctctaacaaaccgactcaatattctaactaatagatacaattgccttaattgagctctatctcttattggcaatggcaattatcccaatctaggccca

SEQ ID NO: 24685 - DNA, 703 bp, Oryza sativa
ttttagattcaccttgttcatcaaaaaggtaggggggcatgtgtttacactcaaatttggcacctaggaataaaatagggaaagttgccaaagtttggaagtctactggtgttttcctctggaggacggtctgaccgccgtgtataggcctgtcagaccaccgcttgaactccggtcagacaagtggtgtgtggtcggtctgaccggcagagtccaagtccaggactgtttcgtcgggtcacgaggtttccttgctcgggaaggcatatttcgggtttcctttggattctatcccgagttggacgtggaggagggcctatagagggcaagaccaacctatatttaagggacatggccggttcattgtaaaaatcaatcaactatcaatcaatcgaatcgttcttttacttttgcttctagttctagtttagtttgtccatctttgtcgatttgcgccgtaactcgtccgacgccgctgcgagattgcgacacctctttgtaggtttgtcctgaaaaccttcccacgagacgagtagctatccatcgttctacctagaatcggctccgctagccggtttagttatcaaaacccatcttggtttagctttggctagattgaggtggttggcgactctgagatcgccgcaaggcgtttaggtgctgcgatcgtgcttgtcaacttgtcacaaaaagttgccaacaa

SEQ ID NO: 24686 - DNA, 250 bp, Oryza sativa
gagataccaaaacccaaaaaatgttccatttaacttttgtatacaaacctgtagattacattcacatcatctgagaatttctcattttataaagcttgctggccactttgtatcttagagaatttttttataatagtcctggaattaatcatggtaaccatgccgtgaactacggttggtgctcccaacatgtaacaaactgcaaaagagcaacttaatttatgtatacaatttgtggccctgcatatta

SEQ ID NO: 24687 - DNA, 633 bp, Oryza sativa
aattatctcgttgcaaatattgactagatacaaaccaatacgcaagcatgcaacctatgcaaaaccgtcttcttggcacaaatggtaagccgattttgtctttgggtgcatacaagaaaaagtaaagtacaaaacagaaatgaagcattcatttgctcaactacaaaattcaagccagggggtacacaacctcaagacacgtacggttgagaacttgagacaaaggcagaacaaccacctcattggcatcatcgatgatcgatcgatagcgtgcgacacaaactcatgaaatgcagaaatgtgtgtgttgtattgttagaaaatgacatctccaccatcgattttaatttattagaaagatatacacgccatatactcttattaagtggttttacgagtgccgatattaactacaacagtatatatatagatcacaagactcatgaaaagcatcataaaatagggttaatatgtttttctgaaattaacacttatatatagcaattgataactcgggcatccgttgttatatcggagttttccttaatttacatgagaattaaaccgcttctaatttattaatattaattataaagatgcatataaataatttgttaatcgcgaatttgaaga

SEQ ID NO: 24688 - DNA, 440 bp, Oryza sativa
cgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatga

SEQ ID NO: 24689 - DNA, 1501 bp, Oryza sativa
ctcaaaagatatttaatatcgacacatgtaattaggtaataagggtaaaaaaataatttttctaagcgatagagaagggtacctcatctccaatatgttcgatgattttccatactttatttacgtgttctctttttagatttacactcttttcctaagaacatgatcgccggtaatcctccgttacgatatttacgtattcttttagatttacattttctccctaagaacttgattgtagtttttttaaggttgatattatgttcctaatgataccataggataaaatatgtctgaatgtttgcgcggttattttaagatttatattttatcacaaagaacatgtaacctcggtaaatcactggtttgcaggttaaaatgtaattcatcgtcaatacgctatatttacatattctccccccaatgaacatgaacatagatacaaagtcttataaagatcaaagtacaacatacgatggtaagtgaagaaggaatggatttgtgtttttatcatgcagccatgttgtttggcgcaaaaaaaaagtgtctttttttattattgtgttgatcaaagtgcaatcgctactattgaggaaattctttttaaaaagatgttttctctttaattctacagtaataaaaagaaaaaacaatgttagatcctattctcccatcttcgttccaaagatttgaacttgctagctaataattaacttgcgttgactggagttaagcatgctaaaagttaggggctaatttggccattatggtttctaacttaatcatcatgcatgcatgtacgcatgctaaaatttaggggctaatttagctgccatgtatatatgctactttatatatacaaacacgcatttccacttaattttagacttgtgatgcatgaaaactacccaaaaaatacattcaaatattacaaaatgataaaattgtgatgcatgaaaactacacaaaaatacattcaaatgttagaaaatgataaaatttatttgggaaacaaaatgtacgggaagatttacatttttctccaccgaacgataaaaaatgtattggagacagcctcggaagattgacaattttttctaccagataatgctgaacaattcggtatttgattaacccaaaatacccatgttttattagataattactccaataccatcagttatgatatatcaacggtttcgttcacattgttttaccttttacctcttggtagctcgcgaactgggtaagaaggaaggaaggaagggagggaggagtagggtggatgagcctgctgcttaccccgtcacgtggttcggcggagaagccaggctcgtacgtggagctccagcaacggcgtcgagatccggtgagatggcggcacagcagcagcacaggggcttttggcgggcggcgtttaggcttgaagaggaatatacgttattgtggtgaacagaagagctagcgatcgatgaatatgcaatggtttcgagggagaagc

SEQ ID NO: 24690 - DNA, 1501 bp, Oryza sativa
ataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttacacacgcccagcactatataaccagctcccaagcgagccgggagtagtagccaacgagcttatagaacacaagtacaagaagctatcagaaatcagaaacgctagctagcagtaggaacaaacaa

SEQ ID NO: 24691 - DNA, 487 bp, Oryza sativa
acgtgcatgcgaggttggttgcacgtcgccgatcgatggaatgatcgaaagtgtttctctaatctggacccaacccaaagttgctccgagcgcgctgcgcaagcaatcgaccggtcgccggttggactgttgatctttcgcaatctcgggcgaaacttagaccgggctggaccgattgccccccaaacccatacgcaattcgcgcaccatttataggcctacacaaagggacacgggacctaatcccctactggccggtctgttctgcacttgtgcgacgtccatgtcacttatcaccctgtcacttcgtgagcttaatttaccctgtcactcccagtgacatgcacaagggttcttgctaaacttaattaactccggccttctagaagcacactgatggatacctcgttctaaaagtattttgtgtcgaatgtgatgtgagcacccatcctttttggttcgtgtcatgctccatcgccaccccagt

SEQ ID NO: 24692 - DNA, 668 bp, Oryza sativa
ccccgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaata

SEQ ID NO: 24693 - DNA, 1501 bp, Oryza sativa
aatatttttagtctagcgagaggtgtacaaatttacccacaagatttagcctcaacatcatattgaccatgcatagcgatactggaaaagtacccgaatggagactgtgacaagacacttcgcataacacaattcaaagcattgcaccttcccgaatcatagtcgccccactttaaaccaatgtatagactcccagcgaccccgtgggcttatctccgtcacttctcagtctagcagtccacaatgaaccatgctatacaatgcatccggttgttgtccacgctagctcatagttattatggttaacgtttcagaacagtagctcgtgaaccggttcttaattgtcatgagcacgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgctgaaaggggtgttttagaatctgtgactttccttgctgttcttcataggcttccaaaccttcttcatcataaacggtctcttcggaacgtcggaagctaaagcaaatgaacaaaatcaacaaaacagtaccaagcataaacaatacatatggatatttttaacaaatagatcttgattttatatgaatttagagactgaaccacctaaatccatgttacggtgaattagttatgaattttctaagtttaataggatttaatccattaacagacaatgtttaagatttatgaagaattatttttaaaaaggaaaagggaattattgtgtcatcatggatcgggtccacattagaccgggtgcacagaagcggtccacgaacagctcagattagatcggcttgccacgcaagcagacgatgaggtgaactggttgggcgacgtggcgctgacatcatcgatgacatcatcgcctgcggcgactactcgggaccctgtggtcaccggcaatctagggcacggcgttgaaaacggaaggcgccgacatgacaagcgtgacggggaacccaccggtgtgcggcgcgacggcaaatggcgacagacagcgacggcgacaaggttggagcgacggcttggctcggatcatcggtggcggcggcgttccagcggtagtcaatggcgtcgggccggtgtatggggtgcgtctcctccttgcaatcccaaagaaggcaacgggaagcggaggcggcggcgcggtgacggcggcgctagggtttgcagtggcggcggcgcta

SEQ ID NO: 24694 - DNA, 1501 bp, Oryza sativa
ggagatggatccgctccgccgccaccaccctagccacactcgctgatgtcgccgctgcctccgccgctctaaccgatgccgccgcctccgccgccctagccgaagccgccgccgtcgccgggattgggagattggaggagggggaggaggaggggagagggagagggagagggagatgggagtgcgggagtgacggatctgagagggagagtgtgtgggacagtgggagtgggcgtcgccgtcgattaaaagggggtgggctatttttgtgtgcgggtcacttaacaggtcagcacgcgctgatctttccgtgtggtcattttaaagagccgcacgtgaaaatggagcacgatttttgcagacgcgaacacttacgatccgtctgcaatctaaaattagtcagtgtgctctgcatttcaccggggcaaatatcctttgctccgctcaacgctggcgacctcaaaccgctgcccctccacgtgtctatagaggtctttttttttatagaggatgtctttagaggtcttaaacaaatgtctttttatttttgtctgaaaggaattaaaatgttcgtttacgctttcagccgttatataggaagccgtcgtttagcttattttaagcataagcgaaacagcatattttaaaaaaaataatttatgaataaaatttttatatatgtgttcttagcgatctaaaagcaaaggctgaaaaataaactttgatgaaaaaacctcaaaatcaacttcaaatttaaggttgaaaatttaaattttggctgataagcataagcataaacgaaaagacgagactgatagggttaacctccaaatgcattaataggttccgctttcacttgggaggacacgtaaatcatctagtatatgccaacagggttaaagccctgtttcttgcagcttggaattattataatccagattattgggagtaagctgaaagaaacagacaacttattgaagtagcttattataatctggagcccagcttattataatctgataagcttatttaggtaagctttttccagattattgggtgaaaaattacccaccatgccaccccactccctctttagactttgccccaataatctaggctctaataatctaggaaagaaacaactaaccgcttattatactacagattataacaatctagtttataataatctgactcaataatttagattataataatcccaaactgaaagaaatagggcctaaataaacgtaaaatctaatcggcgcatgcgcggctgctttcactgtaactgttacgaggaaacctacatgtaataatttttctattttttaattcataaaaaatgatactattattgaagctcaccaatcattttaaatttcatgttctatgtgctcatgtgtggtggcatttttatttgggtgcaagacgggaccatcacataggaaaaatgcgccctaactgttgctagttaaaactaattagtatacgcacgcgt

SEQ ID NO: 24695 - DNA, 365 bp, Oryza sativa
tgaacccgatcgatggagaacaaacagcgacgaggcaacgacgtagagaacgtacctacgctcgtcgatcgatcggcagcgcatgcaggatgagtaacatccgcgacagggatcaatcggcctggtcacatacacattacatcaattaagattctgttagcacgttttttaaactaataaatgttatgtttcctgtgaaaactttctatatagaaattgttttcactacaaggatttctatttgttgcaatggattataaaattgttgcaatatctaacaccattactacgtgagaaaaatatacatttattaagtttgtaatattaaaaattaattaattctatgctaatagttttctcgtttt

SEQ ID NO: 24696 - DNA, 298 bp, Oryza sativa
cttttgacttgagtttctgttgagctcctcttatattagaccaggggcataagctaatagatagattagtgtattaacttgctctgtaatacttgatgtaatatttaacattttcagtcgttcaggtctgttaagtcattgctttgttcgtgagtaaatggatcaattgaagaaggaaaatgtgtgacatgctccctgtataccattttatatggcaaaactgaacacataatattgttcaaattcttggggctacaacaccatctatgtatctaagcatgagtaaaaatatgtcttt

SEQ ID NO: 24697 - DNA, 440 bp, Oryza sativa
aacatgggtcccactgcatgatcgaatgaccagcggactttactgaataattttgtctagcggcatctcagttttatccatcggtatgtcttggccatccagttagagagtctctaggagcacgattttttataagaattcctaaaattcatctgagccacttattgggccattttatggaagttgctcatagtgcctctaaaaatttaaataaaccgagtttgatccggcatgatccggttatggtgtccacataagctctttgttactaaagatggcgttcatgaccaaatgggccgcctaatttggtcaccctgtgcttgagggtggacggtcattatgagtgttagacgctaattaataagattattattattataatcactattattaggagtatctatcattaacttatttattaatttatttctcatcacaga

SEQ ID NO: 24698 - DNA, 561 bp, Oryza sativa
taaactcctaccactaagttttggtattatatttgacgtttcttatgcaggacttgacgattaaagtttgtacttaacgaccgtcaacaacacccccacagttatccattactcatccccgagtaaagctcatgggtcgactagagtaatgactttctgctcaatgatatgacacgcaaaatatttcaagatatacatgtgtctgtgaaccttgaagtgtctaccaccttggggttttctttgatgtttataaacttttactgtactcctcaattgattctctcgaatcactcaaagtgtttcattccacaccaaggcattgatgttggaaagtactaatcataattggtgggcatcaattttggaaacacaagcacgttatacttcgaaatggaaattacctgcatgcatgttctatggaaagtatatgcatgcaatatcttatcgtgttagacccgctaataggttatagtatcctatagtgcattgcacagatcttaaagcatttggattgtggatggccatggagcctgggcaccatggtgcaccaaagaaatgtgc

SEQ ID NO: 24699 - DNA, 1501 bp, Oryza sativa
gtgtctatagcattaaataagctaccacctaggatgaaaaatgatgtggcaagtgaataaatgagaaaagagaaggaaacaatggtttctacacaatatccaaggcatcatgtgagataaatagcattaaatctaagtatggaatagtggtatttgcattggaagagtagtgtctagtactagtttcttgatgatgtggagtttatggaaactatgtctagtgtcatgggttgggaatggccttaggatcttgagacggtgaaacacatcctcctcgactatgtgtttgctcggcaggtctggttgcgtgtgctatcgcctccctggctgggctgctatctcttccccatggcagctggttccagaattggtggctgtccttcagggcctgcttagttgagcatctccatgctggctttgacttcctagtgctcttgatcgcttggcagttgtggaaggaacgaaacactagggttttcgactctgcgctctcttcaatctcagtggttctgaaaatccatccactcagagggtcatacgtggtctttaactagcattgccgcttttggagacttgttgggagtgtagcgtggctcgggcccttcctgctacttggagtttgtgtttagctgccgtagttttataagcttcagctttttattttactttttctctcttctcctggcataagccggtctagctaattgtgttgtgtaactataactcttttcttctaatatattgacgtgcgatttttttgcgcgttcgcggaaaaaaaatgttccaagatgagagacaacatttttacatagctgcgtagtaagtatatttcgttggcttatgttagatttgcatcggatctgaagctttagaattctcttgtctcgaccaatattccgtgtataaagatacccttgacgagtacagtgacttgcctttgtattttggggcactcaaagttgctttcattctgaactagcgttggattaggtagccaccaaacgtacaagtatacatctcagtcgttatctgaaaaattcatcagtgaagctgggagtattcgtcaaatgtcaaatgacatgaaccgctaaaagaagctacatttccactgatttgaacttgccccattgatagcgacaaccaagaaagaattcatgtctcaggatgcttatttctaaagacttgactgacaaattctatgtgtgttcttttttttgcaaaaaatatgtattgcattcatgatccattgatgcacatttctccatgaaatttaacaagattaccacccattatctccaaaaagaaaaaaaatcaccagtagcagtcaacagctgaaaatatcagaacaccattatatatatttatattgcaaagaggcaggcgtaatattgaaaagcaatagtatatggcagagtcttggtcgtcggctacgaaaggtcgccgcggacaaaatcttgtgcgattgcagtatagtgggggagtggttggcatggcaacaaca

SEQ ID NO: 24700 - DNA, 1501 bp, Oryza sativa
accgtcaccctttccctgcccttagacggagagtctctgacgtgctcgactactatgcccgtggatggggctggccgcaccaccgtgctgccttgtaggcctaagtcggcgagcgccgcggccaccaccaccaccggtttctccggcctgagctagtggcttcctcgattcattcgttccttgggtcgtgtcagcatggcccatgtccaaacgggcttgactgggccggcacgggaaggcccggcccattttgccacctagcctttgcctgatgagatctgatggccgttctgaagcctcgcgaagtcgccgttggcgaaatcggggtggtcgttgcagctcgtcgacgcaaactaggtcagcgcaagcaggtagcagactagcagggggcagttttccgccaagtcaacgctgggaatttcgactgaagatcctgctggaaatgtcgccgtgtctgcaattcccagtgaagttccccccctccgaatcacaactaaatcacgcaaccattttgtggtttccttcctgtacagtgtctacggtctgcctctctttccctgtttcctgaaacttctcttgcagctcgagctaagctgatggccacattgtgctgagatctcctctagtggcctaattcagcatcctctcgtcgtgtcgagaccttctatccgtgactgtaagtactgatatccctttcgtttcctctttgggtgaccaatttgattctgaatatttttattaggacgatgcataattgatctgacaaattgtcgtgccatctgttcttctcttgattttgcttcacaacgtccacttgacatctcatcacccatgcattcaagataggtgtataatgtgcgttgagacgcctttcatgtgccctatcaattgctgatgaagttttaggttccctagtcaatatcaatatgatcttttagctctatctgttcctatttaggtttttttttgccggaatgaccgaaggaggtcattcaatctggtgttgttggcgcatagcagtgcttggcttctcctatttaggtttaactggaattactagtaagttatggaaatagatgacatcaacttattaaggatgctgatgacatgatgactataatgatcttcttcctgtttttgtaggatttcatcctaaaatagttttatagcttcaataaaatattcatcatataaatctttaacttcgatttgtcgtctaggttgaactacatatatcagaaataagatacataattttagtgctttactacagggattaaaaaaagagtacaacatgtattgggctttacatgcctgttcaaattatgtgtacatggtagaaagtacaggcataaagacatgcatattcgcacacttattataaattgcactttctcatatgcagttcagctcccaatttcgacatcctttgtctcgttaattgaagcaacagctggttcaaaacattgccctatttgtcacctcgttttcctgttacaca

SEQ ID NO: 24701 - DNA, 827 bp, Oryza sativa
gaaggaaaccggcgcggcgatctcgggctccatcaatggcgccggcgagatttgcgggggcaaatccgcccgtttgaacgcgagagagagagggaaaaatggggggaaagggagagggaatcacggggaatgattccccccactttattgcacgcgggggcggcgggagcggcgggatttgcggcggcggcggcgctagggcacgggcgaggcggcgggagcggcgggaggtaggggatgacgggtgggccccacccgtcagcgagggtggcgggcgggcccgcccgtcagcggcgcgcgcgcgggggaaggccggatgggccgcggggaagaggggagagagggagggagctgggccgagccggcccaagagggggagggggagggaaagggaactttttagggtttttctttttataaaaacattttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagcgaatgatttttaattcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcaga

SEQ ID NO: 24702 - DNA, 308 bp, Oryza sativa
ctgggtggcttgggacgagctgggacccaaggtcggggtgcccagttcggtctgaatcatcgtaggcctggggtaaggcaggttcgtgtgggttcacgcccttgaatactaatactgtgtagctctaggatcgtctttataaaatggctttgggcaactaagtgacttttaaatgctgtttactgcaaaacttaaccccgatattattaccccttgtacccccttgcattaatcatgcatctgccagtgtggcttgctgagtactgtggttgtactcattcttgctctatctttctccccccttcagt

SEQ ID NO: 24703 - DNA, 1501 bp, Oryza sativa
tgcaagagcaaggggcaaacccccacattcttctgcaacttcctttgctaggctttcaatcctaacatctgaactaataacttcttctgttgctttttctttgaataatcgccaagctttttcttggtccaagcattccatgaagatcgtcttgtgagctcccatatgcccacaaacactctcagaacgtgttgccagaactactttctgcttatttaggccattaggatatggaatgccagcttcagctaaatcaaaataaccccataaatcatctatcagaagtaagaatttctttctccttaaaaaacttaacaaaaatgaagcccgtatattaatgctacaacctggtttcaggaacagcccgatcctttcagcaatatctgcttgaagctgacctattccactggctgtagatgccacgacataaacaacaaggtcgaatccataattttctttggttacacctaagaagtgattgttgatttttctgagcaaggtggtcttaccaactcctcccattccccatatccctaaaattccaacattgtcatctttgaggtactgcagaacttctttcaaattacactctgtttcttcagttgaaggtatggtgggcacttcttgcacgaaatatggtggtacctcaaatgatacctctttgaatgcacctttttcatgcaacatttcagcttccttcagtttcttcgcagcctgcatgccaatttcgtactttgaccaataactgaataattgctttctcttcctctgcacattttttatctcattcacctcagtttccatcgctgctaccttttgtagccattctgtaacttcaggattacatgtttcttgcttcccctcagagatactaagccggatttggatttcatttttcctaacttctaggtttttgatagtgttgtccagctttccaatattttcttccatctctattagatatctgaggcgtgcgaccaaaggattccataagtgggatgccaaagtactagatatggaatcaatcagcattggaacatacatgtgtaacaggaaaacgaggtgacaaatagggcaatgttttgaaccagctgttgcttcaattaacgagacaaaggatgtcgaaattgggagctgaactgcatatgagaaagtgcaatttataataagtgtgcgaatatgcatgtctttatgcctgtactttctaccatgtacacataatttgaacaggcatgtaaagcccaatacatgttgtactctttttttaatccctgtagtaaagcactaaaattatgtatcttatttctgatatatgtagttcaacctagacgacaaatcgaagttaaagatttatatgatgaatattttattgaagctataaaactattttaggatgaaatcctacaaaaacaggaagaagatcattatagtcatcatgtcatcagcatccttaataagttgatgtcatctatttccataacttactagtaattccagttaa

SEQ ID NO: 24704 - DNA, 1501 bp, Oryza sativa
tcattccggcaaaaaaaaacctaaataggaacagatagagctaaaagatcatattgatattgactagggaacctaaaacttcatcagcaattgatagggcacatgaaaggcgtctcaacgcacattatacacctatcttgaatgcatgggtgatgagatgtcaagtggacgttgtgaagcaaaatcaagagaagaacagatggcacgacaatttgtcagatcaattatgcatcgtcctaataaaaatattcagaatcaaattggtcacccaaagaggaaacgaaagggatatcagtacttacagtcacggatagaaggtctcgacacgacgagaggatgctgaattaggccactagaggagatctcagcacaatgtggccatcagcttagctcgagctgcaagagaagtttcaggaaacagggaaagagaggcagaccgtagacactgtacaggaaggaaaccacaaaatggttgcgtgatttagttgtgattcggagggggggaacttcactgggaattgcagacacggcgacatttccagcaggatcttcagtcgaaattcccagcgttgacttggcggaaaactgccccctgctagtctgctacctgcttgcgctgacctagtttgcgtcgacgagctgcaacgaccaccccgatttcgccaacggcgacttcgcgaggcttcagaacggccatcagatctcatcaggcaaaggctaggtggcaaaatgggccgggccttcccgtgccggcccagtcaagcccgtttggacatgggccatgctgacacgacccaaggaacgaatgaatcgaggaagccactagctcaggccggagaaaccggtggtggtggtggccgcggcgctcgccgacttaggcctacaaggcagcacggtggtgcggccagccccatccacgggcatagtagtcgagcacgtcagagactctccgtctaagggcagggaaagggtgacggtggccgaaccatcgccaatgccctatctatggtccacggcgcaccagtccaccaccatcgtgaacaatacatatatttatattatattcagttttattgtgtcacatcagatattatataggctgtttagatattaataaaaaaactaattacaaaattagtcattaacccgcgagacgaatttattaagcctaattaatccatcacctttgcatttgctgtatataacgataaagcaatataatactccctttgtttcataagttaataatttgcaggattcaatttttgcgcgtgtaaggaacatgcacgtgaaaaaggaagtaaaaaatttaagaaaaaagaaagaaaatatctcacgttaagaccttttgtttaatcgataagagataaggaatggaggagattgagagaacaacaccacattataatatggatgagtctacggtggaaaaaaaataaaccgaattcccttaataggggttttcaaaatatatgcggttttttttctgcaacattagata

SEQ ID NO: 24705 - DNA, 1501 bp, Oryza sativa
cgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaatcaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttgaaatttatttgatttaattgatttaaatagattaattacccaattaaatctaacagaatacacgccatccttcctgcgcacctccccaacatcatcctcgtcggcgtcatttgaggtctgggaggactaaatctggtaattgcagcatttgaaccgacggccacggcaacgacgacgtgcactcctattgctcctctccataaccagctagcggatgctaatttctctcacgttttcaggtcatgtgcgattattcagcatgagaactctacagtttgattcaaaggtaaattgtcaaaactgacacaaaaatctatttaaatggggatattatactgcatatgttctgatgattggtcttaacattttgcagttaatcaaaaatgttgctccattagatggattttacatagaaatttttacaatgctgatgaagataaaatgatgagcagttactgtaagctactacataatttgccaagtaaattaatgaaattggtaccggatgcctaaaattactgattaataagaaacatgatgtcaaaatagttgtcattgagtaaaaatcagatcgacacatgacgtatatgtacctattttgatatactcaatacattcctaggcatttgatgtgttcaacaaaagttcagatggcaaatatcacagcaagcataataaattgtcttatattaacgttgtatcatatcatatcatggtagaactgtcttatattattatacaaaaagggtagaactgtttgatagatatattaggcagcgttaatattgccaagttcacagacatacaggttgactaatattaacgctgaccatgatacgatttttttttttggataataacaacgcttttcagataatgaccagtatatttgtaatcaccttagcttactatgtacaatgagtcatcagattgcctcattagcccaaggaaactaagagcatgtatcaagtacaatctaccaaggaatttgaaattga

SEQ ID NO: 24706 - DNA, 1501 bp, Oryza sativa
cgccgccgtcgctttgagagaggggatcgggggcgccgctcgccggtcgctgctcagcgccaccgcagccgctcgggggaagaaggggggggcggcggcgccgccgtcgtcgctcggcgagggggggggagggacggggggaggggggaaatgaatcctagggttagggtttgggtatttttatttagcttaggattaatctggactgtccattcgatcggacggctccagctgctcccacgtcgggccgccggcctattgggccaccgaatggaggacgcaaaatagacttcaatggagaaagaaaacaggccagacacatagaatagacaaaagggagggaatataaacttttctatattcggcccaaacatagaaaggaggattttgatttttttttccaattaaataatttgttaaatgatttttgtattattaaaaattagcaattaagctctgataattccaataaattccaaagagcataactaatcatggagaatttaatcaaattaaatttaaccatgtcattttatttttcacacttgctttacttgtaaattgatttaattatacacctacctacttaaaaataccaaatattttaatgaattacataatgtaaattttttttaactttttctcaatttttttgttctgtacacttcccgttgcaacgcacgggcacctttgctagtatatatatatatatatatacacacacaaacacatatacacatgttttgtttttctcaattttaatttaaatatgcaaaaatgcaatgatgcgtagaaaatccaaaaaaaacaaccaaaataaattttcaccacaataaatataaatgaaaaatctcattatattgactttctaaggtttttgttttcacaatttgggtttgttacagcttggctgatcggcgagctatctaacgctaacgccttctctcctattctcccttaccctcgtctccagccttgctccctgctggtgctgtgggcatcgcgttgctactatcgtgaccagcgtaggacctccttgcatcccaaccaccggtgccaccatctcctactagcactgttgcctctcttcgcatcggctggtgtggctctgctcaaggtacggagcacgtgtgtgtcgtgaggaggaagcgcacacctacataatcgtcaatgaacaccgcatgagttaacttctgtggcaaactttattttttttatagtagtatataataagataagataaatcctacttcctccatttcaggttacaggacgttttaactttggttaaagttaaactacttcaagtttaactaaacttatagataaatataatatttataatatcaaattagttttattaaatcaatgattaaatatatttttataataaatttatcttgtgttgaaaatgttactcactccgtttcgaaatgtttgataccgttgatttttttagcacatgtttgactgttcgtcttattcaaaaaattttgtgaaa

SEQ ID NO: 24707 - DNA, 726 bp, Oryza sativa
gtgcatcgcatccatgggcagaccgaatagactggcacctaaatacatctgttcgcaactgagcatgcaagctccaacctgtttggttctataatgactataagtggtactttcagattcagcatatgcagagacttataacagcaggctagtatcggtctgaaattcatttcctattgatccccaacgagcagaaaagagcaggctggtactttcagattcagcatatgcagagacttaaacgctacgacggtggctgcgagcggagaagggtagtcggcgatgaggggctcgaccccgtcgcaactcctcccgagcggcacgaagggcggagacggagcagcggcggcaggcgtagttcatatatgatatggctcagcgaggattaaaacctaagtgatttccctgaacatcacaactgtaacgtctaagcaagcattttgtcgaacaccttttgggcatggggagcattagcgtattacctgcagcttgcatttatttgcatttatgtagttgcatcgggctagcgagggagctccagtggaagagggcgggatcggcgacgaggtggagtcccgagctgtgccaacgagcacggcggcctcaatcccgagcaccgcggagtagcgcagcgtggcgatgggggcgccggcggtggaggcgtggcggggcgcggcgaagaggtgggaggagtggcgtcggcggttggatagcgagcgcgagcga

SEQ ID NO: 24708 - DNA, 181 bp, Oryza sativa
  unsure (1)..(181): unsure at all n locations
ggggggttnnnnttgagacntctctagctcgctgactaaggtcgactctagaggatccccttgtggtggaattggacatacacctctcttcctctttcaaaacccctaaaacctgttttcggtggggtttgggtgcatgccagttatgggaagtagcaccccggccactataaggactaaa

SEQ ID NO: 24709 - DNA, 537 bp, Oryza sativa
tctgtcgttccggaggttcccgaagcgtggttcgcggtcgtcgccgaaggatcggaagtccgttctctctgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgctgattaattaggcaacattaggtggttttataactttagactttggggattctcatatcatttggacactatggaattgttggtttatggtggaattggacatacacctctcttcctctttcaaaacccctaaaacctgttttcggtggggtttgggtgcatgccagttatgggaagtagcaccccggccactataaggattaa

SEQ ID NO: 24710 - DNA, 157 bp, Oryza sativa
ctttttaaggcttgatcatgcttgttaatggaacatgcccttccctaataattaaagaatagttggttgtacagattaggaataaagcacggcctacacctatataattggggattgactggatgggtggattgagaagaaagtaccaatactgcga

SEQ ID NO: 24711 - DNA, 462 bp, Oryza sativa
atgacaggtgggccccacccgtcagcgagggtggcggacgggcccgcccgtcagcggcgcgcgcgcggggagaggccgagtggggtgcggggagagaagggagagggggagggagatgggccgagccggcccattagagggaaggggactttttaggtttttttctttttataaaacctttttaacttggtttatttcttaataattattatttgtgctctgaaaattccactaaaatttatttacacattttaggcttttaggaaatatacaaaaatcctctaagccttatttgacttttactttgcacattttaatttttggaggctttcacacggattttaattattctaggcataatttaaaggatatattttagggtcgttttgggacgtgacaaacctacccccttaaacggaatctcgaccccgagattcggaagaactggcgaagagatcggga

SEQ ID NO: 24712 - DNA, 1501 bp, Oryza sativa
caaagccgacgcgcggcgacatggtgcgcggcaaagtcgactgccagagagcgcgcgcgaaggggaggagaaggccaactaaaccacggtttttgagtgggatgtggtctactaggaccaaatctaaactttgtgcaagattggaagggattgggctgctctagttgggctaggcattctaccgaacaccttatgtgcaatgaacagtgaatttcagaatttttgaatatttccctagaaaagatttgaattcaaactaggagtttggaagggtttcactagggtttagagtaaagcaaaactccactaataataggataggctaaagaaataatctatggtttgaatttgagagaatttgctcaaattcactagggtttagaataaagggaataagttagagtaaattggaagggttctaataatacttgaaccaatttttaaataaacatcaaatagattttttgaaccaaataaatttaatcaaaagccagcatgatgcagtcaaattttagtttaaaatttgaggatgttacactctcgatgttgtagattatggaaattgccaaaggtgattgaggagtcaatcataagttatataatctatcacaggttcgagtgaatgattgagctattagaggatgtcacatatttagcctcgagcttaatcgatatcgtgaggcaaaggggttcataaaagtatacatgcactagaggttcagccgatatgatctttatgtatgcccggtgggtcaatacgttctgctaggggccgctgttgtcacgtcctgataaattcatcccgaattaaaaatcattcgctaaaaggaataatagaattaattaaaattcggaaagaaattggcaaacactaaaatacgtacaagaaaaattcaaatgtggcccggagaatttttgttaaattctccttggtctaaaaggagccctcaaattttagtggaattttcagagcaccggaaatatttataaaacaacaacaacatttatcaaagttcaataaaaagaaaacctaaaaatccctcctcttcctcctttgggccaagcccagtccgaagtcctcctctcctccctcttttctctccctcctcctcttgggcccccttcccctcggcccacctccctcttccctctccctcccgggctgcctctctcttcccctcccctcccggcctgcccggcccaggccgcctctcaatcctctcttcctgggccggccgccggcccaagccgccccagcccccaagccgctcccctcccgcacgtgccgcgcgcgtgcgcgcgctgacgccgccgcccgaccgcgtggggcccccgcgccaggcgcgtcttcttcctcccgcccggctcctctcactcccgtggaaccctagctcgtttcctcctccaaatccgccccgaatccaaccgttccttccaaattaattagggggaattaatcccctttccctcctctctctttcccccttaatttcccctttga

SEQ ID NO: 24713 - DNA, 1501 bp, Oryza sativa
gagctcactctcttcacttcaacacacacctcaagcaatagcttagtttagtagtatctagctggtggaataggaatagagtagaaatcaggagtccggaaatcttcggaagagttcgggtatggctctagcagcttttctcttctcttttgtaagccttgtacttttattagaatattcttctaaatacatttatggtattgaaatactttccgagtatattagtacatactttacattatgttcttgttatactgaatatacggctagcttatctgggagatgctttggtgcgggtataatgtttgcttatgcaattactctatgtcatgacgatgatattagaattactcagtacgggtattcctccgcgcctatatgaaatcctaagttaatttcctggggagggtattcctccgtatttagccccgattgtatggtcatgatgggctgtcgtaaggaactcgacagtcaggggtggcttcttgaaataccaggagggcatcggaaagagggtattagctagtatatcagttaactaagatgtatgtatactatgtatattagaagtataggaatatattatcttccttttttctttccacttagcttagataatatattatgagaatgagtagttaatgcttgtgtgtcactctacccttggattatcttaaaccccgcttagaatatgattattacatgcaacatataaattattagtcaagtcctctctacatgatcttcccacgggataaaataaatacgatacgcttggaatactctcgggtaaatgctacaatggtatatccgtgcgcttgcggatgaactctgtaaccataatatacgagaagtatttctgcgccattgctgggaattatatttctagtaatgtcgttaagaaataccaacatacgtgcggaaacatccaaaacaatatcagatgcaacattgacaaataacctactgaaacatcaggaaatatttattgaaacatccaaataatatattgtgtaacactagaaatatgggtgccaaaaagaaaactaaagaagtcatcggaatataatcacgttggatcttgttataataatttcattgtaacgaatttaatggtgttatcggatcacggattggacaaaaagtttttaaaaaaccatttgaagctaatgttgctcttttacaaggtggtgctagaaaataattgggctaggatttgcgaacactacgaattgaacatttgatacttacaaaatatcataaggtgtttcatcatgtgtaagtaaatgttttggataaatatatttcgttgtttcatcacttgaaaaaaattgtttcatcgtttgttagaaaatgtttcgaggagatgtaacattgaaaaatcattttatagatcgacgtttcgatcgtgtcattttatttgttataattaaatcttcacaccaacatctcaaatgattatattttgattgaaatatatatatgtcttcatcattataat

SEQ ID NO: 24714 - DNA, 502 bp, Oryza sativa
ttgagagattttaaggcgtgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagc

SEQ ID NO: 24715 - DNA, 1501 bp, Oryza sativa
cggcctcatgcccgcatcagtcctccgcttgaggtcgaggcttgtctcggcgtggtcttgcaccgcgctggagaggagaactgaagctggaagaagggattacgcgcggtattagtccgccacacaccatgagtccatgacctgccttcacactatgtcaccagccttagctcgcatgggcacttattacggccacggcaacccactggaccccgccagagacgtgctcagcatcaacctctctgcgcacgggcgtctcaacgtcaccactccgccggcatccctgccgctgcgtgcgctccttgcgtcggtgaaatcagggagagagagggtaatggttagggttagggttttggaaaccggtggtgcttttgttccgggtacgtttgagctgagtcgtctgatcggaattggacggtcgacgctgcacctacaccgcatcaaccagccctgggtgatcatgtccatcgattagatccaaccgagcctgctcatgggcctgtgggcaagctaggccacacatgtgcgatcttgatctccctcatgggctgtacgggcctccgcgcacgataatgggtcggccggatgcaattttgggctatggccagcacttgggccaaattagtttattcttatattttagcccgaatcaatgttattctaattacatgaatgcatttttaatcagcttaagccataatttgatgccataaaattgcattataagtatccttatgcaaataagatcatgtctagctaaatggaaccaactagaaatttggctagaatatttaatttattgcctttattgtttcaacctgttacaccctaaaaattccaaatatataaattgttgtctaaattggaattattagaatttattttaaaagcctagaagagaagatctagttttaattaataaattccaatataaaatggggtcagataaaatttcattaaatactttgcttaattctataatttctagatttttctgggatttatttgagctagggaagtatttttaataaatggaattgcatttaatgaataatttaaattgaaaaaggtttttaaaatcctcttttggctttgggccgaaagtcggcccaaaaccttctctctctccacggcccaagctggcccagtccgcccgcagcagccgcgtgcgcgcgccctcggacgctgacaggtggggcccgcctgtcaggtcgtcgtctacctccggccgcccgccgctcgagccctagcgtcgcgccgccgccatctccttccaaatccgcccgcccctttccgttttcaatgaaattaatagaggggaaatgatccccgggatcccctctatcttttctcttatggaatcgttggctaatttcgtttggaaatccgtggattcgatttcgaatcggattcgtctctctccccgaaccctagaccttccttcgccgtcaccggttgccgtgggcctccgacgccgcctcctagcccctataaaaggacc

SEQ ID NO: 24716 - DNA, 1501 bp, Oryza sativa
cctgtgcacttgcatatttgctgtgtggcttgttgagtatgtcatatgctcattcttgcaatattcaatcatcagaagaggagtatctcagcgaaggtgatgatctggaggattaagcttgttcttggttaagatgcctgtggagtggagtcgccatagctgttccgtaatttgttttagttttttttttccgctgcgtagaatgttattctttgagaggaactatccacctctgtaataatttattatttgcgaatattaaatagttatttatttgtactctattatcaatttgttattgtgtgcctcggctgattcctggacgagggtttaacacacatgtaagcgtttggaattttggatagaaattccgggcgtgacagctaggaccttctaatttagtctgagattcaataagtaaattaaaacagagggagtatcatttttcgaagtaccctaatttactgttttctacagcaaaacaatgcacccaattagtattgacatgcgcagcactaaaatttatgtttgcaatagtcatacagttgaactatatgtttcccgctgatagagctcatacgacaccgtgattcctttccagcacgctgttagtgatatgccctagagacaatcatagagataattgtatcacatactatgtttacatatttatccgactttgttccttaaaatagataactcattattggttaatgaatatgtaattctttcatgagactctttatgttgtttgttactatttctaaaggatccctgatcaaatatcatatgtggaacaaatatgtttaaatgatcagcacatgtattaattgatgatcatatctcatagatcatagtacagagataacaaattaataatgtggacacatgttggggaacatgttgttggatagacccaacatgagacgttgcaagagccatatgtgttgtgtcatcagtgatctcatttagtattggtgttgatccttagacctgagattatcatggttctcaacatgtgtagtagcttacttagggactgctaaacgatactctataattgggtagttataaaagtagttttcgggtatgctgtgaaacatgtagtgggatatgaataatcaagatgggatttgcccctcctatggagagatatctctgggcctctctgtcgggacccaaattaacaacttggatccgactgagattaatgtatcaatccttggatcattaaaaattgatacatgcaatataactggttcttcattgcatatgttaaagtcttacaatactaagggttttacaataataggtactcacctatctgattaatacacagcggaagtttctatacattctgactagtgaggtataacctttagggattttctaaattatcggggtcttcgtagtaatagtcatatgggtcctcctcttgacccaaatctgaaaaaggggttataagagcaaagatgagtattcacaatactcagcaagttat

SEQ ID NO: 24717 - DNA, 944 bp, Oryza sativa
  unsure (1)..(944): unsure at all n locations
cgacaaaataatatgaaaaacaccactagaggatggcgtcacaacagaaatataggtgtgggaggttagggagaaatatcaataagaggggagcgagagattttgcaaaataaagcgcacgggtaaaaggttccaccccacacacacaaagctttttcccttaaaggggtcccaaagggtaaggtgtttntcaaaaaagggggggtacaataaaaacgcttccataataacgggccttaaggtccccaaattaataattacattttaacccgggccaaaaagctcaaaaagccaattccattctttttgattacaataaacaaataaggccggaatacggccacctttttttttagactgggttcctaaggcccgagaattttttccatttgaataactgcggggggcccaattggtcccaaaccgcgggaactcaaaaccgcctaaccagcgctttttcatactgagttcatttcgagtgggtcaagttatgacagcggccggctatccaccgaccattgaaacactgaataaatgcgttgaagtcttgtattacccgttccgttcgccgcgataaggccaagaggatttatgagtgatttggagttgggcttaaagatatacgcattatggtttgtcgggacgtttctgctcgacatagcaatcaactcgctgacgaaaaaagaacatcgccagccactttcaaaactagccattgaccatgtacgcatgtcttccgcaataaccattgtgggcctgattgtgtgcggtatgggctggttcttattcaaggtggtgtgagatgacagtcacccacaacggcaagcagtacaccgccaaaaagctcaacgataacgagtggcagctgacgtcggtatctaacccgcgtgaaaagctgacgatgaaccgctggcatatgaagctggctggcctcctggaacagg

SEQ ID NO: 24718 - DNA, 202 bp, Oryza sativa
tcctgcagccccacacgcagttgccaccgccgaacctcgcctgttggccagcctgcgctgctgcccgggcgcaccgctggctggcgccggcgctcctccgcgcgtcactggtcgcatccgctttgccctcgccctcggccactccaccctcgccggcccaccgccgccgccgaacctcgcctgcctaccaacgtcacagaca

SEQ ID NO: 24719 - DNA, 1501 bp, Oryza sativa
tctttttattgaactttgataaatgttgttgttgttttataaatatttccggtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagcgaatgatttttaattcgggatgaatttatcaggacgtgacaacagcggcccctagcagaacgtattgacccaccgggcatacataaagatcatatcggctgaacctctagtgcatgtatacttttatgaacccctttgcctcacgatatcgattaagctcgaggctaaatatgtgacatcctctaatagctcaatcattcactcgaacctgtgatagattatataacttatgattgactcctcaatcacctttggcaatttccataatctacaacatcgagagtgtaacatcctcaaattttaaactaaaatttgactgcatcatgctggcttttgattaaatttatttggttcaaaaaatctatttgatgtttatttaaaaattggttcaagtattattagaacccttccaatttactctaacttattccctttattctaaaccctagtgaatttgagcaaattctctcaaattcaaaccatagattatttctttagcctatcctattattagtggagttttgctttactctaaaccctagtgaaacccttccaaactcctagtttgaattcaaatcttttctagggaaatattcaaaaattctgaaattcactgttcattgcacataaggtgttcggtagaatgcctagcccaactagagcagcccaatcccttccaatcttgcacaaagtttagatttggtcctagtagaccacatcccactcaaaaaccgtggtttagttggccttctcctccccttcgcgcgcgctctctggcagtcgactttgccgcgcaccatgtcgccgcgcgtcggctttgaggccgcccgcgcgtggccgaccgccttggcgcgccatcgcccgtccgacgccctcagcccaccgccaccgcaccaatcatgacgacgacaaagctaggacgacgaccgccgcacgaaatcgccgctcgacgccgtgcgctcccatccaagccgccgccgagtgcgatttcgcttctacgcggggtgaatcgcgccaattcttgccacacggttggattgaagatagacggtggtatcccctctcacaattcaaaccattcaccccccaagccggccgttttcaccctcgccgccgccgcgcgtcgcgctcggattggcgccaacacatcgccagccgattcctaccgcggtcaagtcaatccttcgccggtaagtattcgaacgtggcctcccgccactcaaatcgatcttgcccgccctctctcagcctctgccacctttgcctcatccaaaacccgagctcatccatggtga

SEQ ID NO: 24720 - DNA, 311 bp, Oryza sativa
cccccccctccaacaaagaggccttatatggcccaaagagggcccccggggggttgaaaagagaccctctgggggttgtttaacaaaaaaaaagagagccctctttggtgttttgggacccaagagataaacacccttttgggaaaaaacacgtttgtggctcaaggcccccaacattggaaaaagacctgttaaacacccatttttcacaaaccccctacgggaaagggggtgccttaataccaaattttccaatgaaaaaatttttcaccctttaaatcacgagaactttttcccggaaacctccaagc

SEQ ID NO: 24721 - DNA, 1267 bp, Oryza sativa
ttaattgtacacataattacataaggcttttactccattgcatcacttaggtaaaatgaaataaaaatgccaagacattaatgtgcataaacataatgttccactctacaataccgttgggccaaaatagagtgaaacgacatgattgaggtaaaatacgcacataaataaaattctaccccataatgccataaggcaagatgggataaaatcatattaggacatgaaatgacaattgacgcgcacaattacataagatttttaatttatctcaccatagggcaagaaatgagaggctacatgtaaaaaatgtcaccaagattaatacaaacacaaaattctacttaatgatactattgagcgaaaatgaagcaaaattaacattagtatcttaataatggaaaatcctatatcgtaatttccgttgggttgtgtcacgcccggaatttctatccaaaattctaaacgcttacatgtgtgtgaaccctcgtccaggaatcagccgaggcacacaataacaaattgataatagagtacaattattactctaattaataagcgaataaaatatcattacagaggtaagcagcggaaaaaataagataaacggcgcagatgactccactccacaggcagcttgaccagggctacacctaatcctccacaccatcagcatcactgtagaactcctcctttgatgaatgattgcaaggtgagtatatgacatactcagcaagccacgaagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcctggctgcacagttctatctccaaaccaggaattaaccattccaaaccaggagctaatcaaattattaccagttatagcatcttttattatgatgagaaatgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtaccttggaaaggagctgtgacagtacccctcgcacaacacaatccaccacagtgcaccgttcctagatcataatcacccctttataaacaaggca

SEQ ID NO: 24722 - DNA, 1501 bp, Oryza sativa
cctgttggtacattgaaaatactcatatgtataatgtaggagattgaataatacttgcctatgtgggaaggaaggatgatcaatcatgcttgtactgcgtaagagctatcagatgctttgcaagtatctcatttgatgtgacaggtggagaatggccaatgtatgcaacagagatatcatttgtttggccatgctggttgtcccaaccatttgacatgtttgggaaggtataatgcactttgggcacagatcatgttgatctcattcactaacatgttatatttctgttggttctgttggaggaggtgaccttcgtttctgtggagttctagactatgtgcaaacaggtctaacatttgcttggttgtgtggagtttcttctcagtagatcctttattgcaatatttttctttctctgaaggcattgaatggctgcatgcgtggtactctctttagcttcgtaggatgtgtctgctacctcaccatagaatgtatctcatttttttatacccgaatgcctactcttggtaaatccatgtttaaattggccctatactgatctggtccttcgaacttgatctatgacgaatgtatgactaagccaggcttggatgtaatcgcgttagcaggagctgctttgagatatagactttagttgcagcctatttatatcaaggtgactaaaaaaacatttgtgagcacaattgggttgtgtgtggatacaaataccttaatacaattgtctaaaaaataaagatgtacatgtagatatatatattagtattgtttgttaaaattattattcatatgggtgcaatatgtcttgttattcttctatatgtttactgcaatgatattttactttgcatatatataatggccaattatattgtaatatgtttgaactatatgactaaagcagtgaatgcatcataatttcaagcagatagagggtgagctaatgtggtgtaggtagtttaagtttaaattgcacgcttgggaaaaaacttgtgagtgttcttttcttttgacttacccctgggaggtagacatattgctctggagcagggttgccgtgtacggttggatctaggatagattcatcagatccaatagctgtgacagatcgtcatgtgtgggtggaatatgcagtattggttgacttgtttggatctgctagacgaaattggtagttgattcctgcaagtgaaaggtatttttgagcaaaggcaggctcaatgaatgggtgtatgtatgtaggggaagaataagcattaattggatgcttctaagacaaaccacgaacaaatatgtagaggagatctatttgacgaaaatacctaattttgtaggagatctggatgagtgcataggagaatagtcggttgatcttgtgattccacagctttatggacatgtagatcagtagatgggagaagaaccggttgatcttctggttgtgcccctaagctgttgctatctcctttgcttcccccttcca

SEQ ID NO: 24723 - DNA, 1444 bp, Oryza sativa
  unsure (1)..(1444): unsure at all n locations
cgcccctgtcccaagggcgaggagagaacactgtttcacagcacccccacagagaggatgtggtgccgtgtgccggcctctcgcgcagggtcttcacccgtagtttttatatggagccttcccatccccccggtgttggggtcaaatatgaacccttaaggcacatgagtccggccttcgcgccttggggagtccaacctcctccataatcccgtgttggatggtcggccccaatccttgataattggtggcaaacacgcaattaaggtcgcttttatagacccaggtttaagcggagaagcgcaatttccgagttgggagggggcctcccctggcgcccccttctgggagaaggggattggcctctcacacgggaccgccgaccattctccgttgcatggacgccggttataaggttacttgcgttccggtctcacctcctcngacgccaccacttattgcacgtaggccaaggcacccccaacgtccacgacatgctgtcaccccacctcactgccgatcgctcacttccctctttcccatcaaccatggtttcgccacgcatggatctgggcatccacattgaagggaagctggatccaaaagtggggttccgaatctagtgtctccagcagcctctgtcaccctggctacctccaaccaccaaccctgcttccagtggcggatctaggatttaggatataggtagtccgacctaattttatttttctaaacacaacaaatctaatgatactaatatgagaatagaatagaccaaatcaccaaaagtttaccatgatatattaataaaatatcttaaaacatcacaatgcacaagagttcaaaattttaaaactgaaaactgaaaaaggtacccaagtacttcgtagaaaacataaaattgtcagcgcaggcagccgggcatcggcggcgacgcactgcagcaagctaggaggcaggtctccgtgactccatttgccagttttactcgactgatcggctcgaagacggctcctcgaggtggcagcacacactgcagcctgcaacactgcatagcagcagtgccagtgcggcgtagcggcgcggtgtgggcgtggggggcgcgtcacgcgcgcacgtgggatagcatcggcatggcgctattgcgtgatcagatgagatgagaaagcatcgctacgctaggggctagggcaagatgagagagatagagtcgcgcgacgccgcgacattctgaatgatcgatacacgcgcatgtggggcatgtgggaggaataggatcgctactttttttttcaatagtcgctatttttttaatagtgggtcgatcgcctttttttttggtggtccatgcaccacccggaccaccctctaaatccgccattgcctacttccatggcaagttggtgctggatatggcaccgccaaggttgagggggagtcacca

SEQ ID NO: 24724 - DNA, 571 bp, Oryza sativa
caaacgcttacatgtgtgttaaaccctcgtccaggaatcagccgaggcacacaataacaaattgataatagactatgaatacacagctatttaatattcacaaataataatttattatagaggtggatagttcctctcaaagaataacgttctacgcagcggaaaaataacagcaaactacggaacagctatggcgactccactccacaggcaacttaacccggatcaagcctagtcctccagatcatcaccttcactgaagtactcatcctctgatgaatgaatattgcaagaatgagcatatgacatactcaacaagtcacacagcaaacatgcaagtgcacaggataacaaaggatggcataataaagctcatttgcataaacaacatttaataaatatttaagagaatagtaaaacagttgaataattaagcagtattaaataaacaccatacaaaacacccgtgttgcataggcccaacctcatctgaacaaccaaccccggttgtacaaatcaaacctctataccaggaatataccattccaaaccaggagtcacattaattagc

SEQ ID NO: 24725 - DNA, 1501 bp, Oryza sativa
tgactttgagctaatttgtgatctttatatctcaaaatgggttgtgttgttgtgatttggaaagagcttacattgtgactttcgattctctatagttggacttcactgccaaattttgtctaaattatcaaaggtcatttgaatgtcatttcaatgctctttctaagttattttttgagtttccgaaatttgaacatcttcaaattttcagctttcttaattcttttgatccttgtacatgcatgttggttgagacatgggcaatgctcccgcaatgaaaattgtgcattatcgtgtaatctatctccaaggtttgttgtagatttttcagcccatggattggattaccttcatgtatgaaccgaaagtttcggtctactaaggacttgtatgctccaatggtaaatcttttacatcatctctacatatacaagcttcaagtgtcatgaatattctttcttatggttgattgccatctattatcttgtggcaatttacatgcattattactacccaatgtttggcacatgtatattcttgcaaatcatttatgtgcaaattgttgaaattatagggtgtactcctcatttcttttcattagacaagtgcatgcttctatcaagtaattcaaatgcttgcatgcacatatttagggggagcatgtcctatgttttgtatttttttagactaacttcttgttaagtgtattttatgtttagtctcatgagaagtgaaacattctcaaaggtatgctattcacaagtggtaattcaattaacttttcatcttatattttatctagctacctttcataatatggattaaattcccttgcttgatttaaatgtcaaataatgcacataaatttgccttccaccatatgtgtgcattacttttgggagaatttagtctatattatgaggtttcacaaataagtgatccaattttcctccacatcaaaaggatcattatttgtgaaactcgtgtgcttttgatgctttctcttttctattgattcaaatagagaaaagagataatgatggatcaaggggagattgatttatgacaaccgaaggaatgggtgaagaaggatgagattggttaagcaccatcatcttgagatgtgaggtttatgaaagtgtgctttacaattctagtccttcaatttatttcttttggtgatatttgcctccttgacccaaaatatagtgtaaactcctccccgattctcattttagtaaagtgcatatgtatgcattaaatttatccttatatgcacaccttgaggggaagtttattctataccttggaagactaatggtttaaattgagtttattctttggtctcatgttggaagtggatgactcccaaggtagacttcattattgcttctatggattttctttgcaaccttgatttcataatataggatggattcttttgttccttcatttcttttgtgaaagtgcataaagatttcttttcactctttgctatgca

SEQ ID NO: 24726 - DNA, 693 bp, Oryza sativa
ctgattttgatctctaaatcggctccgctagccggtttagctgtttttctacaaaacccatcttgatttggccctttggctagatcgaggtggttggcgactccatatcaccgcaaggcgtttaggtgttgcgatcgtgcttgtcgacttgtcaaaaaagttgccaacagaaaagattagtaatactagccgttatagcagcaagttatgttgcgatggttcaggcagacagctacatgattcacagtacatctgaaattcggtgaagttcggcaagtttttttgtagagggcctgatgactgtagtccaatttctagtatgaaaaatagagcccaacaaggttttccagcaatttacgactcatatattcctatagcatgtggattctcgtgtgtttctaacatataattccagatgataatcgttaaaaatcacatctaaaagtaataaatagttaaatatctctaattttgtagttaaaacttatcacacaagggtggtaaacgatagctgggttgaaactgaacacaaccacttatccataggagtgcgttgtcattcgcaggggtggatgaaatgttttccatagaccgaaatatttttaccctataaaatatttgaggactaggtaagctcatgaaaaaacccattaccaccaccggtcatccagtgatattatgccatgcataaaa

SEQ ID NO: 24727 - DNA, 1413 bp, Oryza sativa
cttcactattttttttgatttttttcttttttttttaaatttttgaatttggacgaattttattaaaccgtaccgtgcggtacgggtaaccgtacccccgcggtacgggcggtaaccgcggtaaccgcgcggttaccggcggtttttcacaccctggtcggcactcggcagacggatgcgaatcgaatcagagacgaaggggaagaaagaagaaggatagaggttggtaggtcagtagtataggggaggaagaaaaggagacgggattactcggtaggcgtctactctttgaggcccacgcaccgccgagaggacgcaaacgtaaaaggcccatagattggctcagccagggcgggaataagtctaatttgtctccctcaactgcaaaaccgggtataactcgtctcctaactcccaaaacagttgcaaatcaactcccgtagcggttttggaggtggtttcgtccgacgtggtaactgattcgctgactcatcaggtgggacccgcttgtcagcggcctccaccttatcatcttctccctcacttctccaccgaattaaaggcggctgtgtttagatcacgtcaaaattgcaagtttggttgaaattgaaacgatgtgatggaaaagttagaagtttgtgtgtgtagaaaagttttgatatgatggaaaagttagaagtttgaagaaaaactttggatctaaacacagtcgaaaacttctttttgtcgatattgacaagcacaaatccgtgcacaaattcatggctttggctggattcagtgtaatgcaggcatgtaagcctgttccatccaccaacaaaccggtcgcgatcgccggctactgatcagtagctgaagcgaagcaatcgacgcagctatagctgagctagctacctgtcaagctggccgcaatagcagcaagtacggcctcatgtttactaataaataaggtagactttatatctatagtaataattctaagaaaatttgaacttcaaagagacaacaattctaagacagagggagtagaaaacagaacatgttttaacatcattagataacattgtttctcgcagggcgacaagaacgaacactgaattatttacatttaataacagcattcgcatccagagcatgagttttccaaaataacactactgcatacatttaataacaccattcgcatcagtattccaaaataacactactgcatactactcattggtagtaggcgggctgactgtgcctggagtggtaggcgggctgactctggctggcgtggctggctttgttgtagacagttcctttggtggtaactgaatcaacacaagaacaaaatgggaatgaatgaaaacagaaaacacagcaaaaaaaaaaaaacataaggacttcatcctcatcagagtaaacagg

SEQ ID NO: 24728 - DNA, 190 bp, Oryza sativa
cttttgaatcgtgtaatttctggagtagttgggctagccggctccaaaaggaacagaatcaaaatcctctgctatgtcgctgtttgtttatcaactttggctgatgggcaacgatatgttttttcaaacaaaatctgttatctactcccccctgactttgattttccgtgtcatttcctccttgtttagg

SEQ ID NO: 24729 - DNA, 1123 bp, Oryza sativa
agggaataatgtagaggtaggttaataatccacaataaacgagttcaaaatttaatattcatatgttgatgcacattgcctaagtaaatgaaacacaagccatcgggatagagagatatatatacctattaaagaagctcctttgatatactatcatctgtcgtaggttgctaacatgtcggcccacgagctataagacccatgtgtcagtgcagcgtgggtgctgggggacttgagtcccctctactccgctggatcataattgatagaatgtagggagaagaagtagggatgaaagcgggccaacacgcgaacttacttatatgtcaaataagtgataacccgtaggttttcatatcgtgattcggcttgctgcacttagagatacaagtgggccgatccataaacccatttataagtcaaatcagtaggtgatccgtaggttacctactaattttgcctataagcgggttcgcgggttggcccgcttgcaaccctaagaagaagaggggaggaggaagagtagggggctgaaggaggaaggagatgagtccacgctctaatcttattctagatcatctcttagatgtcaattacttaaaatcagaagaggacaataagttagaagatactttctccattccaaaataagctaataggttttgggatagggagtatgtttctttatacctactcgatggatgagtaaggagagtacccccgtacccgccttttcctcccgcctcctctcctcttcctcttcctcttcctctctctcgttgatttcttttccctttgccagctttcgcttttctttcctcctcctcctttcggcctctcctctccttcctcttttgcttcttcttcttctctctctctacaactcaagctaataggtgtagtactagcaaaggccagcatccatatcgaggctatctagggttggtgctagctacctagctaggttggacccttctcttcatcctcccttgcatatcaagcctcgatagatatagccatcagcccccctctcgatcgcccttgccttttgagatcgatcaccaggttactgtagaagtacagatcggagcgagcgatcgatcgaggaagaagaagaggtaga

SEQ ID NO: 24730 - DNA, 1215 bp, Oryza sativa
ccacccatgaggcccacgatttctccttgcgtagcccatttgtctaagaacgactatccttcacgctgcggcccatgaggcccacgatctctccttgccggggcgagacgctgactgctacttccgggctgggcatttgctgccgcggtggctgctgctttcccgtgtgcgcagcggcgcggtaatggatttttcgtttcgttcttggcgtgcggatgcgacgcgccgtggcgtgctcgatcaccattgttagccgacacccaatcgccagtggttgccagagctaagctcctcgaaaaattgttaacaatgacaaacgaatctagggcctgagagcaagtttaaggacagtcacaacccagaacactagacatggtttctataaattttatatcatcaagaaactagtactagacactactctttcaatacaaacaccactattccatacttcaatttaatgctacttatctcacatgatgtcttgaatgttgtgtagaaaccatgtctcatgcaagacatggtttctttctctttcctcatttattcacttgccacatcattttttgtcctaagtgacaacttatttaatgttatggacaccatcctagtcattgggttgagaataccctaatagtatagtcaactactaactccaaatcatttatagtcaatttaatactagttaaatcatacaatagttacctatgaacatatactacactattaatttctggtcctatttgtcatatacacatcgcgccttgaaatctgtgttatagttggttataaatttgtaacccactgtttttctcatttctcttttatgttattaaaatatatttatagctagcttatagtcctgaggcatccctggatatcatttggtgttaaaataaacgagtggctttgggagaacgttaccaaacgttgtggtcgcaagccacaattgctataacctgctcgctgttgagcactgcgaaacgaattaagccagcagagtcaaacacagaggggacgagacatgcatgcagctggcccgcaatgcaccgctacgcgtttgctccggtggattgattcccagataggcattgacaccgacaccgcgttggtatcagattgttctactagtcttcaaccagcggcgcgcgcggtgtgcaccatgcatgcccatgcaaggaaaacgcccatccaaccacggtgcacgcaatccaa

SEQ ID NO: 24731 - DNA, 244 bp, Oryza sativa
  unsure (1)..(244): unsure at all n locations
gcggccggagctcgccggtgacgncgaagagaaaagcgacggcgcgagtttattcgctgaatagaagagcggcgagtgcgtaaacgccgaagtaaggcacggggagtgtttatatagggttggaaggggagagaccgtccgaatgaggggaaaacgggcgcgaaagatccggccgccattgatgcgtcggcgaggttagggggaaagtttccgaacgaatccgagggagagagggagggaaaaa

SEQ ID NO: 24732 - DNA, 170 bp, Oryza sativa
ggtgggctgtgggtgcatggttttgctagtcgcacccatggcaattaaggaccggttcgcgggaaaccctggaagaatttatcatgcttaccacaagccagcgtgggcaacggctgggcttgtaatgtagctttcctctagctgacgcatccaggcaagggtgggcgtga

SEQ ID NO: 24733 - DNA, 1501 bp, Oryza sativa
cggagaggcgctgcgctgcgccgtcggatcttggccacctcggcggcggcggcggcagcagagtcgtcgcccgcgcgctgccgatgagaggagaggagagagagagaggtagaggtgaggtgaggataaggatgtgaggatggaattttttttttgaagtgttgtgagggaaaaaggagctagggagggtatttttccgtgcggtggtcttaagatgcccgcacgcgaaaactcttaagattccgcacataaaatgggagaacgattttcccagatgcgatcagttatggtttgtctgcaatttaaatgggtccctgtccaggaaaatgttttgtgtactagtgagttttactttgttaattatagaatgcatgctttgcgtacacacgcgcgttgtacttgtacgtactccggcaatggggctcaagaaatacgctggatggaagcacttagtgcatggctacgtcaacgcgcgaaacttaacctgagcaggtatcggcatgctgtcatgtacagtgaggcgagctcttggtgaggcgagctcggcgaaaagactgaacctgagcaggtatcggcatgttgtcatgtacagcagacggcaatgtcttcatcgcacgacaacagtgacgccatgcgggatgcggcaccgaccatcctcggagtatttcgttctaataatagtccaaaccaacgacttgcgaagggaaaggatgactggatgacgaaaccgacatgcatgcattgatgaaccagtccaaaccgatctggtgtagtacaatatatgacggggtacgtaaatcattagccaaggccaacactacaaggacgtttccctcctcctcccgcatcgccctccccaggtgactcgggaggcgacaccgccaacttcctcctcctcccctgcctcgccgccgcatgagcgggtgccggcaaagccgtgcggccgcaaggacagcggcgacggggccttgtctcaccctccacgcgctcagcggccaggggcgttgctcggagcggcagaattggtggccagatccaggccgggcccagccggatctggcggaggggtcactggcggcggggagtgaaggtgacggcggcgacgcctggtggcggacgtggcagcgtggggtttggcggcgacggtggcggagtcccccagatccgcgccaactcggtcggacctggatggcggctagcggctggcggtcgcggatgtggcagcggttggcgatggcggctggcgacggcggcggtggctatggtggcggtgttgtggtggatgctgactgctgaggtggtggatggcgaagaggcagcgaatgtgattgcggcggcggtggctggcgacgacggctggagacaccgagacggcggcagcgacggacgtcggctgcggcaatgaaggtggcggtggaggcggcgtctggcggctggcgacgtcggcggatgcggcagcggctggcgacatcgtgcagatggttgccggcggcagcaagtg

SEQ ID NO: 24734 - DNA, 1501 bp, Oryza sativa
acgtggcggccgtacgatgtgctatgggtgatggcgacgcgactgtggtgatgtgacgaggcgatcgaggtaacgcgcgcggcgcgacgggacggcgtggtgccgattctccggagagaatcaggggagcgggatcgcggcggagtggacgcgacgcggcacacgggagcggcatggtgcagtgcgacgcgggtccgacatgggtgcggcgcggctagggttagggacggtcgcggcgccgaccctggcgcgacgggagcaggacgctcgcgcgggcaagtgcgtatcgccgggttttctggaggtgacgctacgctaggagatgtacagtatcggcgcggctgggttgctctggggagagagttcgttcttgggtagacccagatcgaacgggttggtgccttggtggaccatgaacagtgctggctgagagatgaatagaaggaaaataatagagcgaaaagggagggacttgactgcaaattgatagttgagactaggaatttggattgaaaacattttggatttgaaaattttattaggaattcaaatatttcacttgaatttgaattattgatttcttcccacaaatgatttgccttaatttaatttagatttgatcccaatgaaatcagggacttgctataacttttttatattgatttaaatattcaactaggaccattatagaggcaataaagcattgcctccgtttatttgtgtggcaaattattttgccgagttgaattttatgtcctgagagacttgacgatatgttttaaatattccgatggaacatcctttacgtgactagggtaattctatctaatttcaatcctcaagttaaatttaacatatcctttttaaattggtttttatggaaccctacaatatttgatactcggtacagtatatgtgatatcaaattaattatattcccaataaaactattttatagatattatagatagagctcaacttatttgcacggttatcatttcatgtatacttatatttcatgacacatactaaaggactattgtcgaggagtaaccctagctatctagcgggaggacgtgagatccccctttgtgagttcggccaggggatagggcacgagcgatcaagaggtcgagagtgatcaggagtgagaccaaagattatacaggttcgggctgctcggaagcgtaataccctactcctatgtgtggaactatgcttaagttcttacaagagattttgggctcctgggaaaacctaactgtgcttcccctagagttcaagctatcaaaagtcgtccccttgctcggcgggtaaggtcctccttttatagttcaagaggataccacatgcaccgcctctattcgtcttatctttcttggagggggtccctcttcctcaggttctgctcccgcttatgccttagaccggaagcaatatggctgcttactccgtggtgggtcccagcgccgtctcccatctgacacgggggacatcccct

SEQ ID NO: 24735 - DNA, 1501 bp, Oryza sativa
gttttatctagccatgcctatttacctttgttatgaccttattattgttattgttattatttccttgttcaccctagattaaacaaaaccccaactagtggacactctactcatagtaccactagtataattttaggtagatgcttcgctgattaattaggcaacattaggtggttttacaactctagactttgggaattttctcatcacctggacactttggaattgttggattattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggttgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtaaaacctattcgaatagccgcgccctcggttatgggcaagcctagcaatgtacccaagttagtgttttaaattcttaaaacctgcttaataactaaaatgtggaatggttggcctgggttggcttgggacgagctgggacccaaggtcgggttgccagttcggtctgaatcatcgtaggccttgggttaaggcaggttcgtgtgggttcacggccttgattactaatactgtgtagctctaggatcgtctttataaaatggctttgggcaactaagtgacttttaaatgctgtttactgcaaaacttaaccccgatattattaccccttgtacccccttgcattaatcatgcatctgccagtgtggcttgctgagtactgtggttgtactcattcttgctctatctttctccccccttcagtaagagaagcttcggagaagatgtcttaggtggagtcttggcttataccccagttgagcgcctgtgaagatggagccgtaggcccgctagtccgctgctgtttatttttgattgtcaggcctgaagtgcctttgtaataatgtaaatattgtcgatataataaagatgtgccttttatatcatgtttgtttggtgtaccccggcttttcctaggacggggattaatacactagcgttcgggaaaaggcaattttctcggtcgcgacaagatggtatcagagccatctcgactgtaggataagccaagtggataaaacctaaggacata

SEQ ID NO: 24736 - DNA, 1489 bp, Oryza sativa
ttcgctcggatttactcccgcaatcttcgccggggcatcaatggagccgagatcgccgcgccgggttccttcctctccgggcgctctctccccctcccgacgctatataatcgctccccgagcctgtgtgctccgtttccgccgctcgccgctctctctccccgtgggaatcaagcccgcaccggcgtcctctctctccgccgtcgccgccgagctccggttcgccgccgtcgtcgccccggacctcctcccgtctcggcatcacctccttcggcttcgccgcgtcctcgtcgacctcgtccactcctccgtttcgcccgccgaccgtcggagcgccgccgtcctcgtcgatccgaaccgcgccgccgcctctcgccgcttcggtcgccgtttccgtcaccgccgtcgacccggggtgagccgaggaccgccgcttcgcttccctcttctctcctctctctcggccgccgctccgccatgcctatggccgccgccggcgaccataggggcgcgggcgcgccgcctcccgtcggccgtgccggcaaggccgccttcgggcgcgtcccgcggctgccaggtggggcccggccgtcagccgcccgcgcccgcgggtgcggctgacgcgtgggacccacggcgccggccggcgtcagccgcgtgcacccggtccaccgtggactgagaggctaccgcgtgggccccactcccgtggacccggtccgcgcgccctctctcccggctgacgcaataaatgagtttttaaattaaaatttaaatgaagaaattcgcaaatatccatttaaagagcatataaacttcaaacggccataacttggccatttgaactcggaattggaccgttcaagtctctaatttttccttaagaagtcaagagcccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagattaaacaaaaccccaactagtggacactctactcatagtaccactagtataattttaggtagatgcttcgctgattaattaggcaacattaggtggttttacaactctagactttgggaattttctcatcacctggacactttggaattgttggattattgtggaattggattcacaccgccccctctattcaaaatccccaaaatggttttaggctgggctcggggtgcatggttttgatagtagcacctcggccatataaggaccggt

SEQ ID NO: 24737 - DNA, 1428 bp, Oryza sativa
  unsure (1)..(1428): unsure at all n locations
aggccggcaacagannnattttctcccccttcccaacattatataaacactccccgtgcctccctccaccgtttccgccactgaccgctctctctttcggcgggaatcaagctggcgcagtcgctctctctctcagcggtcacagccgagctccggtccgccgccgtcgtcgccccggaccttctcccgcttcggcgtcgccttcttcgggttcgccgcaacctcgccgacctcgtccacctctccgtttcggtcgccgactgccggaacgccgccgtgcccgtcgacccgagccgcgccgccgcctctctccgctccggtcgtcgtacccgtcgtcgccgtcgacccggggtgagccgtggaccgccgattcgtttcccccttccctcccctctctcgggcgccgctccgccgcgccggtggtcgccggcggcgaccatcggggcacgagtgcgccacctcccgtcggctgtgccggcgtggccgccttcgggcgcgtcccgcggctgccatgtggggcccggccgttagccgcccgcgccctcggatgcggctgacgcatgggacccacggcgccggccggtgtgagccgggtgcacccggtccaccgtggaccgtgaggctgccgcgtgggccccactcctgtggacccggtccgcgcgcccctcccctcggctgacgcaataaatccaattttaaattaaaatttaaatgaagaaattcacaaatattcatttaaagagcatataaccttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatagttttaggctgggctcggggtgcatggttttgatagtagcacctcggccatataaggaccggt

SEQ ID NO: 24738 - DNA, 222 bp, Oryza sativa
  unsure (1)..(222): unsure at all n locations
tcctccgtctcctactattacctctactttaactnttctcccttctctttccgctctcacccctccnttacttttccaacntccgcccccccccaagtgatgcactctatanacccccnnnnnnnnnnaagaaaaaaannaatncgggcgtatacgtcacgccgtcgaagaagctataaccaattattatagatctgcagttcaaaataactgcaaattaga

SEQ ID NO: 24739 - DNA, 232 bp, Oryza sativa
aaatgttgcgagtgggccctccacaatttaagaatcaggtgatttttcataagagttttattgaggctggagggggaggccttaaagtgtttagacaccaaccaaatttttaggatttttcgtgtagcggggggctattttttggattcaaaaaacaattggccgtttttcacaaaaaatgatatgtatgttttaaggcctccaaagaagggttttatagttgagatccaga

SEQ ID NO: 24740 - DNA, 1501 bp, Oryza sativa
cacaaagggggatctcacgtcctcccgctagatagctagggttactcctcgacaatagtcctttagtatgtgtcatgaaatataagtatacatgaaatgataaccgtgcaaataagttgagctctatctataatatctataaaatagttttattgggaatataattaatttgatatcacatatactgtaccgagtatcaaatattgtagggttccataaaaaccaatttaaaaaggatatgttaaatttaacttgaggattgaaattagatagaattaccctagtcacgtaaaggatgttccatcggaatatttaaaacatatcgtcaagtctctcaggacataaaattcaactcggcaaaataatttgccacacaaataaacggaggcaatgctttattgcctctataatggtcctagttgaatatttaaatcaatataaaaaagttatagcaagtccctgatttcattgggatcaaatctaaattaaattaaggcaaatcatttgtgggaagaaatcaataattcaaattcaagtgaaatatttgaattcctaataaaattttcaaatccaaaatgttttcaatccaaattcctagtctcaactatcaatttgcagtcaagtccctcccttttcgctctattattttccttctattcatctctcagccagcactgttcatggtccaccaaggcaccaacccgttcgatctgggtctacccaagaacgaactctctccccagagcaacccagccgcgccgatactgtacatctcctagcgtagcgtcacctccagaaaacccggcgatacgcacttgcccgcgcgagcgtcctgctcccgtcgcgccagggtcggcgccgcgaccgtccctaaccctagccgcgccgcacccatgtcggacccgcgtcgcactgcaccatgccgctcccgtgtgccgcgtcgcgtccactccgccgcgatcccgctcccctgattctctccggagaatcggcaccacgccgtcccgtcgcgccgcgcgcgttacctcgatcgcctcgtcacatcaccacagtcgcgtcgccatcacccatagcacatcgtacggccgccacgtcgcgccatcgtcaccatgctacgccgcgtttgctggttagaaccgcgcatccctaacccaagaaccctaaccacgccctacgccgcgacgtcgcccgtcaccctcaccatgaccccggcgccgtatgagaataccatcgctccgcgccgcctccgtcggataatgacgcgctctccgcaccagtctaacttctagcccagcatctagctcgactgcccatgtcctagccagtaacttttctatattttttttaaaagatcacattgtttattatttcgagaatattttcttcccactgtgcttgtctcaaacacaacctaatactccctccgtatgcagcaatgatttttcgtgtccaattttaattgtctgttttatttttaaaaaaaataaaaaataaaaatata

SEQ ID NO: 24741 - DNA, 546 bp, Oryza sativa
attattatttgtgctctgaaaattccactaaaatttgagggctccttttagaccaaggatgtcgtaggctctccagaccttccattatatttgagagatgaagtgaataattcaaatcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccccattaagttctcatcctaga

SEQ ID NO: 24742 - DNA, 1501 bp, Oryza sativa
tatgtatatgtatttcattttatcatgatcttgctcgtaaggatgtaaactgtttgggggctaaaggttctgaaagcgctgtaactgctagatgttggaagcttcccagacatgacaaaattaaattataagtcttaggtatgatcagctgttactattcgtttttcccgaccgcatcttacagcaacgttgaaaatgtgcttgcacaaatcatcgggtaaattgaatgtacacatacgtccaaccaaaatcaacgagatcctctttgaatttacgcaagtagagacggttggattccaaaataggttggtggttccgatccgcggaacgccacccaaaaccttacaaattcaagtttgtcgatcgatctgagagcaagccaggtcgtagctagctcgttgaaagcttgactatatattcatggcatgtgtggttgatcagcttcgttgcactgcaccgaatattcagaactgctgacctccatcacacaacagtgatgcttaatttcctacgaggaaatacagtttttattgactgaagtttcaggtcaattgtgtgaagaaagattaattcaaaggtgatcgactggctggcagagctttcagattcagttgatgacatcagcaaacaaaagattcaatgcattaattcatctcgaagaagaggattccatccaaactactccactgatctggatgcagtttccttgatactcctacttatttagcatttgactgctgattgatcattcaagagaagattcgttcagctcatgagttctcacgtttcgccgacttctgtttcgttgatgtctcgatcatcttagctagaacatgtaagctgatgggtggccacaaacgtcaagcagtagttgcacctgaaagtcagaaacacaggaaccagattcactgcattgacatgacatttgtatgtatatttgatatctgggaggaggaagctgcttgacggtttctatgcaacttgtacttgtccgaatctattattggcatggtatatatatctattatgttgttaactagtatggtggcctgcgcagattgcacggctagctaccaatatattttttttaattttgaacttttgatttatgacttgctttggttatctcgtgttttgctatgagatgtatttattggcatgacgagtacttattgattacatttggtttataggagtattccagttcacacttatttcaaagacattgtctgtttcccgtgtcgtgagatgttttatttctttttttcgtttctacctaatcctaatctccttcgatttttctatttctcttattttcttttgattaatgtgagaatttctagaccatgagagcaaatgtggagactcctttttctgttactttattaagttaactagcatggtggcctacgtagattgcgtggctagctaccaatatttcttttttttaattttgaacttttgatttatgacttgctttggttatctggttttactatga

SEQ ID NO: 24743 - DNA, 1501 bp, Oryza sativa
ttaattagtgttgattttactagaggtagatgattacacctagattccattttctttggttgcactcaaaaataatgggtggactgctcacagaaattaaacaaagatgggctattagaaagctagattaaatttttaggaggattaaacagagaaggaaaattctagaaaaattatatttattcacgataactaatctagtatttgaataaattatttcccatgttcacttatatgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctcatcactgtccacataaatttttctatgattttatcttgcacaaaatattttagagaattaggatgacctttgtttgtataagtgttcccacttcataattgcatctaatattattatagggattacattaaatttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcaatatgtacatgtatgcttgatgacatttctagtctaatgttgggaatgaaaaggttttattttgttctcaaattttaatcatgcaatggtttaagttgatcatcacctaaattaaaacggaaatttttggctctcaaaattggagaaattaacctctaactattttgacaagaaattttaagtcctaaaatttcgggtaagttacaaaggagaatttaacaaaaattctccgggccacatttgaatttttcttgtacgtattttagtgtttgccaatttctttccgaattttaattaattctattatttcttttagcgaatgatttttaattcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcagatggaatcttctcttcacccgacttgtccctggttgaacctttagctgacttcgactgggttgcggcacttgaagatggtgcttcagttccagaacttcgcatagtttatatttttggcgtcaacctcatagaagttacccatttcacgttatgcgtcgagatcagctcgtcattactaggataccatgcttgtcatcatgagaatatcatgcttgtcttttacttctaacttgccaccaactgcctcatattagctttcctgctctccgggtgctagct

SEQ ID NO: 24744 - DNA, 1501 bp, Oryza sativa
gccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcggattccggcatgaagcggcgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcttttcctcgatggctttatacccttcccatcgctgagcccggctcctcgtttctcgtgcccactatctcgccccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggcccagacaccgttaccgatatgcgtggtttgagaccgttgggtttctgcccaatcacggagaccggtcccacctgtcaccaggctttatgagtggcgtcatgcccgaccgcttcccttgagaaggataatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacatggtagggctcacctaaccgcatttattgcggtctggttaagcgtgtcacgctgcatgcagcgcaatgcagcgcgctcttttatccggtctgtgaccagtcacagaccggtcagatcaacggttaggtggcgactggcggtctgactcacgcctcgccccgtcccgtcaagatgagagcctctaggcactcgtccccagctggagctggcgtgttacatcccagagatggcacgttagccccgatcgatatatgccaggcttcatcctaaccattacaggcaagatgttgtgtgaagaagggcaaacatgcacgttgctaagctgacac

SEQ ID NO: 24745 - DNA, 1501 bp, Oryza sativa
tgtcgttaccaggttgcttggggccttgaataataatcgacatcattatgtacttcctcttcatgcatagccaaggggggaggttgtagatacacatcgtaacgggctgctatggccgctgctcatctctccaaaaggattcataccatccgtacttaaaccaaactgtatgtttcgtgcatcctttccaaagtctttaaatgttctgtcgatgttttgccactacgaaccattggcggggtgtctcagcatcccgtcctgttgacgttcttcagcgtgccaatgcatcattctagcattccccttgttcctgaacaaacgccttagccatggtattatagggaaataccgcatcaccttagcaggaattctcttcttcgttgtctacccgtcaacttcacctggatcatctcgtctaatcttgtatcataatgctttacaaacagggcatgtttctaggttctcgtactcctcaccgcgatataggatacaatcattcggacatgcgtgaatcttctgaacttccagtcctagagggcagactatcttcttagcctcgtacattgtatcgggcaatttgtttccctccggaagaatgttcttgacgagtttcaataaatcgccaaatgccttgtcactaacaccattttttgccttccattgcaagaactttttgtgcccctgctcgcaacctgggtacaacgacgttctgtggtcctctaacatacgctccaatttatgggcctccttttcactttcacagtcctccttggcgtcctacaacatctgaccaagatcgtccgcagcgtcgttatcgtcagcatccctgtccacctcgcccgtttgatttccttcaaatccagcgtactgagcccaattcggaatgttctcgttctccacttcatcttcttctttttttttactaggcatcttcttccatttcaaccccttgctcaccgtgggtgttggtatttcttaacgtcattactagaaatataattcctagcaatggcgcagaaatactcctggtatattatggttacagagttcattcgcaagcgcacagatataccattgtaacatttcacccgagagtattccaagggtatctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggttaagcgtgtcacgctgcatgcagcgcaatgcagcgcgctcttttatccggtctgtgaccagtcacagaccggtcagatcaacggttaggtggcgactggcggtctgactcacgcctcgccccgtcccgtca

SEQ ID NO: 24746 - DNA, 1501 bp, Oryza sativa
ccttccacacctttgtattttagtgcagaagacggcttcctctgagctggctgctctaacttcttggccggtacaggtgattttactagcgtcctccaataacggttcctgggcattgttgtttcctttcccaggaagttctgcatgaaccttaccaggctatccgtcttgggttgctccacttcgacctcttgaatgttctgcgggtttggcctgtacttgattctgaccatgaagcattgttccgttcctcggttgtaaatctctataactattaatctctctatctccgtttgtattatggtaatactgtatcactccccgttcccacgtcactgttggctcctgcggtgctaaggaacggacgccccagtatgagcggtgtctccttccccatgtccatgtctagcaccacaaaatcaaccgggatgaagaaattccgtatcttaacaggcacatcctccactatccccgccgggtaacgaactgatgaatcagccagttggaggcacatcggtgttggtgccaacaccatgaagttgagtttgtcaaagacgttttttggcatgacgctgacactagctccaaggtcgcacaaggcatggacgaattgttgtgccccgatcgagcaggtgatcgtgggacaccccggatctttcttcttctcctggagcttgtggagtatcaggttgctgcagtgttccgttagcttgaccacctccgttgttgggagcggtctcttgttgttgagtatgaccttgagataacgggcgtatgttggtacttgcatagcatccaaaaatggcacatttgtcacgtcctgataaattcatcccgaaataaaaattattttctaaaaggaataatagaattaattaaaatttgaaaagaaattggcaaacactaaaatacgtacaagaaaaattcgaatgtggcccggagaatttttgttaaattctccttggtctaaaatgagccctcaaattttacttgaattttcagagcaccgaaaatatttattaagcaacaacaacaattatcaaagtttattaaaaagaaaaacctaaaaataatcctccttccacctttgggccaagtctggcccaaagtcctccctttctctctccctcggcccgcggcccaagtcctctcttcctccctctctttctctccctccttctcttgggcctccccttcccctcccggcccactcccttttcctcccctcccgcctgggccgcctaccggcccaagccgccccagcctcccgagccgcacacccctcacgcgcgccgcacgcgcgctgaccgcactccctgcgtgggtcccatgcgccgggtcatcatcctcctcccgcccggcctccttcctctctctcccgtgaaccctagctcctttcctccctcaaatccgtgcgatttactcatgggattccaaaattaaatagggggaattaatccccattgattcctctttgattacccccaatttcccccttgat

SEQ ID NO: 24747 - DNA, 1501 bp, Oryza sativa
gatcatccgaagtttaatgctgttatatgaagatttacggattattgtgatttggtttcgcaattataaaacatgtgtaagtgctaacctggaaaagacaggaaggctgcgcttgttgacatgcagactccacatgtcaacctaagggaccacggtggaccgggtacacagagacggtccgcgggtcgacggaagcggaccccgtgtgtcaaccgaggcgagtagccgacaaacggactccaccagacaccacgcgggctgcacacgtagaaaccacgtggctatcgagcgggcacactaacatggtctccacacgcacaagcgaacgactaccgacaccggtacacgggtaccggggtcgacagccgcacaacgggtacggggcgacaccgaaaggacgaggacgagggcgacgagggagagatccttaccaccacgcgatgaggcgtgggaatgacaaagacgaacgagcgcggcggagacgactcggggacgacggaggcgaacggcgagggaacgacttcggcggcgatccttggacgaaggcgagacgcggccggcgcagggcttgacgacgcggaggcgaggacgaagacgacgacggggctgcagcggcacacttgacggacgcggacgacggacgagaacgacttgacggagggacgaacgccacgacgaccgggaacgacgagaggacgacaacgatgacgaccagggccggcgaggagacgatgatggcagctggcggcagctgcacagagctgaggccggcgtgggacacgccgcagcaatgcccacgacggcggcggcacaacgagacgaggagccggcgaggaggagcggccgaccgaagggacgtcggcgacgacgaggatggagaggaggcgatgccgaggacgatgtcaccagttcgccgctgcgatgccggaggtggtggtggcgcggccgacggcgcacgggtagaggaagggccaaccggggaaattccggcgaggtggatggagaggccggcacggcacggcggtgttccggcgaaaccgaggagtggccggggaaggagacgatgccgcggtatcgaaggaggagacgaaggcgtcgatcggcgtatcggtgatgaacaggagccggccggagacggtgtagtggtggcgacgccactgaacgccggcgagaacgcgcctccggtgctctccgcgctaaacggaggacggcccgggggagaggaggcggctgcgaggctgctggtggcgacggcgcgaccggatggcgctccggcgaggtgggagaggcggctggaggcggccggcggcacaggagagagaggaggacggcggggagaggtggtgaggccacgggagagcgcgggagggggctaaaatgatagaacggagtgagggggttccattgtataggatggtggagggagccgggcatgggagagggcggaacggcgacgggaaacacggccagcggccatggaaggcggccgggaatggcaggg

SEQ ID NO: 24748 - DNA, 1501 bp, Oryza sativa
ggtgttgttgccaaaaataaaaaagatcagtgatatacgtttctgttttggatggcagtaatctatcgacaccttttacccttctatccataagacaatttgttatgcatactaatcttcaatccttccagattggcaccggtgtcacgaatgcactgataaaagcaaggaaggctgttgacaaagagctagatgacgaagttgaagatattccagttttgtcaactagtgttgcttatggtgtatacatggcagtatctagtaacctcaggtaaacattatcttcaaactactcaccatttgtagcatacttaagtcatgctaaacgtgtgaataaatgtcctgtcgttttgttactaagggacctggaggacttaccccaccgttgaaattgttttacctgtttctctcttcaaacaggcaaaccgttgtagagattatacatgaacaatccttgtgcagataaacagttgcttcttttttaaatggattattttttacaacaaaaatcatattcatcaccaggtaccagattttggctggtgtaatcgaacagaggatgctggagcccctactacataaccacaagcttctattgagtgctctatgctttgctgttcgcacgggcaacacattcttgggttctttactgtgagtaatatttacctcgcatgaagtttaactcctgaccttggggcagtaatgttacttactgatgaacttttgttaccagatgggttgactatgccaggtgggtaggcgtacaaaaggttcaagaagaggcctaatgttggcataccgtaagttactacgatatgtattctacaacgtcacgacattcttctcttcatagggaacatctttactggtaaaggcagaagataggcatctccatatgtcgaattcatatcaacagtgtcaccgtatttttcttcatagcctgcaacttgtaagacttgtctttgtaatatacgagtttttgacccaacgagcactcggagggacctgtttattggttgtctttgttctaggattgtcgtgccttttattttcacttatggggactgttgacagcactctgccggagtttactcatgtaatgttgataaaggactgtcagtctgtcaccatagcattcgtctgaagaaaaacactcttcccgtttcactttgcctaattcgcatctttcgtatggttcgattgattctgaaaattatgcaggatcacacacaagatgaggggtttagcacaagtgtcgtctcaaagatacctttctcctatattgctatttgggccttacacacatcataggctgggccgagggagatagcaagatagcccattaacagcagcaaataaaccctaataaaccatgacagcctctcgatctcctcgtatttccccaaacccttgccgccacgatccagacgtccatcgttcccgccgctggtgcagcagccaattgcgatgtcgtcgtggccgccgccgccgccggtgcaac

SEQ ID NO: 24749 - DNA, 1501 bp, Oryza sativa
ttaaatttggcggttgtttttttttaccgccaaagaaattagttggcaaaaaaaaatacggattcttgtagtagctagcactactacgaaaaggagtttttcgtgcggtcaaaaagggtttagcgtgcgggggggggaggggggtgtgaacttcacgcacccaggtgtttgcaaaaattgctatttttgtgtgcgggtggcgcacccgaatgcgaaaactgattttcgcgtgcagggtggttaggtcgcccgcacgcaaaaataaaatccaaaaaaaacaaaacctaaccctaaagctgtcgtcgtcgccatcacctcctcgcggtcaccgtcgtcctcgccacgcctcctccccaccgcccgcaggccgctgccagcgctgcgccggccgccaccgccgctggatccacgcggatctgggcgggggatggccgtcgccgccggatccgagcgggggccgatcgccgttgcccctcgccaccttccgcatgcgcccgccgacgcgagcacgccgaccgccgcctcttgcctcgctcgccgccacgcccgagcggccgttgagccgctcaccgccagtcccggcgccacctcgtcggtgtcgccaccgagccgcggagaggagaggagagaaagggacagagaggagaggagagagagatgagtggaaataaaagggagagaggtgaaaaatttaaagtgaatgagagggaaaagaggtagaggtatttttgcgtgcggacctctgcgaaaataatcttattttcacatgcggtccatttaagaggattgcacgcaaaaatcgatttttccgtgcggttctattaaagagccgcacacaaaatggatgacgattttcgtagacgtgacctgttatggtctatctgcaatctaaaaaggttcatgtacacaggaaaatcgtttttgtactattgtagatatcattatatattgctccatcccttatcttggattgatccataccaacaataattgtcgtagcctgtcggatgaatccatacttgaaagagaaacatagatactatgtgcagaaaatgatatgtcaactattgcatagtaattgtattattgtaagcacaagttaggtcgattaacgcaataatggacccaaatcactgataattaagaacgaacgtgcttttgtgcttgatactgtgagtcagtgaccctaacatgcatgtacactgttgtttgttgagagcaagacaaacacgtctggattaaactagtagcaaagcaagtatcacgaggaccatatagaattataaatcgtacgacatagctatcaaactttctgtaaaaaaaaaaagaagaagacattgctccgaaattatttttcaccgggggaaaattcagagtactagctagtacgtgtatatagatcgatatatatctatagccactgcaacttccaactatatatatatgcagcacagatcgagctcacaaacaataaagatgataaaaatggccggaatagtgg

SEQ ID NO: 24750 - DNA, 1501 bp, Oryza sativa
acgaaaaatccttggaggcaaaagcattgtcgaagaggcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgtagaaaagacatataatacgacgtgtgttttattgcttaaatatgtgaatgtcttttttacatgtgtttttcaagtgtatgtaagtcaaatcaaaactatttactagaagctactccttttatacctttgtccacatgattatgtgggttttaaaatattaacatcatgtgtgatgatatatgatgtatgattggtctttgtgtgatgtaagttggcaataatttcccttgccattttgttttgtgccaatctacaagacaataagagcaagtttaatagtatagcccactgctagctccaaaccatctataattaatgtaatagacaattcatacaacagttgcttactatactattaatatctggtcccatctgtcatacacacattacgtcttgtagtccgtgctgcagctggctacagatctgtagcccgctgctcttctctctcttcctttatctctttaaaatatgtttatagttggcttatagcctgctattgtacctgctctaacctgatttcccctcttcaccttgttgcacacgaataatgtattttcctgatttatctcgaccatattctgtactttaaaatgtgattttaaccaccattctcattagaatgatatagaaacatatcctaaaatgaattatatgtaactctattttctatctggacatgattgacctcacgtttcaccgtcggacggagggagaacgtgaaggcaatactgtaattaacccagaagaacaggggtataatagtctcatactttaaaccctagagcaggtaaatcaactccgccgccgccgtcggcgagtccaaaacccttctccggccggtgtgtcgcgtcgtcggccatgaagcggaagcagaagcccgccgccgccg

SEQ ID NO: 24751 - DNA, 1501 bp, Oryza sativa
tttattatttacaagaggattgaaatcaatatttgcttattattatgttttatcatctattcttatatagatacaatccgccaattgcatttaattgcaacaaaagagctgtcgcatttagccgtgtcatcaaacgtatttgcgattggattaaagtgtgtatgagttatcaaccattagatcaatgtttcttatagtaaagtagtttaaaaaccccaatgcaacgcgtcatattcactattgtttttataatcgttatcactcagcaagttggccttcatcaatatcttaattctggcttagccactgtctaaaatatgtgcaaaggatctagaagacctaacaacccacatgacaacattcgtggatcacgagaaccaaaagatgctgtaaacaaagaaataataatgcaaactatacatgtgtacgtatgtcggacataggagacatgaaggcagcaattgtgcgatctttcaggaattgaaaattacatgttttaatcttaatcaactaccattttaacaaattaataaatataagctcaattggttatgtttttttatagtgaaatcgtggctagatttaagttctagactcacaagtgcttacatttacgaataattatttttttagtgacaggtgacacatcagtcgatggtgatatccgtagtgatttcatcaatctcaagatatattggccagtctttcaaaaatgaaatgttgttataggtaggatctacgtatatgttttcatagtagtgagcattcacacgttgtgagcggttgtgtttatgctgtgtattaaaaaaaactaattagtgaaaatagcaactgcaaataaaaatatttcaaggcagttctgtgcacaatggctcggtgcctggcaagggattttggagtctgcttatttcagctacgggctgtaagccaaaaactaattttaaattttagaattatttttagtttttatgttgtttttgttactcggactaaaattaattttctttcatcagttacatgtacatgtcataatttaatttaaatcttggccgagaacaccggggcgtgcaggttggatgacagacaccggtgtttggcgggtcgcaggagcaggagacgacagacactgaagcgtgtttgtttaaaataaaattgagaagctgatgcaagaagacaggaacaaaattgttgcttgtgcccctcaattaggccgtgtacaaaataaagagtccgaggtggactcttaatcatttagagacgaaatagtaaagaccattatttttattaccattctttcctttaattttctccattctcatgcaatatgattaaattttaagagtcaactttgagtggttgttatgtgtagcaactattttttcttttcctttccaatctctttcatatcaccaaatttacttgcatgataacgaagagagcccgttattaaacatcgttttacatgctctagtttcaatcgtatatatatatatatatatat

SEQ ID NO: 24752 - DNA, 1501 bp, Oryza sativa
aatttggagaattgcctcatgttccaccaaatcaaaagctttttcaaagtcaattttcaaaattatcatctcttttctggactgatgacactgatgaatatattcaaagctccaggctaagcaatcttgtatggttctgcttctgatgaaaccatattggttatcatgaatgagtttcagaattacttcctgcaatctgtttgccaagatttttgtaatgaatttaagtgctgaactctgaagtgcaattggcctgaaatcatttgctgtttctggagttggctttttcgggatcaacgttatgaaggagtgattcaaattctcgagggagacattgttggtaaagaactgaaaagccaactcatagaagtcttgttttatgatactccaacatttgtttaaaaataagccattgaaaccatctggtccaggagccctatcagtaggcatgtttttaatgatcctgtccagttcttctgtagatgggatctcactaagacactccaagccttccattctacgaaccatatcagacaaatttaagatcatgtccattgagccccgagttcccattctgtttttgtaggccatatataaaatctgttctttttcagcatgagtagtaactatacttccatcatccaaactgagatgcgagattttattccttctatgactatcagttgctgaggcctgaaaaaactttgtgttctcatccccaaattttacccatctgatggtacatctttttttccagaactcatttttgtaattcaaaagcttgagaatatgttctttgagaattattctgaaattccattcctgcagagctagaggtctttgttcttccagatcatcaagggttgtcagaacttcattactatttgaaatttgagtgttgagatttgataaccttttgctccaagctttaagaccccttctaagatttttgagcttagcattcaagataatagcctggttgcttcctctcactggtattgaccaacagcattcaaggttttgatctcgaatcttttgaaagatttattgtaccagaggttagttgtactttgtcctactctttttgtcaacttttttttcatttttattggttgtatgttgagatttttcatcgcaaaaaatacttgacatggaggaagaaaaacattttttatttgttatttggagctcaaaatggcaaaatttgcaagaaatattgtgcatgatcgatgttccatatatatatctagttttcgataggtttatttttagcagatttatatattagttaactgcaaaagaatgagctagctaggaagagaagaagagaaagaagggtagtttggtaattcgtctgagggatgtatgttttatatatgcagatttttggctagctttaattatcttgttcaaaatatttgaactaactaaagttgtattattttttccgcaattaattaattaatgcatagatggcagacagggcacggatgaataaaga

SEQ ID NO: 24753 - DNA, 1501 bp, Oryza sativa
tctacttgttcttgcttgttcttcgattgcttgcaggacgagtgccctcgtggccgggttgacgcgcaccacaagttcgcggcgaccattggagacggtgtatcggttgctaaggcgcagcgtctttggacggttgtagtcgggccgtgaacgtcgtcttcatccaatcgagttatcccttacctctcatcgaaagatcgggccacaaaccctagcgggttcgcatcagatggtatcagagcgtggttcatcggtgagagaatttacccttcccttcgtcattaatttttttttcctatagtccagaaaaggccaacaaaaaaaaatagtagattagttttcccgtgatcctatagaccattgtgcttttttttactagtactgcttagttaaggcttgttgagttttcgattgcatcggttgtgttaatttgctggtcttagtgttaggcgattagagtttcgagttcttgccaccaccgcacatcgccaccttcatcaatttttccgtcatcaccaccgtcattgccgtcgcagtcacccaccaaatcactttctatttgtgtttgatctgttgccgatagcttttgtgagttgtcttgtatcttgccgccactagaaaagaaatagaacactgattcgagtgaccttccttaaaacagtcatatctttttcagacggactcgaaattaggcttataatatatccacggacatctaaaaaaaaagttacatccgattctcccccacttcgccgggttcggcaaatttaaaattgccaaattcctcttgcaaaattttgtttttgtggcgagaagcttcgggacctattcgcatagaactttgaaaaaattctacaagcttcatactttgtccgtttgagataagattttctgtggttggttccagtgtgctcctggttgtgaaaaaaatatcagaaaaataaaataaaaataaaaaaaaagttgtgtctctctcctcagcactagagagagcaagcaaaaaaaaaagaggatccagcgagcacaccccaccattccccctttgtcaccaccttccaccaccgtttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttatgggttgctgtccccctcctgtgggcaaggtaagaactggtaagagcttgtgagacaagttgcgagtgaagtgagagtgagcatcttgcaaaagctaaatcccaatagttgtgtagggcttacattacatactccattgttttgttgtccttcatttctaaatcatggcaggtc

SEQ ID NO: 24754 - DNA, 1501 bp, Oryza sativa
ctgtgtttttttggtggatctgtgtaagagcaagttacaaaatatcaaccagccctctcctctcccgggaaaatccaaaaatcccccccttctctttgtgggcatggtcctccttttatctcttaaggggataccacatgtacccttccctttttaaactggacttttcttctttacataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgccagctccagctggggacgagtgcctagaggctctcatcttgacgggacggggcgaggcgtgagtcagaccgccagtcgccacctaaccgttgatctgaccggtctgtgactggtcacagaccggataaaagagcgcgctgcattgcgctgcatgcagcgtgacacgcttaaccagaccgcaataaatgcggttaggtgagccctaccatgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgattatccttctcaagggaagcggtcgggcatgacgccactcataaagcctggtgacaggtgggaccggtctccgtgattgggcagaaacccaacggtctcaaaccacgcatatcggtaacggtgtctgggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgaca

SEQ ID NO: 24755 - DNA, 1501 bp, Oryza sativa
cgaggttgcactgggcggcgatggaaggtgcagcggccaggagggtgtagagctcgccatggctattgcaatgaagaatcacgcgcctggtccgagggtccttaatagaaaaaccaaactcgtcaaactcaatggaacatttattgtcgcgggtaaattgacgaacggagagtaaattgcgaaccagagggagcaacaagaacatgacgaaggtcaaatctagtggtgccaatagggagaaaggaagtgccatttttatcaaccggaatagagggaccattaccaacggtgatataagtgtgtgagttggggaggcgagtaacgagtataccatcggtggaggacatgtgcgaagtggcacccgtgttgagaacccatgaattggggctgtgaatcgtcatttgattgagaacggcgacgaggccggtttggtcccaagccggctggacagaccctgcaggcggcggcgaggagtatggcccggtgaaggcagtgtgggcctgaggatacggcccatgtatcctggcgctgggggcacgccagggttgctgctgtcctgcccagggcaagaagcacatccatggtgcggcttagcgtggagcagggatggagaaagtgctggtgccgaagctgttgccgccgttgttctgtccaccatggtggccgccgaatccactgccgccgttgcccccggagttgcggttgttgcggccgccgttcttgcccttgttcttgccgccgttgccgccgccggcgcggctctgctgctgcccaccgctgccagaggagtggcaagtgcccctggcgcagttggagtaggtggtgttggctgtgacgagggcattctcggactggacctgcacggaattggcgttgcaaagctccttgagaactagcgtgttcctcaccgaggtgaaggacgacaagacaggggcgctcgcgatggtgtcggccgtgctggtgaagcgcgagttgacgccacggaggaggttgaggacgagcagggactcggtgacggggtggccgacgtcgcggagggcatcaaccgcttgtaagttcaagtgccttaatttggttttggtgattaatgacaaatctaactatatgagactaacgtttttatgagcctttctttgaataagctcatttggatatgaaagtaaaaatgatgagaggtattgttttaaccttacacaattctacttggtttttttgtgggatccaaaattaagggagcttcctcatgactttattgactttatgggcaattcggtcttcatatcaaatgatggctttttggggggagctattttatatttgttttatagaactttcctggtttgaaataattttattaccctttttatggttattggggttttttttccaaaaaaaaaaaattaaaaacttgttaacaaaggaaaaggggttgggaaaagaaaaacaattttgggttaacctttttaaaatgtgaaaggttttcccaaataagagggggagg

SEQ ID NO: 24756 - DNA, 1501 bp, Oryza sativa
gagtctcgacctgtgcacgattcagcgcccccaataactcctgaatctccaagagcaccttgccgaaatccacattctgcttctccatagcttcgacttggagttgcaatcgagatatgtagcgtggcttctccaggtttacggctctgataccaaattgtcacgacttctaagaattagggtttagctaggaaggaatcggaattgagactggaacaagagcagcagaggaagagggatttggggaagaacaacaatagaattgggagagatttgaattagtttcaggaaaagtgtttctacattgttcgattcaatccagtccatgccggcctcttatagcattgcgctaatgggcctcactcgcttacagtggcccagcccaatatcactgagtccacacactcgagttatacaatttattaggctgtctctcccgcgcagacttccttctctgctcgttgtgtgatattggttctttgccttgatcatccttgccttggggttgatcagatgaggtagccgtcgtgacgtgcacctaacccaacacaaacaaagattgatcgatgtttttgcacccctgactgtgacattctgtttcagcactcaagactcttgcccctttccagcttttgttttgttcacacccctatgcttctaatcggccaggacgagcaagcaagagtgaaggtatttagatttgagagtttttggctgcaatacccctccttctataggcctctgaactcaacaaaccccctggcaatctttagattaaagctctcgagactagcaagagacctaaaaagatgggagtcgaagcaggttggtgacattaaacttcaacttgcaattgcaaatgaagtcatcttccaactagacttggcccaggaaagtagaaacctatccacagacgagagaactttttattccactctcaaaagcaaagtgctgggactagcggccttaaacaaaatcaaaattaggcaaagattgagactaacttggattaggagaggggacgcaaacaccaagcttttccatatcaaagccagtgcaagaagaagggacaatttcatctaatccttgcaaactgaaaatggaattgccacctcaaaccaggaaaaagaggaaaaaatattctcatacttctacaaaaggcttggaacggtgcataacagagttttctcactcaactagcaaaacctgggagtgaacagttttgacttgcaggatcaagaagatgacattacaatggaagaggtagaacaggctttaaaattgatgccatctaaaaaagcccctggcctgatggtttcattggcgccttttacaaaagatgttgggatcgcatcaagctggacctgttcaatgcaataaaattctttaccgacctaaatcaaaactagcttgaggaattaaatagtgctcacatcggtctgttgccaaagaagggcgatgcctcattggcagatcattacaggcccatatgatgtgacca

SEQ ID NO: 24757 - DNA, 1392 bp, Oryza sativa
cggagagtaaattgcgaaccagagggagcaacaagaacatgacgaaggtcaaatctagtggtgccaatagggagaaaggaagtgccatttttatcaaccggaatagagggaccattaccaacggtgatataagtgtgtgagttggggaggcgagtaacgagtataccatcggtggaggacatgtgcgaagtggcacccgtgttgagaacccatgaattggggctgtgaatcgtcatttgattgagaacggcgacgaggccggtttggtcccaagccggctggacagaccctgcaggcggcggcgaggagtatggcccggtgaaggcagtgtgggcctgaggatacggcccatgtatcctggcgctgggggcacgccagggttgctgctgtcctgcccagggcaagaagcacatccatggtgcggcttagcgtggagcagggatggagaaagtgctggtgccgaagctgttgccgccgttgttctgtccaccatggtggccgccgaatccactgccgccgttgcccccggagttgcggttgttgcggccgccgttcttgcccttgttcttgccgccgttgccgccgccggcgcggctctgctgctgcccaccgctgccagaggagtggcaagtgcccctggcgcagttggagtaggtggtgttggctgtgacgagggcattctcggactggacctgcacggaattggcgttgcaaagctccttgagaactagcgtgttcctcaccgaggtgaaggacgacaagacaggggcgctcgcgatggtgtcggccgtgctggtgaagcgcgagttgacgccacggaggaggttgaggacgagcagggactcggtgacggggtggccgacgtcgcggagggcatcaaccgcttgtaagttcaagtgccttaatttggttttggtgattaatgacaaatctaactatatgagactaacgtttttatgagcctttctttgaataagctcatttggatatgaaagtaaaaatgatgagaggtattgttttaaccttacacaattctacttggtttttttgtgggatccaaaattaagggagcttcctcatgactttattgactttatgggcaattcggtcttcatatcaaatgatggctttttggggggagctattttatatttgttttatagaactttcctggtttgaaataattttattaccctttttatggttattggggttttttttccaaaaaaaaaaaattaaaaacttgttaacaaaggaaaaggggttgggaaaagaaaaacaattttgggttaacctttttaaaatgtgaaaggttttcccaaataagagggggaggccctatatacagctaatgttggaaaacaaggtcacctctttcacttataggcaatt

SEQ ID NO: 24758 - DNA, 1501 bp, Oryza sativa
ctaatcatcataatagaatagtttataacagggcacacgtgtattccacatccgcactccagcacaaaaatagagctaccataaggttccaaaatatataatgcaacttgaacaaaacgaggagttcacttcctggtgacacccctacatattagacaccttcatttcagatttatcatacagccgggctgagaaattagggcaatgtctggcgacagggcacaccacaactcgatcaactaagcaaacgatgcattacacacgaaaaaaaaaggaagcatccagagccagcaatccgcgaagcatggagcacaccccaacccccctctacagcatatgagcatcatcaccaacaataacaaaaaaaaaaacctctaatattactagctaggattcgcacgaaatccagagcatcggggacaccacccggccatccaacaccgccacgtagcaggagacacccgcgggggatcctaagtgggacagagagagagaggcgcgcttgcgggcataccttgtcgtcgccggcggcggtgggggaggaggagaaggaggaggaaggcgcgacgaaaccctagtcgccgcggctcgcctcgcgctgggttgcctcgtcgtcggggaggaggagagagcgtaataaagaggtgaggggagaccgggagagaaagggaggaaacggggaacggaaggaggacgggggtggtgggcccgggcggcgtggggggaaacggtcgtggagcccgatcgacggctggagatcggcgcggttcccggatggacggctgcgatcgtctcttgctcccacaacatgttagtttcatcttttattttccaccttctccttcaagttttagggggcttctactattgatggaaagctttttctggaaataggcttttttggacgaatttaaatagtaagaaaaaatgttttgctctttgttattacaattaaaatgagaaaagaaaatacataggccgagtagtcaacgggtcaaatataagtcaaacagggaccaaacgtatttgcatttgtaattttagacaaaaatgaacacctaagaaatggtaagttaacgattttttacacacacatctagtccgtccaattccaaaataaattggtttttagattcacgtaggagtagagaagcgaagcgagaaataaggaatggaagattccaaacaaccttttttcccactcttatatacatgcatcgatcaatttcatgtttcgtgcagtgcacgaagctgcaatggatgaacatctctggaccagacatcaaactgccagggacttttttttttgaacgactcgcacgagacggtacgaagttctattaacagagcaggaaaaaaaataaaagattacaaccctggagaatcgtaaccaggaaaagaaaaaaaataccaccacccacacgacgatatcgccaatacacaagcccaggagaaggctagtaccggatcggccgccgctaagcgtggccgaccgccacta

SEQ ID NO: 24759 - DNA, 1501 bp, Oryza sativa
aaagatcgggccaacaacagccttgagtgtcgagaggaactcagggttcatcacaacatgttcttccctcgctcgccccttcttttcttgggtttgcttaaagctgttgtgcgcacgacagctgtagcttcagcttcaggttcagttgcggcttgggctttccttttcgagcgacgtggagcattcaactattgtttgcaattaacgtgactttaattaaaatccatagttcgcagttaatatgattggaactaaacatatattatatgctaagtaccaccggttcggggggaacgtagtcggagtcaacttcattgtcgctaccgccctttctcttctttgcaggagaaggatgggggtcactcggcgagtgatacgatccactgcctggttcacttgagctagacgacgaagattcctccgcgactactttcgtgcaaatatcttcctccatgactagctgagtttccttgcccttgtcacccgtgggttgctcttggatgggtttgtccattgatatcgcttgaaggtgaatttatgtaagttgcgaaatggaatcattttcttattgtaaatccgaaaagaaggcaaaatttagatactaattttgtacaacaactataaatattgttatcgccagcaaactccttgatcgcttaaagcaatcaatgaaattggtaacggcatcaatattacaatccaccaaccctgaccatttcaaactacctaattaagttccttaattatcaaagaatgacataatacaaaatgcatggagaattatggtgtttaggtcggttctgtccatggactacactgaccaatccaccataattcgctatgcattttgtattctgtgatggtttgataacctaggaactacattaaatctacggccaatctatcaattcttccatttaagctacatttcaaaccctaaacctaattaagttccttaattatcaaagaataacagaatacaaaatgcatggagaattttggtgtctaggtcggttccgtccgtggactacactgaccaatccaccataattccctatgcattttgtattctgtgatagtttgataacctaggaactacattacatctgcggccaatctatcaattcttccatttgaactaaatttgaaaccctaaacctaattaagttccttaattatcaaagaatgacataatacaaaatgcatggagaattttggtgtctaggtcggttccgtccatggactgcactgaccaatccaccaaaattccccatgcattttgtattctgtgatggtttgataacctaggaactacattaaatctgcggccattttaagctaaatttcaaacaacacattttgatcgccatagtatcaaactaacaaattactcaatttcagtcaaactaacaaatttgtgcatctaaatattcacccacagtcatctcaatgaatcatattcagatatatatatatatatatatatatatatatatatata

SEQ ID NO: 24760 - DNA, 1269 bp, Oryza sativa
  unsure (1)..(1269): unsure at all n locations
cttgaaatagcttttttgaactgtatggacttatcatgcaaatgtttgttctgtgcaatttgttgaccaacttctctgaacaattttgtaagttaggaagtgatcccaactgtcggtctgctctagcgaaccactagtacacaaagattacaatacatgtataggaattacacaacacatgtatagaaatttcacaagttaagaatatctgggctgagaagacaggactgaagtgaagggctatcaaccgtaggttgcacatctagtggcagcaaaaaagtgactgaaattttgtaaaatttcaggtgattgaaatctagattcccctgtgtagcatatatgatcccttactattaggaatactttgacatatatgtacatattgtattgaattgtctctttccttgtattctcctctaattgaggatcatgtacatgtgcttcctatatcaatgcatggccacccctcccattgggtgtgaggtgttctccccattccattctacatggtatcagattccaagttttctcctcttctagtactgctctagcgccgcttcctctggtcgctgcgtccaccgagcgctgccgcctncctggctgntgcgcccctccttcctcaccatgtncacttnctcggctaccttcgctgncaccgactcctctacggcgtcgtcttccacctctaccgtcgccccggtgttcatcaacccgtatgcgactgtcgccgtcaagtcccatgtccaatttctctcgagcttcgtaccccaactacaacaagtgaagggcttcttccgctcgatgtgtggaaatttggtctcctcgatcatcttgacgctgctcctcccgcaaacccngacgctgcttgggaacagcccgattgctgcctccgcagctggcttttcggttctgtcgcagacgacgtcctcgacctcgccatgaagcccgatcaatcggcttgggacttgtggatctccatcgacaccctctttcaagccacaaaggagcttcgcgcgatctatctgcatcacgagttccactccatgacccaaggcgatctctccgtcgccgattattgtcagtgcatgaagacggcggtgtaggatcaaggaggccgactagagggggggtgaataggcggttttaaaacttaatggcacttaaacaaaactaacataagttgctaggcaaggtgaagtgcaaggttaactaagcaactaagttaagttttgcaaacctaggtgatatgggctcaaatatgtctctata

SEQ ID NO: 24761 - DNA, 861 bp, Oryza sativa
cctattggacttcacccaagcggctactttttcttcatgagaccacttgagattttcatattttcctcctcgcccatgtcgagttcttcagctgatttgagttcctcaggaggatcctctcttatggccaagtcgtaatccaacaaagctaagttaagacgcatagtcacccttttttcaatatttttgttttcccctctttggtttttagtctgatttacgtgaagtaatacatgtatgcttcatcaattgtccagatctagtagaaatgatgttgttttatttagttgggtagttgggagttggtatcttgtggatgttttttcatcatgttgttcaatatattattatgtaataattttgctagatagatctagttctttttcaagtttgtaggtctgaatatgtgttggatctgtcgtctcttgtggttggatgcatggtatatggttgtgcttgttgcattccacgttttgacaatgtataatgcatattataaatttgctatttgcatagatggtagatatacgtcataacgttagatcctaatggctaaagctgctggtttagttgttacaatgtgtgcctacatgattttcattatgaggagagctaggcaacgccatcactaggattttctatgggccattgatggaaagggacttaattagacaaaccaacccattttttggctgtcatttgttgcgccaaagagagctactgtgggactcttgttaacaatgaaatttggtaagccccaaagtcatcatcggcctagtgtcactatcggcttcagagtcatggaatcgaccgatgggaattatcaagttgtcaatagtaggattcttattatatttggtt

SEQ ID NO: 24762 - DNA, 1501 bp, Oryza sativa
acaagctgtggaatcttctttttgttactgtctttgcatggatcggactcttctatatcgtcaagggcaacatccagatcctcggactggctacggcttgttttgtattgactactcttgcatgttggacatctgtccaaatcctcgtactctttacggaataggatacagtggttaacacacgcgtgtatctttcgcacacccagtgacaaagggcatataagcttcttcgcttcataggtgcttgttggcagggagttgggttgcggaaaaagtttcttcaacagaaccaacaagtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtgaccagtttgtgtatccctcaacaaatccatgcatcaccaagtgttgctcgattacagatggatcattccaacttttctgatttttgcagtgcacgcatggacatctaatatctttggtcttcttagatgcagcattcttcttagctgctttcatgaatatgtcgactcattcaatgtatgacgcacgatatctctctttattcatccgtgccctgtctgccatctatgcattaattaattaattgcggaaaaaataatacaactttagttagttcaaatattttgaacaagataattaaagctagccaaaaatctgcatatataaaacatacatccctcagacgaattaccaaactacccttctttctcttcttctcttcctagctagctcattcttttgcagttaactaatatataaatctgctaaaaataaacctatcgaaaactagatatatatatggaacatcgatcatgcacaatatttcttgcaaattttgccattttgagctccaaataacaaataaaaaatgtttttcttcctccatgtcaagtattttttgcgatgaaaaatctcaacatacaaccaataaaaatgaaaaaaaagttgacaaaaagagtaggacaaagtacaactaacctctggtacaataaatctttcaaaagattcgagatcaaaaccttgaatgctgttggtcaataccagtgagaggaagcaaccaggctattatcttgaatgctaagc

SEQ ID NO: 24763 - DNA, 1501 bp, Oryza sativa
atctcggcttctcctttgatgccactgcctagggcatcccccgcgccgacgccgccgtcgtctctcgccatcatctcgctgtcgtcgtcgtcatcaccgccgccgccaccgccaccatatctctggggttgccgccgctgcctgcgcgaactctctctctctctctccaaaccgccgccgcctcgtcgtcgtcgtcattgctacgcctgccgacgccgaccccgactccgccttccgccgatgccgaccccgacgtcgacgcggccgccactgccgacgacgcccccgccgcaccgcgccatgccgccgccgctccttttcgctgccgacccatcaatgccgaacgtgaacgaatgcgaacggacatgaacgaacgcgaacggacgcgaatgaaacgtgaacaaaacgcgaacgaacgcaaacgaacgtgaacgaactcgaacttaacgtgaacgaacacgaacgaacgtgaacgaaacacgaacgaacgtggaggaaacgtgaacgaacgcgaatgaacgtgaattcacttgaacgaaacgtgtgaatgaaacgtgaacgaacgtgaaggcacgtgaacgaaacgtgtgaacgaacgtgaaggcacttgaacgaaacatgtgaacgaacgcgaacgagacgtgcacgaacgagataattaaacgattattaaacttagcatatatatatatatatatgattatatacttgaaaacgtgaacggaaaatatatgttcctttgcgtttagactaatacatttttttgcatgttgcagataagagacttcgtcgtcgtccctcaagccgaagtggtagctaaccctcggaggaatttgcgcaggcaagtgatataaagatatgattatctagagttctaatatacgaaacttagacttagcatatatgattgttagagttttaatataagattattagagttttaatatacgaaacttagacttagcatataagattattagagttttattatacgaaactttgacttagcatatataattatttgagttctaatatacgacacttagacttagcatatatgattgttagagttttaatataagattattagagttttaatataagattattagattattagacttagcatatatgattattagacttagcatttctgattattagagttttaatataagattattagagttttaatatacgaaacttagacttagcatatatgattatttgagttctactatatgattattagattattaatatataattattagacttagcatttatgattattacagttttaatataagattattagaattttaatatatgattattagagttttaatatacgaaacttagacttagcatatatgattatttgagttctaatataagattattagagtttttatatacgaaacttagacttagcatatataattattagaattagcatatatgacctatagaattagcaaatatttcttgtatgaataga

SEQ ID NO: 24764 - DNA, 1501 bp, Oryza sativa
gaaatcgtcccggaaacagagtgaggatcggctgaagttcgaatcggctacgactaagatcggcagagttcaagtcggacgaggttagccgattgagccgaatccgacaatatgacacaacatatgttgtcggtttaggttgatgtgcttcatgataattgctacgcatgtatagagtcctgagaaggcaactgtatcaattaattaggatattttatgtaattttcttagagatatgtttgggcaaaagtctgccgcaaagacttatggtatcttagagtttgttagagataagagtcgtgtccgatatggacatattttgtaattctcgggtataaatagacccgagccccatgtaatcaaactaacacacgttcaatacaatctcggtgcattgccaccctttttactttcgttttgtttcgacgagttcttactttcgggttgagctgcatcggtttcgatcttcaacaaggggtaaaacttgttatggtggcttgcgttctcgggattagtgcttccatatttatgacactctaatcttttttatgtaattcgtcgagttatcatatatctcacataatctctggcaatatcgctatataacctacaatcggctaacatctgtcagtagaaggcagccgattaggttaaacatcgatgctggcttagattatataagatatccaccactctatgacacatccaacggcttgattgtctagatattattcttcttttcatacttatagctgcattagttgagtttgatcttatgagtcgtgattagaatctcaatctctagcctgcctttgattgccgattagggtagtatcagggtttcagccgatcttacctgatttaactacatttatcttatatgccttattgacatgttaaattcgccctttatgttaatatcttgatgcatttaagtatattaggctttcgtttggtatattttacttgctgtgatatcttaatatagagtggtatcgaagtattagccgatacacgctagatctatcttatcagctatggtataaacacatatagtcttgttattaatatatatttcgatctaagtgatttatactgtctcggcatggcgaccgatctatcgcaatcacttgatttaagtatatatcgatataaggactatataccgttaatatctacagccgatcgagtatatttagttctttcttacttattaatgattgccgatcgatgcatatatgacatcggctcaaagataaatgatatgtcatcggcatctagccgatcagctatcatttatagatttaaccgtggtttctttgtctttgtttcttgttgattgcaggatcaaatcaactggcacgctcgcatacccaaaggcaagttttggacctgcattggagttaagcagatctctcaggcctcgtgttttcacatcaacacgcttttggcacgcccagtgggacccattagaagtcagagtcacaacagcggtctctaa

SEQ ID NO: 24765 - DNA, 1501 bp, Oryza sativa
tctctcaactaatctccctctcccctctatctcaactgctagctcgctccacctctatggctaccattccctgtcttcttgatcgtcgtacatttataagcagggttacacttttggttttggtcgaaatttcggtggtcactgaaatatttttggaactgttttacatgaaattatttgaaattttaactgaaattgaatacattttgactaaattcacaaaaaaaattgaaaaaagagtttttttgtgatatagatactatgtttttctatatacttagtcaaacttaaagaaagtttgatgtactagaaaagaaaacaaaacaacttataagatgaaagtacatgctagtacaagagtgatgaaaaccaaaatagagttagtatctattacctcccgttgcatactataagtcatttatactatttgactgctcaaatatttctcacatttgtcaaaggggtgtttgtcctgtcaaactagcacttaccagtagtcccactggagatgtaactataactcatgcaatttgtttctaaacgatattttctcttttaaataaaatgcatgaattctcaaaaaaaaagtcatttatactattttactagtcgcacttttttatgtttaaccaagtttgtagaaaaatttaacatcatctaaaataccaaattagtttcattaaatatgttttgataatatttttgtagtgttgaaaatgcggaactatgtttttatataaacttaattaaatttaaaaagagattgattatgataaaaattacaatgttttataatatgaaacggagtgagtattttgtaggtcccttttgacgaaccatatatatacgccgcctgtgtgaatgtcatctcgttgttgcaagcaatatacgtactgttatttgggcatccctcggaaggctgatgagacctacatatcaacatatatatgcctaacaacctacgcgcagtctatcatgttaattatgtaagatcaaagtgtgttttgattcttattctgtgatgaacaattggcatctgtgattattggttttgatatttggagattatcgtcgaagtggttttggagataatcaattttcaggtgatgatcggattcactgttatttcatgtgaccggtccgaccgggcggtgtatgccggtcagaccggtggtaatcgagcagttagaccggcaggcccgcagtctgaccggccgacgctgtgtcggtttcggtttcggtttgtttctttggatattcgtgattgtttcatggttatggcttctagatggatactttacgtatgtaatactgttgtttgctaacaatgagtcaagtcggagatagcttggtctcggaatatagtttctttgtttgtttcatgtgtaggtgactcgatgcctcgggagagtatttgcggtgatggaccgggagtcggcttggtggaaagacgatgtccgtggtggtcagatatcacgcaggatactaaggctagagttga

SEQ ID NO: 24766 - DNA, 1501 bp, Oryza sativa
ggaaaagcagaaagagcacaactatattactactatttttttccttactaaattttttacttaggtagatgagttataaaaattctagatgcactcacagcattactaaggttgtgtttgagaggagaaaaaaagagaagtttaagaagatacgtaaaacaaggtgagctattagaacaggtacaataacagactattagccagctataaacatattttaatgagataaaatatgatagagaagagaatcgggctacagatatgtagccagctgcagcacggattccaagacgtagtgtgtgtataaattggctatatatggtgagaccatatataaagagtatagtaatcaactattgtatgaattggctattagattaactatatatgaattggagctagtagtgggctatattattaaacttgctcttagcgcatgattaattgagtgttaactatttcaaatataaaaatagattaatatgatttttaaagcaatttttaaatttttttttaaaaaaacacatcgtttagtagttcaggaagcatgcgcgtgaagaacgagagaaatctcctcttagtctcttgctactgaacgaagcctaagaatttgcaaatttgccaccgtttttttcaattttgcaagtatgccactcgaatgacagttctaattgcatttttgcaattttttagtggcgtttttgcaataacgattcaaagtagtagtaaatttacaattaccccaagaatttactggtaagaaagagttagtaataatttagtaagaaaaagtgtgtaggcttttccatgtaagaaatggataaaagggccttggtctaagttgggtaaatttaaagatattttcgaatcaaattgtataaaaacacgctaaaaaacacattccataattttacgtgtagtttatagagacagacagtgcgatgatacgcgtcaggggtgaaaaattttatcgtatcacatcggttatacggatacacatgtatcacatcggttatacggatacacatttaaagtattaaacgtagtataataacaaaacaaattacagaatacgcctgtaaactgcgagacaaattttttaagcctaattaatccgttattagcaaatatttattgtagcaccacattgtcaaatcatgaagcaattaggcttaaaggattcgtctcgtaaattagtcgtaatctgtacaattagttattttttaacttatatttaatacttcatgcaggtatttaaacgtttgacatgacatggtgaaaaattttggggtaggacctaaaccgagcttgctctacacttcaacaggatgaaatgtcataattcggagttgtattctttagaaaaaaaaatcaatttggatctgtatggctctggatgtaaactgtgcaaaagtaatgagtaaacctgattgacaacgccagccaaatgacagcatattgtccggcttgtggatgactgaaacaaacaagtcaaaatttc

SEQ ID NO: 24767 - DNA, 523 bp, Oryza sativa
ttctgggttgtgactgtccttaaacttgctctcaggccctagattcgtttgtcattgttaacaatttttcgaggagcttagctctggcaaccactggcgattgggtgtcggctaacaatggtgatcgagcacgccacggcgcgtcgcatccgcacgccaagaacgaaacgaaaaatccattaccgcgccgctgcgcacacgggaaagcagcagccaccgcggcagcaaatgcccagcccggaagtagcagtcagcgtctcgccccggcaaggagagatcgtgggcctcatgggccgcagcgtgaaggatagtcgttcttagacaaatgggctacgcaaggagaaatcgtgggcctcatgggccgcagcgtgaaggatagtccttcagagacaagtgggctttacatgggccttgagcccatgggctcaatgtttcggcctatgaagtagccaccggacagtaaacgcggcgtggctgccgttttggcagcgaagcgctatccacccagagcggagccttggca

SEQ ID NO: 24768 - DNA, 262 bp, Oryza sativa
gtcagtcacctgaaattcccatgtatatatatctgttccattcttaaagaagaaatattcaagtaagtattatatgtagctttgaagttactacatgtaattcagtttggtccagattgtttttggcagctggaaatcaatgtgccaatttggacagcctgcaaaggattgggcagagtgaagaataggtccatatggaatggacgcataattttgcgcccaaaggcctgtccccttgtaaattttgctgaatttttgcagg

SEQ ID NO: 24769 - DNA, 1501 bp, Oryza sativa
atcacttggttttttttaatttcttttttcctcttgtttttttccctatgatacatggaaggactacatatgtacaaacatgatatcatgtttaaggtcttgtttgaataatttaaaagttcaagtatagaacaaaacttaccgtggctatatattctatttcttcctactgcattcatcccaaaatattgctatttaatatgtgattaaacactttatagcatggagtaataattttggacagctaagagcgagtttaatagtatagccaactattggctccaatttatctatagccaatctaatagcttattcatacaatagttatgtcaatgggtgatacccgtagaccagatgagtagagtactagggtacgttggtacgaggatctacacgatacgacatcaagcaagaaaaaatacaaggattatattggttcaagccccttatcagctaatagctagtccagtttatatgggattaatatggaaaaccacataatacaataggagtaggcaaattcggctgtaccgacgagatcgtagtcgatggattcgacgagattttctggtgacttggcttcacgtgctccggctttgtaggctatggtcgatgtgttggtggtgaaattcgatacccgaaacccctcccgaggtgtcccttttacaccgtgaatcatttccatgtagaacttgaaaatatcggaccccgtacgatatagaagacaccttacctcctccgagtgggactttgttagtctcccgactcgtaaggatactttccataatatttgttgaattaccttagcgtatatggaagcaacctgtgtacgcaaaggtatatcatattcgtatattctataagtcataggatagaagatataccttctccgtaaccataacgagttacctataaacatatattacaccattaatatttggtctcatctctcatacacacaatatattggagtccgtgctgcagttttccttctctctcttctcttctctatttcacatgtgcttacagctaagagcaggtacaatagcaggctataagccagctgcaaatatattttaaggagataaatgaggtgagagaagagcaacgggctatagatttgtagcaagctgtagcacggactttaagacactgtgtgtatgataggtgggaccagatattaatagtgtagtatgtaactattgtatgaatgagctactagattggctatagatgaactggagctagtagttggctatactattaaacttaaacttgctctagtattttgggcgaaggaaggaaaagaaagcaccgtatgacgtggaaggatgggcccggggtcagcggcgtcatctccgtcgcaacagaatcaacgcgatcgcccccgctcaggccgctcgtcttctctacttgcaggctgcaggctgctactactacttcacttcggtatggagtctggagtctggacgtttcgccttctccgcgccgcccgctcgat

SEQ ID NO: 24770 - DNA, 1501 bp, Oryza sativa
acgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcaggtctaaaaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctca

SEQ ID NO: 24771 - DNA, 1501 bp, Oryza sativa
tcctgaggaggcggaggttgccatcgtaggcggcctggaggagcaccttctccttctcttgcttccccatcatccccttctcctcctccatggagagagagaggatcgatcgggctcgctcgggggtggagaaggcgagagagcggtagcggcaggcagtgtgctactcgctactagtagaagcctaggccctaggcattagcccttgactggaggtgacgtaggggcggaagagaagaagacgaacgatgcggagtgagttttgtagagactgcggagttggtggggaaggcagcgatagttaggtcgtggatactggatagatgatggttaaccaaggttaacactcaatttctccctttttaacgatggttaagttggaggttggtgttgggaaccatcccatacatggaaaacggagcggtttattaacgtatgatcaattaagtattagctatttttttaaaaaaaaatacacagtttagcagtttgaaaagcgtgcacgtgaaaaacgagaggggagtgttgggaacttgctcttgcaaaacacaccaatttgcacaataatctaaactcaaacagtttttttaaataagatatatattatattttttaatattggcagtttacacgcgcagtttctcacgattttaaggctgtgttcagcactctgtttttccaactcatctctcttttattccgcgcgcatgctttttaaactattaaaaggaatattttgttgcaaaaagtttctatacgaaagttgctttaaaaatcatattgatccattttttttaaaaaatagctaatacttaattaatcacgcgctaatagaccactccgtttcccgtgcaccagtagatttgttcctaacgaactcagcctaaggcgctttaaaatgcatataagaaaaacatatgaatagaaaaaaaaagtaaagtccactggcggttactaaacttacgtggttatgtcatctacctctctatacccttgaaatgtatttacggatccccaaatttatgttgattattatataggtccaaacggaaaccaatccactctaaatgctgacgtgacaatgtcacaattggggccgacctgcaagtgggaatgacatatcagtcatataaaaaagataaaattaaaaaaaaggagataatatgtttttaattttattttttccctatgactgatacgtgggtcccactacacatatgcaccacggtggcatgccttgtcaatgtatgaatcgggttagagtctgtttggagctgtaggacaaccaaaaaaaagtttgggatctaaaaatatattttaagagtttaatgacacagatgatacaactgcacaaagtttaagaagcacttgcgtactcactctagaaaaaaaacatagaaattaacgtagtactagatgtgtgaaaatagatatggaaagagaagccatttaattacactatataaacaatataactaaggcgtaacgccgtgcttatttt

SEQ ID NO: 24772 - DNA, 1501 bp, Oryza sativa
catatatatgttgatatgtaggtctcatcagccttccgagggatgcccaaataacagtacgtatattgcttgcaacaacgagatgacattcacacaggcggcgtatatatatggttcgtcaaaagggacctacaaaatactcactccgtttcatattataaaacattgtaatttttatcataatcaatctctttttaaatttaattaagtttatataaaaacatagttccgcattttcaacactacaaaaatattatcaaaacatatttaatgaaactaatttggtattttagatgatgttaaatttttctacaaacttggttaaacataaaaaagtgcgactagtaaaatagtataaatgactttttttttgagaattcatgcattttatttaaaagagaaaatatcgtttagaaacaaattgcatgagttatagttacatctccagtgggactactggtaagtgctagtttgacaggacaaacacccctttgacaaatgtgagaaatatttgagcagtcaaatagtataaatgacttatagtatgcaacgggaggtaatagatactaactctattttggttttcatcactcttgtactagcatgtactttcatcttataagttgttttgttttcttttctagtacatcaaactttctttaagtttgactaagtatatagaaaaacatagtatctatatcacaaaaaaactcttttttcaattttttttgtgaatttagtcaaaatgtattcaatttcagttaaaatttcaaataatttcatgtaaaacagttccaaaaatatttcagtgaccaccgaaatttcgaccaaaaccaaaagtgtaaccctgcttataaatgtacgacgatcaagaagacagggaatggtagccatagaggtggagcgagctagcagttgagatagaggggagagggagattagttgagagacgtgggaaaaaaatgcatgtgatatcatgcggcttcccaacccttgtatagctccccacctgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 24773 - DNA, 1501 bp, Oryza sativa
aggtaatacgctaatgctccccatgcccaaaaggtgttcgacaaaatgcttgcttagacgttacagttgtgatgttcagggaaatcacttaggttttaatcctcgctgagccatatcatatatgaactacgcctgccgccgctgctccgtctccgcccttcgtgccgctcgggaggagttgcgacggggtcgagcccctcatcgccgactacccttctccgctcgcagccaccgtcgtagcgtttaagtctctgcatatgctgaatctgaaagtaccagcctgctcttttctgctcgttggggatcaataggaaatgaatttcagaccgatactagcctgctgttataagtctctgcatatgctgaatctgaaagtaccacttatagtcattatagaaccaaacaggttggagcttgcatgctcagttgcgaacagatgtatttaggtgccagtctcttcggtttgcccatggctgcgatgcacaatagcagttgcgaacagagttttccttcctcgtatacctctatgtccgtctgatgatgatatgttcccgtttcgcttcaagaggaagcaatttccggttagattgagctttgcattgaccatcaataaggcgcagagtcaaacaattccaaatgcaggcgtctacttaccggagcctgtcttctctcatggtcaattatacgtcgcgttgtctagagcaacctctagaacaaacataaaaatactatcgatgccggtagaagacaagaaacaaaagaaaaagtctaagtgtactggcgtgaaggacaatgagaagaaaggaaaggaattgtctaaacaggctgcaacatacacaaaaaatattgtgtatagagaggtcctcacagattagaaaaggtatattatgcgactaattaaccatccacaatatgcttgcttaaattccattctttctgtaatttttatattccaagtcaaacatttcgtgtgttttttttcttggacagtagtaaacattactttcggtgggattttggcaaggcctatatacaccattacaggtattgtgatcaactgcaggttttttatgtgctacttatactaggaaatgaaaaatcgaagatttttgcattgtcgttgtgtcctacaactctacgagtttggatgcaggatgctagcggacaagttatccagtgcctgaactctgctttatctaacctggtggctgacattgacaacaaatctatttacaacactctattattagtctattacctgactctggaaaacaaccatcaactgcaaaaccatttgattcacatcccttcacctgatcccacctggtttcttgcttaggtagcttcatggtaaggtcaatatggagctgatgatacttctatatggttcttttttcttcttctttaatttttttacctaacaaaagtactgaagcatagttcttaggtctgatgatttatttagctgaatgctgattgttttctcttaaacctttccacg

SEQ ID NO: 24774 - DNA, 523 bp, Oryza sativa
tgcaaataaatgcaagctgcaggtaatacgctaatgctccccatgcccaaaaggtgttcgacaaaatgcttgcttagacgttacagttgtgatgttcagggaaatcacttaggttttaatcctcgctgagccatatcatatatgaactacgcctgccgccgctgctccgtctccgcccttcgtgccgctcgggaggagttgcgacggggtcgagcccctcatcgccgactacccttctccgctcgcagccaccgtcgtagcgtttaagtctctgcatatgctgaatctgaaagtaccagcctgctcttttctgctcgttggggatcaataggaaatgaatttcagaccgatactagcctgctgttataagtctctgcatatgctgaatctgaaagtaccacttatagtcattatagaaccaaacaggttggagcttgcatgctcagttgcgaacagatgtatttaggtgccagtctcttcggtttgcccatggctgcgatgcacaatagcagttgcgaacaga

SEQ ID NO: 24775 - DNA, 1501 bp, Oryza sativa
atttctaaacctgaaccttcttgcccactccgcctcgcctcgcttggctaaacaatagtcacaccatccgcacttgctcatggaaaaaatattcatattcaaaaataagttttgggaaggtttatttttaaaactaaaaatgaaaaggttcaaaaaaattaaaaaatatatatctgtgattggtcatatattacatttttatctgttggacttcatatttctaacgagcacggagcctttcagtatgattagatcaattccctgttatactaccttggagttgtatgcttgtgtcatgctcaaacagctcgactattcagcccatccaattttcaaatgatcttaacgactgattgtcgcagggtagagacatacaaagaacaaacaataattttgtttttaaaatagctcaaaagaatatttagtgaaattttaccagggtgaatatgttgggatcatgagttcccaatcacaaattccctcgccgcaccaagtgtgccccttttcaatcaccggttcttaaaaatatgtttgtgtgttttgggtgacattacaggaaaatgcaataatattttagtgtttttatatgtcgaaaacgtgcattgcacgtgcacgattactagtcttagtataatctaaacatagcaagctaagggacctaaacaagtgctattagctttaaataggtgagtttatgccactatgctgctaattatgctcgttcttgctataaacaaggctgcaaaatgtttttttcatgaaaaaatccatttgctattttatatgtcaaggattgacgtgttccttttgttcatgtttagaaatggaattctgaacattgcgtgctcataggaagggctgcatgtgctcagaaaaaaaaattgggagggaacctcttttttttatagagctaatgttcattaaacacctaaaactcaacatgcaaacataatatttagagagaatcccttatatgccactagaatttgaccagttcccttatatgccactcaaaattggcttcttccttatatgccactagtttaagtttttccacccttttatgccactcccactactatagtgttagttgactgttagttaaaggttagtttttttttcataaatgaccaatatgccctctcaactaaaaaacgtgtaaacttcaaaaaatcataactaatttattttaaatcctttttgagtgaacaaaattttatcagaaccagcgaaaaatgctctttatattaaaaatattgttggaaaactgcatgtttcatgcttatattgaaaatttatttgtgatggtaatggctaaaattgcatgtgatgtagaaaaaatcaattttcatatgttgtatccagtagctatattaatctttttacaatgaagttaacggtcaactgacggcaatggcataaaaaggaggagaaacttgaaccggtggtataaaagggagaagccaatttgaagtggcatataagggagccggttaattta

SEQ ID NO: 24776 - DNA, 1501 bp, Oryza sativa
ctgcatagaggaataccacattacaaaatatcggtagggtttgccctccgtgccgcccgctcgtattctggccttcaaagtattcgtcatgatttggaggagacaatcattgaagtgaaaaaaaactaacttatttcaccagttctggaaatgttttattcagtttcctggtactatcaatgctaagagttgtttaccctggttatcactgatccagaaaaacatagtaccattaatcaactcaaaaggattgtgtgatattttactgaacaaatagaatgcgcttattacataattgatatttcaacctgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggccgaggcgccccgacccctcgtgggttttcgctccgcgtgtatgggttaggtgggcacagtggggctcacctaaccatatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggacccccacgctccgtcatctggcgcgccaggtaggggactctgcgagtgatcttctgagctctcgcactccttcgtgtgcgccaagcattttcctgttcagcccaa

SEQ ID NO: 24777 - DNA, 372 bp, Oryza sativa
ccgcaataaaataaatgataattacataattttattgaataaacaaaaaggtcaaacgtttattaaaaagtcaccaatattatacattaaagtacggagggagtaataattttgaccaaaatctattgaaatttgaagaaaaccatcgtaccaccgaggatcaggatctgacgctcaattgataaggtgaacttaaccctgcgctgcatacgtgcaagaggacacgggatgagctagccttgtgaaagaccgtgcgatgtcgagccttgtaccaggaggctactcgtagccacctactcctacctgggtttccgcggcgccgtcgtggcttagacgcaatccaccctgatccggtgacgagaccactcccca

SEQ ID NO: 24778 - DNA, 1501 bp, Oryza sativa
tgttgaggacttgagatagctagagcatatatacatgggatttgctctttctctgccatgtgaataactccatatatcaagatgtttatatagatctgatatgtgccggggtgattcatattgatttctgtatggtttttttttctttggagagggattttatgtatgttttgattgaaagcgttgagtcagattaattcatgctgatttgtcaataactccatatatcaagatgtttaataatagatctgatatgtgccggggtgattcagattgatttatgtatgtttcttttttttttctttggaaagggattttatgtatgttttgattgaaagcgttgggtcagattaatttatgctgatttattcgtgctgttttcttttgttgaaaaaacaaatctggatctgttgtatgctagttctctaacggatgcataatcttttgtcttttggcagggtttctcctcgtcgcagatctgtgtctgcgttaaggtaagcgagaaacaacatatacaactattattttttatttttcttcaatagatctgctcagatagaaaagtttcaggaggaaacgtatagtcttatgtccatgtaagatatatacaagtagctagggtttatgcgtttaattctccattgtagattttttccccagcaggaaacatgtggtgtactgtctccatagattaatacaagtaactagggttttcgtcgcaaaaaaaaagtaactagggtttaggtgcttcttcaaagtagattacacgagcaggaaatacatgtatagtgtctccatgcataggataaaactagctagggtttttgtgtttcttcactgtttgtaataatctttttctcccgtctgcttaaataaatgtgtttcccacttttcacctcaagattgtgtgacacttatttatctcactcactagctagctcttatcaagattgtgtacgtgacactattttaatttaagttctctttttttttatcagatcagtagctgtaacggagaagagttcgtcctcgacgccgtccgccgcgaacacctctgaactgatggtagcgcaagccgccaccgccgccgccaccaccaccgccgctgccaccaccgccgccgtgccgatgacgaatttccagctcttcgggtccatggtgccggttccggtggcgtccatggcgacggctactgctccggcagctgtggcagcagccgataatggtggccatggatcgtcgtcggcgtcacagaacgcctctggctcaggcgaaggacaaggcggcagcatgtccttgtccttgcaactgaggccgctcggctcaacgccgacggcggctgtggctgtctcggtgccacccatggctgcggcgccgatgatggctggtccagcagcagcagcgccagcgccggcgccgccgttggcgacgatggccgttgcccagaacgcctcgctcgcggcggtggcgagcgcgctggcggcgcacaggaggaaccagg

SEQ ID NO: 24779 - DNA, 457 bp, Oryza sativa
atatttatttttttgacgtgctttattatttaaagtattttaagcaaaatttttcttttttatatttgcacaaattttttaaataagacgagtggtcaaacaatataagaaaaactcaaaaggtagtatctgactagtagaagtaggaggagtactacgagtatttttacagtagcacaggatggcagttttgccccctccgtcgctttctggtcatgctttctccgggtccggcactccgggcccctcttgcctctctcttcccttgcgactttaccggtgaatatcaatacacggaaaatagtagtagtagcacactagcactagtagtgtgtagtggagtactactgtattgaatttcccgtgtattgattttttttttttgcgttcgtaaaagcttgatttgggcatgatgaatcggtagccttgcgttgcccttgccgtatgcatagtagga

SEQ ID NO: 24780 - DNA, 1501 bp, Oryza sativa
  unsure (1)..(1501): unsure at all n locations
gaaggattttgatgaacttttcgaaggtggatttgagtggattggtgaaccctagtttgccggcgcagctccgtactgtagcagggagtggggaaaatggcgagagttccggcggggaagacgaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgcccaatgctgataaaatctttttttacgcggtcatataattcttcggaattattgcaatgccaatttttcaggtgtggcctgtcacgttcttttagggactcaggcacttttcgcttacgccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcatttttattgaccaatagtatggcttaggctgattatatattgtagtcattttttttaggcggttggtaaatcctttatgagtttatttactcggattttacaccacatattcctgttttcattatggtggatagtcatagcttagactattagacttattcattaccataatttttataatatttggtgggtaatctttagagttttttattcggatgcctgtcaagtgtgttcattcgtgaaccttttagagtgttaaccactcggattctttttattatggctaanaagcagtcggctagagtgcctctttaggcgccgcatatgcttttgtcatatgatgcatgattgtgctattatttttgttctcaactatatgtttagtttgttaactaatcacatagttggaggctacacctaattaggtgcatctattcgatgcaccatattccttatttttttttgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactagatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacac

SEQ ID NO: 24781 - DNA, 1501 bp, Oryza sativa
attacttcttgagctccgaaaaatttacggaaaaatccggagagtattttagggcagaaagaatgttacaaaatattctcggccaacgatttttaaaggaaattttaatttcctctataatttcacttgattaatttgatttaacttttatttaatttctaaaaatacattatttaatgatttttagtcccgaacgaaaatctgggcgttacaaattccaacctcccatttgctcttcctctccctaaaactcttgctccatcgaagagaaacaagatcgcgccgccgccgggtgtcgaacacctggtgagcgggggctgcgccgccgccacagggcttctcggccgatgtgggtggcggggtgtggagagaagttgctgttgctgttgttggaaggagccgggagctgctgaatgaggaagaccaggcgtcgaacacctacgagcgtcgccaaccgctagccgcccctgtttcggccgcaccacgccgcgcgccgtcgaactccgccgtctcgccatcccgtggtaagccctcgcgcctatagcagtgcctagtcaccctgaagctagcggccccctcgacttggggtgtgcgccgccgttgccatgctgacttggtccgccaccacgccatggctgagctcgccatggggagacctcgttccaatgtagcatcggcgagaattttccttttctatactccgtgtgaaacctagatggttaaatcgaggtcgcctgcacacgaatcaaccaccattgcgccgccgccgttcttgcgatctcggtgccaccgagcaccatcgcgccgcgcgtcggatggctgccgtgcctcgccgctgccaccggcgggtttcaggtgatgcaccgccacctttccccaccacgggccgagccgtcccggctcgagccattggatcgctgcgcgccgttactctgttcggtcgtgagcgagaggtagaagacgatggggaaaaagaaagaacgagagatagaaaccgtgtgggacccacatgtagttagcgcacagcaatcctccacctaatggtgattaacccacataatggcatgtggggtccctgttattaaaatctaagaaaacttagttatagattttgttacaaggactggttgacccccttgtcaatagggccggtcccacctgtcaatgacacagcttgttttccaaaagaaaataaaatagagaaaagaaatagggggatggcccgcatgtcaaccacagtgggttttggataatgtttcggattaaaaataaatcaattataaacagtaccatttcacaattattggtattaattcaaatttgaatctttaaacttacataactcactcattttaactaggattcgaatgaaacttgaacctaaattcatctaaaatcaagatctaattgttggtaccactttctcaatttactttgtactgtttgaatttttggtgattttatttgaattctaatcaaatctttcgcacgtaaatttaga

SEQ ID NO: 24782 - DNA, 1501 bp, Oryza sativa
taatatgcccatgctaacgctacggtgctctttggtaatgtaaagcgaacaaccaaaaggtgataaacaccacagaagaaagaaaacaaaaatctaaaattctatcatgagcatcgacttcgctgctaagaactaaattagctatgatactattgcatcgtgctgatggagcatgcatgtctcctgtcttagaaaaaacctgcaccatcaaaactaccataagtaccagctcagccatgtcatagtaaataacaaacaagccaactgataatgaaggaagaaatattcatctggatcaaatggctctaatagccaaagcagaccagcctaaaaggcaaaaacacattgaatcagccaccaaacaaatcattcatttaaaaaatcaaaccataactataaaatatagattcagtcagtttgtcctaattagtaattggtgctcaaactgaatacatgtataacctaggtcgtgagataaatctcacagggatcacacatggtcatctgatacatgtacaactaaaatctagcacaaatctcacacggaaaacataagagagccgaagattcataggaattaatatgaaacttccataagatcaaccgaactcttctaaacaaaaaactcaaattgtggcaattagaatcctttgggttctcctatttctctccctcaagtatcttcttgaatatgccaccaccttaatgctgagaaagtagtgtacaatgtaatatatcatgagtaataatacactgtagtaacaaagatatctaggattaaaagataaaccttatcagaattcaaaagaaaacaaacttacagagggtacatatggtatgtttaaatatatattcgtgaatcttcaattaagttccaatatcaaccacttctgttgctgatcagcataaaatcacctataaaatcatctcaaatcgcatagcatagccaatagatcattaaaagtgacattttatcagctggtgaagcaatgatccttatgacatccaaattggggccaccaatgccaagaagaaaacctactcattaagaagatggcacaaaccatgccaacgttattcactttcagaggctagaacttctctgaattaagcaacggccaaatcatatatatcgtcgcacgggagagcaagcgtgggactacataccacagggcggttgatgtcttcaaccatcccaacctacaccgccgccgccagtgcctccctccaccgccgccatatatatcctcaaattgtttgtaaaataatttaacgttgttctcttctccattgcaaatacacaaataaatataaaccatgaaacatgaagctcaatttcttgtaaaagaagttctggaacttggatgaattccattgttgcagcagtcgaatgatataatacataaaggtagtatatgcacgctactaattaaagcgctttatctgaatttacagatataaacataaaacatcccaatcataagagaagttaaaccatttg

SEQ ID NO: 24783 - DNA, 1501 bp, Oryza sativa
catgctccatcagcacgatgcaatagtatcatagctaatttagttcttagcagcgaagtcgatgctcatgatagaattttagatttttgttttctttcttctgtggtgtttatcaccttttggttgttcgctttacattaccaaagagcaccgtagcgttagcatgggcatattactagtcttggtacaaagtggtatcggagtgctagccgatacacgttaggtttgccctatcggctatgctgtgagcatacataatctctgctttgaggcacatttagatattgagtgacttatattgtctcggcataacatccgatctatcccaatcacctgatctaagtgtgtttcactggatagactacgtatcattgacatctacagccgatcgagtagatctaataatccctacgtttcatctgaccccgccggtctgacgcaagtcgcatcgacgtggcccaggacgatatgtcatcagcaatccaaccgatcagctatcgttgatggatttaactttttcctttttccttccttgttggttgcaggatcaaaccaactagcacgctcagaacccgaaggcaatctctttggacctgcactagagttaagcagatctctcaggccagtgcgtgtttttcgcgtcaacagcgggttaagtgggcgcgcccaacgcccacctaaccgcatttaaggtggatcctgcgaccgcgccacgttgcatttaatgcggtgtgcaggcttggctgataggccacgcgatgcttgaatgaccggtatggcaaggcgggtgcgcctgtgagctgactgcctaccaggcggcgtgcgcctgtgccatccggtcacatcgccatgatgagaagccttttgcctcatatatagaccggggacagattccctactccggttcaaattagggtacccgttccctggttggattgggtgcccggaagtctttagtaattaatgcagaatgatgcaggcgtcccacatgtcgtccggcgtgatctgatgggggccatgccaaggcgctgtgcgcatggttttccaagtcagatggataagaaatgtaataaatgtaaagaatgttttccttatcccctaggtggttttttgggcccctgtggtaaccctttgaggtataaaaggaggtccaggtctagtggaaagggaggattttcggatttctaccgactcatacactagtgttcctcgcagaatcaaccacacacaggagtagggttttacactcctcagcggcccgaatatgtataaaccccttttgtctcatcattctcgaggggcccgaccccttccgcataactcttgctaccaaaccacgattctcacccgctgcccccgactaaactaaaagggggctctccagtcccctacttgaggagttcaccctccgacagctggcgcgctaggtacggggcgcgttcgtgagtttttgagggatttttcgatttcgtgtgcgccaagtttcgctcatgaggccgaa

SEQ ID NO: 24784 - DNA, 1501 bp, Oryza sativa
gcgtgttctgttgatggatctgtctatggttgaaaaactggtgctagctatttttatgaactgtcacaatcaaacggtaattgtcaaagtcaacagttctaatgataacatgaaatcgtctagaaatgtgaaaagacaattgaactttgtcaggagattgagaaactccgaagttataccattggattacatccaaacagcaagcaacctggtagatccttcacgaagggactatcacgaaatgtgatagacaatgcatagaaggagatggtttgagaccatgtgttgcgtttgaacatgttattcacattgctagcgagaatgaagagcttaaattgctatctttcttaaataccatacccttctaatgtgatttttcatgttatggcaattatgatagtaaaggagaatataatatgcatcgagtatatatttgttctaatttgactacacctccttttcatgatgaaaggtattgtctaaaggaccgcatgcgtatacgtaattctctatcaagttcctctagttgtttaaatgagttacaagttggtttgtaagaagaggagtgttgtggtttttcgactacaaagatttcaggatccaaccatatggccatcaagaaatgttcttcaccggatgttgtgatagataaaggtaagttcaatacgctccatgacaacctaaaacctaggacggtttccaatcaagaaggggaggatgataggaacacaactagctcagatataaccatgattaccttatgtattaatgaaccaaagatacatatgttctatatttgatttacttgttatatatttgaacaaaagttgctacacaatgagttttgtgtgctttcgtttgcagaggtacttgcttgggcgaaagaaaagagactgtgcgtaaggaatgaatggatgattaaagaagtttattggggaccaaatcaagaccttctctaagtccacttccatcttaccacatcactttttggtccatagaagacaagagataaagttctacacgttttaaattcggattcgggcctcttgacagcatcaactgtaaacggacctagctgctgatctagaaggaatttcggggcccattagtatttgttggaaagcttatggagtctactttcagatggttttggtcccacatcaaaattcctaccgagctgtcgggaacctgcaaaacaagccatgtacctcatccagtcggaatctaatttgggttttgggccttgtaattgagttgtgggcttagcccaatagggtgtgccccctagggcaaccctacgacattcctaatcatatttattcagtagccagcgtcgtttagagttgggttttgcttagattaatctgtcgagaatagttttgccactagatcgattcgtagaacccgaaatttgagtgcttaatcattcatatgcattctgttgcaatctatcttgttcttgtttgtgttcttcgattcgcatgcagggattagccttttc

SEQ ID NO: 24785 - DNA, 1501 bp, Oryza sativa
ggaggaatacacatactgagctgtcaccaccagcggcccacctctactgtcccacagcatataaccccaaataatgatattcaatagcctaagcacctcgcttatgctaccaaatactactctacaatcatcgtcatgacatagagcaatcatataaatgaacattatacccacaccattgcatctctcgagtaatctagctagataattatatctcaaataataaatcagaagctggtactcgaatgatccaaatgaagtaaagtactgtaaatatattgagaaaaatattctataaatattacaagtcttattaaagaaggaaaaggtacaagagccatacccgaactcttccgaagactccgaggactgaagaactctattctatttctattctactatactctagagactatacaaaacttgagaaaatgtgagaagctacttgcttgagtgtgtggaagaagtgaggaggtgaaggccttaaatagcctagtaatgacggttatggttgttgggaaggtcagtaatacccttcaaccgccataagaaagcaatccagacagtccaacgccaatcttgcattgaacggctaaacgacgagatcggccgaaccatgggctgagccaaactggcccaatctcagcaggtggcctctttgacttctcccttatccagaacagtgaattctgggcctgttggatcgtgtcaattctgtgttttcagcccacttgtccacaagtctgattcttgacagtatccgattgattgattgtccgttttgctgccaattctcctccattttgtatttattctttgcaagaggttagaatcgtagtgctagtggaacataagttattccaacataaatttgcattggaagcataactagttctcctttattttggtaatattgacgggtgaaactgattgataatgaccgtcaacagcaccctgatcaagcatcctgatatgtctatataagttgagccaccgcctccacacaacacatgtgaaatcaatctagggttttcctcctcctttgtactgcgccgtcactcgtagtttactccatcccgcttgccggtgtgcaccggcaaacaggagagtaggccttcggaaccttcgccttcaacgccctacgtcgggatatagtggcaataaggtttttgggaagcgcttcgcacgactgctccttgttcgcccacatcagctcatctttctcttcgctcgcgtgctgtgcaccgtcgtcaacgcatggtattgtgagtccttcctactgagaagctggttttcgaaaaccctcgatacgcattcaatatgtttcgcatattccatctgctcatgctttactgtctagtttacatgtgtagatcgtatgatgcgataatgctagtttacatctgcagtgtcatgatttatttatggaataaactaaatcattatgtgtttatatattcaacaatccaaaaaccttattataggcactatggtttaacta

SEQ ID NO: 24786 - DNA, 1501 bp, Oryza sativa
gctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctctttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaaaaaccgcgttcggttaaacatgaaacagaaataaggttccttttgacagatggaacataaagaacatcatctagtgataaatgatggcctccttccaaaactaatgaaaggtctctaatagcttctacatgaagttcgtttccgtccgccactttaagacttcgctccccctttgcgatagtcctcacggaactcaattccattcttagcgagccacttcttaaagccattacagttcttctgaatgagccctggctttttgcaaaacctgcatattatggcacttgctgatggaccaggagcaggagaagctggtgtcttaggcttcccctttggcttgggcttgtgtggagagttcctgggtttcttactggtttcagcagcacaaatctcatcagccttccttttgcctttctcattatcaacaaggtaggcttgcttctttgcctttccgccttctgacactcctcctcctccacagagtgagagatgagctcggcgattgaccacttgtccttctgagtgttatagttaatcttaaatggaccgtagtcagatggcaatgagttcataatgaagtgaaccaggaaaccatcagagatggacatgtccatactctttagttgtgccgccatgttggtcattgtcatgatgttttctctcacactccccttcccgttctaacgagatgtgagcattctcatgatgagagcactagcataagttttcgaggagcccttaaagttctcctcgacattagcaatgtaatccttggcgttttcagcatctggaatgccgcctcttaatatacagatccaaacataaataaagcgtaaaatacttacagaagaggcacttagtcctcacaccgaaacgaaagcagcagcagcggaaaaggcgatcctagctgggcttcaactccactccacaggcaaaactcaactggggtttgagccttagtcttctaacttcgtcttcagctcagaagcactacacttctgaaatgggggaacaatagcaaatgctgagtacaaccaccgtacttagcaagccacaccaacaatgcagacgtgcaaggggatacaaggacggtttacggc

SEQ ID NO: 24787 - DNA, 1501 bp, Oryza sativa
aatagtttttctatatatatatatatatatatatatatatatatatatatatatatatttgtgtgtgtgtgtatgggcaatgctagaaagtcttataatatgaaacagaggttgtatcaaatatactatcaaatcttagtggtaggagtttaccactaaccacttccactagttttggtaaatatatgtttgcaggacatttaaggagaaaatacacccaccatgtgattaaaatgaacctctggccaattatatgtgagtacaaggattggagggtgcacaagtcagtcgaaaccgacttaaaagtggggccaaaccatccttaatcgccataggtgcccacctgtaaactgctggagaaagtctgtggagagaggtggggcccactagccactcttggcccaccttatctccaccttacatgtagaagaccgggatgaactcccaatgacggttgtgaggggttaaccaccatttgaacagtcattagcagctataaaaggaggtcttcctccgcacttcaacacacataaacttgagctcaagtagagtacatctcacttgtagtttcataattagtacatcagagttctttcgagaattttatggagtgctgggttgtcgccattcttcctacggagttctggagaaagccaggattattggccttcttctctcgctcgtacagcggtggatgcttcttttataaagtaagtatttgagtttgtttatgttctataattagtttatttatgtgagatatatcggtatgtgtttatcgattagtgtgcaactgagtgctctagtactaggtctctggataaaaaaagaagttcctgagcatggctagaatagtaattaataacttaggcatcatgtctaggttaaaaaaatacctttgtttgttgtgtgctctatgaaaagtgaggtaggcagttggtggtgacaacattgtttgttctttgtatacctgcacgttcgggtacatcatagagctcaaggccggacttagcaagacagatagagtttaacctttaacttaattaactaactaaaaagacataggaatcttctctagccaaattattctaaggttgttgttcatggattgaatcaagatcgtagataatgcatgcacgttcctcgtgttcgataccattagattactctaaggggaggtgatatagcggcattccgtacgcttgcgaattaatctgtgattgtaagaaataccaacatgccggttccttaatagttttctatgcaaagatgttttttttgccccgccgagaggaggttcacatggtggagtagcagagatttccaccatttgcacatttaggccccgtttatcacagcgtcagctcccaactccaacttacatagagctggggctgtgccagacggtctagattcacaaaatttggagtggagcggggtgaattgctcgagaaatttgtattgttgaggtggagcggcgaaaacgtggctccacagctcc

SEQ ID NO: 24788 - DNA, 1501 bp, Oryza sativa
gggtatggggtacccataatctccacagtagcccctgagaccttcacagtcgaaaagataatcttctctcgaactagattactccaaaaccgagtacttcaatcatctttgccatggtctcccgagtatttttaccaaatctgaagactgtggagggctgaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaattttcaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacacatgtaacatgctcccgggtgatatagaccatgtgatctgagtgattatcccttatgggatactccaaaatagatataacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatca

SEQ ID NO: 24789 - DNA, 1501 bp, Oryza sativa
ctgtgttcgacagtgtgagaaggtgaaaaaaaatctcgttttctatactgtacccgaactaataaatgatgtgttttttcaaaagaaaaatctataggaaatttacttcaaaaattcatattaatccattttttaatttaaaataagtaatactacttaaccacattattttgtgtatcttaccattgttctattttctcatttactcaaacacactcaaagcggtagttattttgggataaattttaaacccaaaagagcagtttttttttattgtaaacagaggagtaaatttcacctttagacatttttttttatcgccgttgtttctatttggatcacctttcaaccatttttttcagtgttgtccggataatactacctttgtcgcattttgtaccatcctcaaccgttttatccatttacatctaaattgtcatatatcaaagaacggactacgacatacagctgagggagtttattgacaaataagaacaagagtactcgagcttgttcatatgcatgcaccaaaagaaagtaacaaatgcaagattagcccagtccgaagtgaaaacattggtcaaaggtgatcaaaagtgaaacatcggtaataaaatgtggcccaaaataaaaatttactcaaaagaactttataggaaagttatcttaaaaaatattaatccatttttcaggattaaaaaaattaacactcattaatcatatgctaatgacttatctcatttttcgtatctatcattcttctcttttctccttcactcaaacacacccttaggtttagtagttattttgggacaaattttaaacccaaatgagcgattatttggagatggagagagtaattagaatgtgaagtgggcccatagggcatctatataagtaattttcttatctattgttactagggtaaaaaatcaagagaaatattaattaataaaataaaaggacttaaacataaaaggtagagagctgaaatacaaaatctaccaacggtacattaaggttatcgtgcatcgtgaaacatatgtgcttctattgtgaatacctcaaagtgcatgatcttcacaagaatttgataaaagttgagctaattcctataaagtctagcaaaatattttcattaattgcccttgccaatatatacaagccatacagagaactctaaccagcacgtttattttcccgaagagctagctcttgccttcgctaagaatcgttaattatatggaagaattgctaaaaagtgttacacgtgaacgtttacaacattggccaaataaaacattctgcattttagcacaataatattttttacttcttggcccattatacagcaaagtcatgtctcttttgatatattattttgagcttagatttttttttccaagtttccgtttatctaagtgaaatatgtttgtcgggaaataaacatttccatttttttccaactagaaatattgcagatcttttttccaaataaaaa

SEQ ID NO: 24790 - DNA, 1501 bp, Oryza sativa
gagactttgaacttcgtgtagttcagctcacagatcagctttatgcggctgtagtttgggttggacccaagttgatccagaaatgcctatatacgaaccccgctgttttataatcttgtttgacggtgtaaagtgtgtatccattaatatcgtatcgctgccatgtgtcaatatccaaaaacagtcctactggaaaccatgttaatgtttcgcttacgccttctgtcaatgttgcaatatgattcttaaaccattcgttgaaatgggagttatggttcttattgatccagttatctgatcgactcatgttctcctgctggatcttcattacatgttcttcaaagtatggcgtaacttctatcatattttggagcatagagaaataggcctactcataggctagttgggcctgctatattctttttttgcctactgtgccgacatcagataaccttccttcatgacgagatgttagaactcaaacatgtaatcaatgtagaactcaataacctgctatgtcatgtaacattcaatgatgctcctcttcgctttagctctattcctaacatacgatttcagaattcccatgtacatcttgaatgggtacatttcgcttagaatatgtgggccacataattttgtttgcttctcaacatgaacagggagatgaacatgatatcgaagaaaggcagtagaaaatacatctccaggtgatagagggttttgacaatatcttcctacaagctatcaagaccaattgtatctataacctttgactaattgcattgaagaaggcgcacagatgcatgattgtgtgatagaaattagttggaagaatattccttacagcaactggtcagagctgtgtgattaatacatgacaaacatgggatttcattccaaccagttttagatcgtccaacaaaacatacttccatatcatcgctgaatagcccgaaggaactttatatcattcaagcaggattacatatggatcctctcttccatggccaatttgtgtcaagcaagagggaggtacgctcttgctatgtctagattagttaatggagtgagttcacttcaaatattaatctcctataaatctagatgtgcgttcaatccatcttttatctttgctggactattcaacaatagccctatcaaactatcatactcattcttttctacatgtttcagatcaatgcaatgatgcatctcaatatctttctagtatggtagtcactataatatgtccttagtattaatatgttttcttttcttcccaaactcattgcatatgtgttctcgtgaaattcgtcgcacacggaggcctaggagatttgcatcgatttagtgcaggtcctaaatcttgatgaggtttgggcatgccaattaatttgattccgcaactaacaaggtggaaatcgatcgatgatgaagaagtttttcatcaacttgggaagccgataatcaacttagggagatcgaaactaagatcttg

SEQ ID NO: 24791 - DNA, 722 bp, Oryza sativa
cccgaccccctcggggggactaagaggagggcgaacacatcaccctcgggcccgacatcccccgatggtgccaggccacgtgggcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcagtggtaactcggctgtcaataatgagcggtctcttcaagactgccacattactcgagtagcatacgaatctggacatggcgattcgtttcgtctggagatatggtaacgtcgcttcggtcggcgagcgtaattaccgcgcgcacgatatgatctatctcgactgccacaaccgcatatccacctcatgcgccgcaagcgggcgaataggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 24792 - DNA, 1024 bp, Oryza sativa
  unsure (1)..(1024): unsure at all n locations
agctgtatgcacccnctngcnacnnncnnngnngntttataataatgtcgatgcaagttgttttgaatcagtccaagaccatacatctgaaattctgaatcgaatcgttcccacaattaactgagataatggcactaaaacatacagaaaattttaggatgcatgcacttagctagtcgatatgatatcaacagctgttagccactcggtacagcaccctgtcaagcttgcattcaagctagatgaatgaatccatttgctaattttcccatccggaacagtgattacggaaaacggagtgatccatctggaacagtgattacggaaaacggaacgatctattagcgcatgattaattaaatatttgctatttttttcaaaaatggattaatttgatttttctaagcaactttcgtatataaacttttttaaaaaatacactatttagtagtttgaaaagcgtgcgcgcgaaaaacgagaaagaaggggtgggaagaggggcatccgaacacaccgttcacagcaccctagcaagatattgaaatgcacaagttgttacattattatcgttacatttatgtgtgccatactgtcattttctattgacattgtgccaatgaaagagggaatttcctggacatgtgcgtattactgctaaagagatatttggtgaagcgagttctgttatgattgggtttatgcaacaatgcagcgaatgctcattgtactttcactggatttattgtgataatctataaagtaatagaaaaagtagtctccacgtccgctctcacggtctagaaaatcccacgttaattaaaataaaataagaaaaaaagaaaaatagaagggtattaggattaggttttgtgtaaacggaaaaaaaacaagagtaaacggacaaaaaaaaagttggaaacgaaaaaaaaaatccaatcggacaagaaagataaaaagtgaaaacggacaaaaaaaaaacaagaaattccaatattaatctctacttccgttgtccgtgtaaaga

SEQ ID NO: 24793 - DNA, 1501 bp, Oryza sativa
tgtagtaatagaacctagaaaataaaatagaatttagaagttggaaaactttatgcttttcacattctcgtcagccacttcttagtatcttaggccctatttagggagtttgtggcagctacaatttctctaacttccccaaacaatccaggttttcaccaagttttaagaattagtaaccacagaatccactacaagcctaataaaaagctaggaaaatcaactttttttatcggctattacttggaatctcaagctctccaaaagaccttatgctactgcaaaggggttaatataatgctgctacaacaacaaatatctctacaattgcaacctccctcccgctcatattgcacacacaaccatatcttgtcggcgagaaaagaaaaacaaacgacagtcaaagaggaaacaaataaaaactaagctattggttaaaaataaaatatgctagatcccatcccaacttataggcctgcgcactgcaacttcatatgaatccattgtaatgcatgagcatgttactaataaagggtaaaattggactgaagattatatctagtctagaataagaaacatagtgcatatggaaacaattgctgggacattagaagttgagcgcaaaaatggttgagctgttgaggagctatttgtatctggccgcaaaatggtatactaaacattgtgtaaaatcttcttgactggaacatagtagaagcattgctgtctgatatagtttatgtgatcacctaacctactactattgctacttggtcaaaatttccctcttatttcaaactttgcagttgtgcactagtgtttctactgctacagagccaatattataaacaacactgtgaaagaaaatcacagtagggcacctcttcatcaatacttatctacattctacttcagcccaagctggggcccactggacattgagggtatgcaaaggttgggcaggtgagaactgtatgctactatttttttttcactccctactttatttttctccttgctacagctattctttttgtactaaagtagagcaagcagtaaactactactactggtacactagtctgttgtaacttttgattaggtgttagcttacgctaaggttttggaaatattagagagatgagagagagagagagagagagagagagagagaggaggggggcagttgcagtggttaacaaccctttgccagagggcaagaaggaatcatttcacctcagtggcaggtaacaaacaccacattagcctgcagctctcttcttgcccttttgctccctcttcttgtccatataatctttcaccgcaccattcattctcccctgcggtcaaattgcggccaagaagacaactgagctgtgtccaaatgcgcactagcactaggtaagatgctgcggagaaagattaaaaaaagagagaattttgaaagggaggagatcatcaagctgctgttttttttttttccttttttgcgttcttgaat

SEQ ID NO: 24794 - DNA, 292 bp, Oryza sativa
tgggcccaaggaagggttggggaaggttggttttaaccaatggaggggaagggttgtagaatagttattctagggaaggggtgtaaaatagatccactatctatatatatatgtatatatgtatgtatatatggacatatatatgtatgtatatatatgtataaagaaagtagttcaagtgtaggagtagttacgttgtcgttacattgtaaatatacaactatgctatagtacatttgacactttttagcaattctgaagaaaaatggtaaaataaagactttggctctaa

SEQ ID NO: 24795 - DNA, 755 bp, Oryza sativa
caaccgggacttcccgctatttccaaattctttttaaacctggttagggttaagaaccgggactactgataagcgcactgaatattattttccattatatatgtgtttctaaaatagaagataatgcattacaattgtttaaagtaaaaagattaatgacaattacttcgaaaaattattgttgtctgtaataacttaagtggataaaacgtaataagcaaatatatgatttaaaattaataaaaattctaataatcatatattcttagcatatgaatgatattattaaattggtaaaaactctaattaacatatgtatatacatacgacatgatttaaaattaataaaaattgtaatcatcatatatacttagcataggaattatatgaaattaaattgtgaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccata

SEQ ID NO: 24796 - DNA, 1501 bp, Oryza sativa
tttgttgggcagttcaccgtgcgtgagatttaataccaccattcttctaccgttgcgcacccatcccaatcttgcaaccgaaggtctaaccctgtccacctttgtagttcagcccaaatccttctggataatctgcaatttgctagaaggtgtagagccgattctggcacggtgcgacagagggggcaaaaatgttgattagcccaccctctcttttgcaacctatctgccatccatactatgttttggatgactagccagaagaagaatttgcatttaggcaaggcccaacatttccaaatggtctggatatagatcgttcctgctgctccatggaattgcagtctatacgctgagttagaagagtaggttcaatttgctgtcagcttccagacgattgaatccttctgatcaattaggggggcggcacgttgtatcaatgtccataggcagatgtactggcacagatgatccgcctcagttatacgcagcagatcaatatcccggatccatgtgttgaggtcaagggcatcatgcactgtccttgttttgcgtttggaggctgcgaagatagctggagtgatatccttgggcttcttattctcaagccaatgcgaatcccaaaagctggccgtctacccatcccgtaaaaggattgtcgtcgccgttgcgaagaggtctttgtctatctagtcgcaggagagtgcagtgccattccaaggcttgttcggttccgtccactcatactacaaccaccttaaccttagcgctcgggtgaaccagtccaggtctagcacaccgactaactttgtcccaactaactttgcatttcccaactgagatatcctctcctcccactcataggaatttcctcctcatcttatcaattgaatggagcatactgttcgggattttaagctattagatagtagattgtttgcgatcttaggacggacttggttaaagttgttctccttgccgctgtcatcatccaaccttgccatggcgccaatctggccttgcacttatccaacagaggctggatgtggactttcttgagcttggagaccacaagcgggagacacaggtatttcattgcgaagccagtgatgtttgcagggaagactcgtaagatctcttgtatgtcgatgccaacacaacggatgggcgtgatctggctctttttcatatttgtctgaaggccggttacgtccctgaaggagtgtaggatttgagctaagtggctcatgtctctgactgtcggccggacgaacattgcagcgtcctctgcataaagtgacatccgtaggcgtggtgttctcccatttagttgggtgagatagccgaggtcggtggccttttccaacacggcaactaatgggtcaatggccaggataaagaggagaggggatagcgggtccccttgatgaagacccctgtcgtgcttgatgggtgtgcgcggtgagccgttgagcaggacccttgtggagggtcaatcaga

SEQ ID NO: 24797 - DNA, 1501 bp, Oryza sativa
gggccgtggtccctgcggcgtcccggccgcgcgggggacgcctttgctgccgacgctcgctgacggccgtctccgcggcggcaggggcttcccctcccgtctccccgtcgcctagccccgatggcggctcccccggcgtgtgggacgctctcggcggcgtgtccgtgctcgccgccggcaccggcgaagccgttcagctcagggacctgtgggaccccaccgaggtagttgtcatcttcatctctgtttttctcggaatcacgcactcaaacacgaagaatcggtgatagttttcggagtcctgtgtcgttgttgcgcgtagggggtggccgtggtggcgctgctccggcacttcgggtgcttctgctggtgaggagatggagccgacgcttccatgttcgctccgtttcttgtgtttctcggctgttaattactaacatttttgtccatggtcaatcaaatggattatgatttatgaagctgggagctggcctctgttctgaaggaatccatggcgaaattcgacgctgccggggccaagctgatcgccatcggcgtcgggactcctgacaaagctcgcattctcgccgatggggtaagcgtttacgcttgctttgaaatgaaagcgtattggagtcaacgcggtaatagattgatcccaagcaagagtacacacagggacgatacatccttatttctataaccgacttatagaaataaaatcgggggagaattagggaaaccgaacacaatacaaatatgactctaacatcaaattgagatttagagagcgtaccagcgtgctcattgttactgttattacggcatttagcatgatcaattcactctgttcactgactttctctgagattttgcgcactgcagctgccgttccctgttgatagcttgtacgctgaccccgagcgcaaggtacgtgaagagaaatctaacgggcattggattttgacgatgtattatgcttatgcacgtatttactatggatactcatcttttcaggcttacgacgtattggggctttaccatggtctgggtcggacattaatcagtcctgtaagcatcaaaattcagtactagtagtgtaattctgtaagcttgtggcaatgcaattctgaacatttgcacgagtggcattgaagtattaaacatgtgatgtacgtccatgaaggcgaagatgtactcggggcttaattccatcaagaaggtaaccaagaactacacgctcaagggcacaccagcagacctgacgggtatcttgcagcaggttgttgaactctgtgctttgcatgtacaaatcctttgtggctctgtattgaagttcagagtttctcttgcatcttggttctgatctgtcgttcgctgctcatcgtactctggtttctgttcagggtggtatgcttgtgttcagagggaaagagttgctgtactcatggaaagacaaaggcacgggtgatcatgctcctctggatgatgtcctcaacgc

SEQ ID NO: 24798 - DNA, 394 bp, Oryza sativa
  unsure (1)..(394): unsure at all n locations
cagcgccgatagcacnctacgtagcaccncaccggttatagtatatatctgcaattgacaacctcccggaattgaaggagcttgagttagaaggcaaatgttgtttctcttcaagtgtggagagatatcaatgcacataacaagaaacttatacacaagagaacacaggttcaggatgaaccaaaaggaggaccgacactagctaacaagaaaaagtctgcattcttctccatctttccgtccactcatcgctgattcccggtactgctaacttgtgtgtgtgcaagctccatcgtaaatatgtgtgcttcgcgccatgattctcttgttcttgcttgtgttctgttgtgtaagtgtgtgtgtgtttccttcatttgttccgcgcggagcggta

SEQ ID NO: 24799 - DNA, 1501 bp, Oryza sativa
aaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataataattacggtaatacatcggcggtgacagttgaccgcacgtactttctcctcactattgttccctccttgtgatcgctacgtgagtaaggggtgtcttcatttgataggaggatgctagggtcaatcgtcaccgtgaaagggggttgcccatccaactgatcgtaatcctcgtcagtcttgtcctcaacttcgatgatttttcttttgcctaggagaaccacgtgacgcttaggctcgtcaggccctctgcccttctttcctttgctagacatgtccttcacgaaaaagacttgcgttatatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgctagttgttccatcgtgtcccatggcatcgacacgaatagcgcggttttggttcgtgctcttcatgtcttgggctctcgtgtagaatgtgtacccattgatctcatatccttggaatgtcgcgatcgacccagacggtcccctcgccaggaaggcaagttgttggttgatcgactcgttacccatgagatgttgtcgtatccacgcggggaaagtatcaatgtgatgccgtgtaatccatgcatcagacttaccgatgttcctggcgcgaactagagccaagtgctcctcgatgtaaggagctaccaatgaagattgttgcagaaccgtggaatgggctttacggaataaattgttgtctaccgtcattattgctttccttccgagagttccctttccccgtagttgggtacattgctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaacactaacttgggtacattgctcggcttgcccataaccgagggcgcggctattcgaatagattaaactctgatcaaaggtgtacatctttacccacaagacacatcttcctcacgtgtaaccacgtgccacataccaccacggtatacggacggaagacgtgacatagtttccaac

SEQ ID NO: 24800 - DNA, 674 bp, Oryza sativa
  unsure (1)..(674): unsure at all n locations
aggatcccaaccgtcgccggggggtgcaaaatacctttgtgaatcccaacaaaggaaaacggctttctttttaaagggttaaccctaactngcgatgataaagctgccaatttttgaaaaggcaaacggtncggccttttcggttttaccacactggcaaaaggggaatgtcttcaagcaattaagttgggtacgcaagggtttcccaatcccgacgtgtgaaaaccacgggccagtnatttgtaatcgactcatctataggnnnnnnnnnnnnnnnnnnnnnnnnnnnnnnnnnnnnnnnnnnnnnnnnatataaatcggaattttctcatacgagcatctcacaaaccataagcgaaaactattttcatgagcaggcatgttaagtcacccggctcacaatattttctccaaaaattgaaaaaaaaaagaaaaagagaatgcagtagtacaaaactgaaggggaactcatctgagaaaatcatttccgtaccagcagcaaacgggtaaggataggacaaaaatcttgaaaccgcagcagagcaaaggaaacaaaaacggcaagaccggatacgtcggtcgctccccacgtcccgaggacgaccgacgacggcgacgcggcagctgatcaagcgcgcgacccgcggcgaagtgacgcgccaccaccacgccca

SEQ ID NO: 24801 - DNA, 569 bp, Oryza sativa
aaccgggactaaagatctagggctatatatattcccgatgcgcgccctcgtcttctccaccaacacttagaagtttttgcccgatcgatctctctcggcttctccttcgccgccactgcctagggcatcctcgcgccgacgccgccgccgtatctcgccgtcgtctcgcgctcgttgtcgtcgccgccgcctccgcctcctccgccgccgccgcatctctggggtgagagccgccgcgcgccgcctccctcttgatctctctctccgatctcgatctctctctctctccctctcggttgccgccggccaccgagtttcagacgctgacgccgacctcgtcacgacacgacgccgcaccacgacgacgccgcgccacgaaacgccacgacgccgcacactgccgccgtgccacgccaatgccgcgcgcggcgccacgctgctgccgcgccatcccgccgccgctccgctgccgccacaccgccgtcccgctaccgccacaccgagaacgtgaacgagcgaacgaacgtgaatgagaacgagcgaacgaacatgaacgataacaaggtgaa

SEQ ID NO: 24802 - DNA, 1501 bp, Oryza sativa
taccgctgagtgggcctcagccctaatgaggcaatgcgccctttgcaaggcacaagggggccctgcggcaagggcatggcgcgggctaactaagacggagtggcggcttcgagagccatagccaattaccacgtcaatgccctgtaaatgcccttactagacctatatttgtgataatccccctcatctcaaactgtacaggaattcaggaaatcgtctgagacataccctatatcatttgtgaaccatttcataatgtcccttctgtaccaacgcatatcatatatagtgtactggcatatatgctttggtgggcatcaattctcgcaaaaaaaaaaacggaaaagtacagccccaagatagccaccaaaactaaaagactatatactccctctatcccaaaatataagcattttggactttgatgcggtattcaagacactgttttgaccaacaatatatataaagtaagatgtttaaaataaaaaaagttacatattatgatagtttgtttaatgaaaatctgcgtactaatatcaattttacttgattgaactttttttttgctattaatagtcaaagttaaaaatgtttaactcgacactattctaaaaatgcttatatttttggacggagggagtatgtaattatgtatgtgctatttaaataagttcaaatgaatagattaattaagacaacaggaagaacaacactttgctaaaagacaaggtttgtaaagcgaattaaactccaacgaccgttaaagttctcccattacgttaattcagacaccatatccgccctaaaaagcctttttctttcactctcttgctgcttttctcggccatcagttgtccatgtggatttatattctacaagcagagcacagcacgattgagattcgcgtggtctctgccattcaaataaatataatcttagatatctcccgcgtccaccagttttcttccctttcactttcagcgacatctcgtatcatcatgctttatatagttgagaatttcttttcgtattttgaaataacattctgtgcccgctgcatctctaaaaatgcactctctttgttttcaaatgtatgatgttattaacctttaggtataacgtttgattattcgactcattaaaagtttagtgcaaaatatataaacagagtgtttaaagtatctttaatgatataaaaacaagtaaaagacaatacttgtagttttattgaataaaacgaatgatcaaccgtcatacaaaaaattaacagcgtcgtatatttaaagccagacgcgcataacatatatatcattgtcaagggaaggccctcgatagcggggagtcgtgagacccccctttcgtgagttcggccgggggcagaggctcgcctcttagaaatcacgtgttcgcccctaagactgccggctagcttgcacacaatcgaattatacaggttcgggccgctatggagcctaacaccctactcttgtgtttgggatta

SEQ ID NO: 24803 - DNA, 1190 bp, Oryza sativa
attacaaatctaataatcttatactaaaactcaaatagtgatgatatatgctaagtctaggtgatgtatattgtaggaccctagctagtcaattattatatactaagtctaattagaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacgtatattatcgaaccctagctagtcaataattatatactaagtctgattacaaatataataatcttatattaaaactccaataatcttatatgctaagacaaaaatagccatgtttgctaaatgtaactgtcgtatattagaaccctacacaatcttacatgctaagtctaattacaaatctaataatcttatactaaaactcaaatagtaatatatatgctaagtcttggtgacgtatattataggaccctagctagtcaataattatatactaagtctaattacaaatataataatcttatattaaaactccaataatcttatactaaaactcaaatagtcatgtattctaagtgtagctgtcgtatattagaacactacacaatcttatatgctaattaagtctaattaaaaatctaataatcttaattgcattacaaatataacaatcatatatatataattacgtcacttgcctgggcgaattccttcgagggctagctctaccagtccggcttgagggacgactccgacaacgtcttttctgcaagatacaaaaagatgtattaggataaacgcgaagtaacatatattgcatttgacgttcacgtttcgttcacgatatcgttcatgttcgcattctcgttaaggtcacgtttcattcacctacgtttgttcgttcacgttcattaacttacctataattgcatttcacgttcatgttcgttggctcgttcacgttcgtccgacaacgttctagttcacgttcattcaccttgttgtcgttcacgttcgttctctcgttctcattcacgttcgttggctcgttcacgttcgttcgctcgttctcgttcacgttcattcaccttgttatcgttcatgttcgttc

SEQ ID NO: 24804 - DNA, 244 bp, Oryza sativa
  unsure (1)..(244): unsure at all n locations
tgcccaagggatgtacccccccgaaatctatatatctacatctatacgtgagcgcgcgctcccacccactttatcagttccggcctccttcagcaacaatcatgttaggttggccagtcgcgcgcgaggacccacaaatctaactcgccttttctctctgtcagagngagtgtatatgtgtgaaggagtctgtcttttggacacgtttgccgcggttgtgtagatggcgtcacgcctttctagg

SEQ ID NO: 24805 - DNA, 1501 bp, Oryza sativa
cgcctctgccggtctggctcatctaaaagaccgcctgtgcaatcaaaccggtatagaccggctggaccgcccgattttgcagaaaaccgcctttcccaggcatacaagcaactatgccaaccaccaagccatgtgcttccttgtgtttggaacaaaggagttatttctttattagatactgaaccgctttggacctcgaccgatcagaccaataaaccagtaaaccgacggctttgccgattcaattgccggtccggtctcaataactatggtatataccaaagagcaagaaggagtcgtgtctgatgcgccactaatatctcacccctgtagcctctctcagtctctcgcgtgattcgtggacgattttgttatacgcttacaaaatttatcaaatgtaaatgcagtataactataatgtaattatattataatttgcatgtaactatgatataactttcacataattttagatcattagatttacttcaatattcatgtaagttgggaagaaaagaaatcatagtaagcacgggtgaggagattcggtcttgtgacctccgcttcatgaaaatagcatgttactggggatttctaaaagttattgcaattacattatgattgtactgtatttacatctttatcgacaaaattatagctagtccctttgtgtatgcgcagtcacagaagcagtactaggcttctggacagctgggcctaaagctaatgcttgttgggccatgattttatgaggtatattggcggtggtggtggtgggatgtgtgtgcgcgcggggggaggggtatcatagtggggttggtggtgcggaatataagtcctggcaatgccctggtccacagcatagggtatccgaggctcatgtttgcctctacggaagtgcacggatactgctgttgctttctctcaatagtatctgtcgatggagcgattcctcggacaatggagagtggagacccctccccaagtgtgaatattcaaccagggggtttgtggtgtacggcgtagaaagagatcaaagcaagagcggatctgtggagcccgagctccccgccaagcaaaagacacaggaattatacaggttcaggccatccggaggtgtaataccctactcctgtgttggtttcattgtctttcctatatcagctgagtacaacgaaggccttttcaggctacaaagcgaagtatactgatctaaagagtccaacccttcatccgtagcttgtccccttctttttatagtccatggaggggctcacattattacaaatctactccttgtcttgtgttatcagttgtcttgttgccggttggttccctaacacaatcttcgagaaacctgcattacctcgggtacctaggcttctgtccgagacagctgggtcacgccatgtagacccccgtttttataacaggaatctctcgtgttaatagtaccatttccctggatcaagtagtatggtactcacgattacattgctgg

SEQ ID NO: 24806 - DNA, 1501 bp, Oryza sativa
gaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatccacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttaacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggca

SEQ ID NO: 24807 - DNA, 1501 bp, Oryza sativa
atctgtgaactccatgatgtatttccttaacgtatgctgaaaacgtccgtatacgcgtgagcataccatatcgatatatgacgtatatcgaagggtagagggtataccttacccgtaaccctgacaatcgcagcttcatatttcaagtagaaactaaatttcataatagtattgttttgtcacaattaacatgatgcatataactaacaaaaataatttaagaaaaaaatattgtaactgttagtatgcatttatgtggcatgtgtagcgtcctccaaccggatgggcgtaaaaaggcaataatgaaaagtgtcaaaaattctcaagaacataataactgtatgatgcatcattatcgatttacttaccatatagacataatatcatacttaatgttgtattcggaaactcttttccatggtatgacacacaacatggtcttttgatggatcattggacaaataatctagaaaacttgaaaatggccgtatagttggctaccatggggaaataaagaatttactcattttaattcatagcttcggcaatatagcttagattagaaaattaacttgattcacagcttggtccgtatagcttgagagaacttgttgcacatacataggtgtggaaactagaatagcaaaaatctaaattttgtctacaagcatcaaaattagaatagcaaattctgcaaacaaacccaattaaggtgaacaaaggtaaattttcattggaagaaagtctaacattaatttttaatggacaaggcaataaagcacgggctacatgcgaaaacatcttgtcccaagcaatagatgccgtaaagcctctatttccataggtggctgcctgggacaaggctattttgacagatccatggctgcatatagctggccgcatgtgaaaatggagggctttttcgtaggcagacttccgtgatagaccttatacacaagccttctcatattgttatgttttgctgttactgtgtttgctatcgaaggaaagtaacatgacactctcacatttgaatagaactatacattggggataatttgacatgaaggactactatgtctgatgtaaacacaaacttttgtttccctagagaaaataaatcacacatttattttattataaaaaactgttttttcttttttatgatatttctttatgaaaaagttaattgtagtctcttgaactattttgtgaaagcagtaaaccgcctaaactatatgcagctcaattcacacccctaactagtgaaattagttcggcttacttcgtaacgatatttttcttttcttttcttctctctacataaggagatagatgcattacagtttatgtcttaacatttttttagacttttatatcactgtctacatatgttggaagcaccaaatactgaactaaacatggagattttaaagttcaaactgtcaaggttacggataaggtataccctctatccatggatatacgtcgtatactgata

SEQ ID NO: 24808 - DNA, 1501 bp, Oryza sativa
tatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggca

SEQ ID NO: 24809 - DNA, 1501 bp, Oryza sativa
tttctgcagtaaataagccaaattagactttcttaggtcaagtgctatccaaggaaaactagagcagataaattggaattcaatgggatgtagtaattaatgttgtatttttcatgcactcaactctacacttgaattcaataatgtcatcatcagcagcacgagcagactccagcatgagcctactcattccatctgtcgctgatgtgttatggatcctggggctccagacttcttcacataatggctcaagaacatgtagcatgttgatgtcctttgtgcactgattaatttgtaaaatatgtaattaggccacataacagagaactatacacagcaatttcaattacattattgacaattgtatacacacaaacagtagctagtactgatactacctatgtcccaaaatatatgattccattgacttttagcacaatatttgaccattcattttatgaaaaaatatataaataatattaattttgttttaacttgtcttatcatcaaagaaattataatgttgtcttataattttgcatatttaatctaaatttttgaataagatgaatggttcaatgttatataaaaagtcaacagcgtcgttcaacgtcatataaaaaatcaacgccattatacattttgggacggagggagtatagtttttcttggaatacttacattgcgtatagcttggatagactgctcacaccgagcattccctggggcactgtatttccctctgcaggtttctttagcatgctggtagaaaattggtttgagtggtcagtatataatatgtaagaaatattacaatagattttgcacgtaggcaatagtaccttttgccctgttcgaatgtcatgtatgaataaatattttgggcagcacacttcgcaagctaaacgttatgattttataaaacaaattatatatacacggttggtagaatatgtttttaaaagcaacttttcaactttgtaatatagttaattgtcaatttattagttcgtgctctcgggtattataaaaaaaaatcagatactccatcatcctattcatcctttcagctgaaaagaattagaatattgcctagttggtcagatatatactgccgtgatctgttattcataatgaaacaggccggtgtctttttttttggaattaatacctacaaatatttgctgaatgtactataggaaacatataaagttattaattactggattatggattacctcataaagttcattggatataagtcccatgccatggagacatggaattttaccatcttcatcaaattggctatcggtcactggattgccagcaacatacccctgcgttataaagacaaggtaaataaaatggttgaaggcaaaagttaattacagggcagattggtagtacacattaacaagcaatttatgtagactattgacgtaattaagattccaaatataaaatttcatgattgatatttatctgataagatcgatca

SEQ ID NO: 24810 - DNA, 1501 bp, Oryza sativa
ggaatgcttggcaggtaccagtcaaatctaggactagaccactggaaggctgttaagaaagtccttcgctatttgcaaggcactaagcactacatgctaacttatagaaagttagataaccttgaagttactagttactcagactctgattttggagggtgcatagacattaagaaatccacatcaggttatgtcttcactctcgcaggaggggctatttcattgaaaagctccaaacaaactattactgcatcgtcggcaatgcaggctgagtttattgcatgttttgaggcaaccggacaggcggtatggctaaagaatttcattccaaggttaagagtggtcgacagcgctaatggaccactcaccatatactgagacaataaagccgcagttttctattcaagtaacaacaagtcaagtgcagctgccaagcacattgacattaagtatcatgttgtgaaagatagaatccaagatcaaacaattaaggttgagcatataagcactaagttaatgcttgcggatccgctcactaaaggtctaccacccaacttatttaacgagcatattgccggcatgggattagtaggtgacctataagcaagattctagaatagaggcataagaatcaatcaacacccaataagattaagttgattcctatcaaggtattatagtggctataggtactgttgtcatagtgacattttattgattactatgacacattgctttggttcgctattctacttagactggactcgttagcattaagatcaagtgggagaagatcaagtgggagaatgttggttgatctcctggtaacgagaccagagagacacgtcgtggtctaggcccacccacacccacgcccacacgcggctaacggcgaggagcgagcgatacgctcgcatctcatccactacgtgcgccgatcggatgcgcatcgttctccataacggattctcccccgatctcctctagcgctatattaaaagggagaggccgtctgtgcttaggtgacgatctaagtacactaaaccctcccgataaaccctaacgccgatcctaagaagtgctggaaggagaccgaaaggcgttctccaacgccgttcccggccagtgcaggtggcggcctgaagggcgacgccatctgcttcacctccggcaacttgctaccacgacctcgacatcaccgacgactcctaccgcgactaagatggcttcaagctcaaccggtcagtcaattcccgcataagtttaggtgatcatgtatgtgctaaggataagttaatgagtataagatctaataattgtatcgtagtcaacacttaaattaataagattagccccatgtagtatttttattttcgtggttgggacgctttagataaattcatgcactaaaactagcgtttcagagcaagtttaatagtatagctaaccgttggctccaaattatctatagtcaatttaataatcaattcatacaataatt

SEQ ID NO: 24811 - DNA, 1308 bp, Oryza sativa
gcagaggccattcgcatggaagaggatgagggagaagaaaaggggaactttagtttgggttggcaggggcattttggtattttctaaaaattctgacaacacaatacacggtgtgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcttcttttttggtctcgcctcgcatttctttgcttggtaaagtcttgatctgtctagagatttggtttgttggagggtattttaggatttgtttgtgccttgcacatgcatgctcactagtgctaaataaaacataacattggaaaaaccattatataacacttcagttttatttatttccctaaaatataattctagtatttgaaattagtaagtatgaagttatatccatcttggactctcaactagtattttcttattttaatctaaaattggaaattaataaataaatactccatctgtttcacaatgtaagtcattttagcatttccaacattcatattgatgttaatgaatctagacatatatatctatttagattcattaacatcaatataaatgtgagaaatgctagaatgacttacattgtgaaacggatgaagtattaactagatgtaattgcgtcgatcttttaatctaatctaaagcactacgatttagaaaataaccattgtattgcaacgtacatgtaggctatggcgactagttcacagaagggttctgataaaattattggggggagaggggttgggttaattatatctagctcaagggtgtgaaccagcggtccagcgcggttactgaatatgcttcaattctaaatttccgtgaacaggcaagtagccgtgaaaaagacagaccaagacaacgatattcacaaaggttgtcttactgttgatctattctattgcagatatatttctttgtcaagtttgattactggctcgacatggggaagtagctgggacgtctcgtcaatggagcagcaaattctacaccagcagcggagtttccatcgtacaaaaatagtgattctgaagtgctgagtgcgaactatcaatgatttggtaaagtaaggcctactgatagtctgatatcgatgcatataaaccgtatcatctctgatgtacctatacatagtcagatccaattaatactgtcgaaattttcagaaaatttcaggtaaagatcaggagaggagaaattcgcca

SEQ ID NO: 24812 - DNA, 1501 bp, Oryza sativa
agactttctccagcagtttacaggtgggcacctatggcgattaaggatggtttggccccacttttaagtcggtttcgactgacttgtgcaccctccaatccttgtactcacatataattggccagaggttcattttaatcacatggtgggtgtattttctccttaaatgtcctgcaaacatatatttaccaaaactagtggaagtggttagtggtaaactcctaccactaagatttgatagtatatttgatacaacctctgtttcatattataagactttctagcattgcccatacacacacacacaaatatatatatatatatatatatatatatatatatatatatatatatagaaaaactattatatagccacctcccacctcagtcaaaggtcagtcaaagcacccccacatcagtcaaaacccggtcaaactgcctaccaactcccccaccacccacctcttctcagctctcgtcttgcgaaacagtgtagtaacgcgacagccatcgtgcagtaatactgtgtcttacgtgtagcaataacattaaaatttagttgaaatatagtcatgacggatctacttttgataagcattttttttctaacatcatggtgcaaatggttttaaaaaatcatacatcacatgagagatattgttattcgaagcttgggtttttttggatcttaactctccacaagtagtaatactatagcattactacttgttactactatctgttatgcgttactacaatcccatcacgacgttattgtaagtgtgtagtaaaagccataagttttgtagtaacaatgcgtcttactgcaatttatgaatagtgttactgcataaacatgtggtaacatgtaccttccatgtagtaacacttcaactttgtgcgataacaagtatatttagcatgtgagacttttaacccatatttttcttttgatttctggtttactaacgttctatatgttctacagtaacaaagtgttttactgtagttcttggatagtgttactacataaacatgcggtaatgtgtaactgtcaggtggtaacgtgtatatgccgtgcagtaacacttttacttttgtgcagtaacaagtatatggttagcatctaagactttgaacccatatatttttatttcaattcctggtttactgtaattcacaacaatattactgtcaaaagtgcagtaacgtcatatacatgcattgcagtaacactatattggagggaggagaccagttttcttgacaagagggaggaagaacgatttcttgtggaggggaatatgtagatgtattttgaagtttaaacctccacatgcactacagtatcattgtgaaaacggtattaaaaaacaatacatatcttgtgagatattgcttttcaaaaattggcattttgaactttaatcctccacatgcagtaacataatgtgtaccttgcagtaacaacggcctatacatgcagtaacatggttttacc

SEQ ID NO: 24813 - DNA, 1501 bp, Oryza sativa
aaaagagaaaacatttgatttagtaaactaatacataataacttttggttgcaataaacaagaatttgagttgaaaaactgataaggagaaaatagaattaccttgtcttttttatgtatggcattaatcaattgtatctataagcaataataacactagtatcaaccacaatagtatatccatcaacgaagaaggagatccatgggaaacacagaaagctaagtataaacaaaagagatgaggggtaagtaaaaaaattgagcgcttgggtgacaaagctagagaagtttctcaattcatcgatgctcctagtgctaattgtggggtcatcttttatagctcttctatgcgttgtgatcttgtccttccagagggttcgctttggcatgatatgtttgttttcacgcgctccacccgtctctttttctaaagcatatagtattttctcttctatgcgttgtgatcttgtccttccagagggttcgctttggcatgatatgtttgttttcacgcgctccacccgtctctttttctaaagcatatagtatttcaatcgtttgcgaataaaaccatgcccatgaatttatttactattttttccttttcccacatatatcacatagcctctcccctataattataaggaacacctatctcaccaatcatccatccctaagtttttaaggaagtgaagtgtcaatgcatgatcattttaactcctataaatttatttgttggtttcatatatagtcccctcaatatttatgtggttgctacagatggaaattttcccatatgggatgaggatatgcccctggggggaggggggcatatatgtgcacttgggcggggacctaaaatcatatcggccagggatgggtctatgtttggatccgtgggggatcttgtaagtataacatgcatgggacaaagtaacctaacaagcccaatagagctaaagatataagatagtcctaacatatgtagttgattatttgattgttctttacaatgcaatagattgtacgtggttagcagtgagccagtgactcccaggtgatcccaacaagtattgttctagctgtcatattagtagagtagggttttaatcttatgctaacctaatattggtaatgacaaacataaattttagtaaggtacagctgatacgttgttttagattggtgccaataagagataaatatttgtggctagaaatttgttagggcagaacttttaaaaatggtggtactcatatgtcattgactatacctcgtcgacccctccacgctctctctttctccatctcttctctcgagctactcagcacaaccactttgagatggaggtggagagcttgagctggaggagagtgacaaccatgaagttgctagaggccgatgatcaaacccgcaattggcataggcggcgatccatcaaattggactaggaacgaaggagttattgggaacaactctattgagctctagcactccggca

SEQ ID NO: 24814 - DNA, 1501 bp, Oryza sativa
ccttctccttcagtgatgccgccacctgatggtccacgagcggcccgatgatatcagtcaaagggagagcctacgcttcataaagtcataatgcgatcccggaagaaaaatgcaaaaggaccgctaagtacacttacattgatggcagcgtcgctcggctacccctttctcgcaaaagggggacggggacgttgctcgccgttgttgggccgctaatcatccgttagccaacacagcgctccacggttgcgctatccaagcctgtagatcgagaccagaattcgataagccgggaagaacacgcacataagggagtcaatttaactaaaaaggaaataccccgaggagaaacccgggtcgcgtcctctggcctagaataatcaaaggcaggatgggctcgagcctgaagcggctggatccgcctaccaatgaagtcggcagcaacttcataccccgacaacccccgttctcggaggtcatcaacgatatcgatgaaagattggagggacggggtcaaggcaggtttagtggtccaagatggaatcttgtctggctgctcctcaggaacaacgaagacaggatccaaatcctctatctgaagatagaaccacctcccccgccatttgctgcgagatgaggggcactgaaaggggatgtatcgcgacttcagaccatcccgaagtcggaaaccaacacactcggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaaggaaagaccatagaaattcaagaccaaaaggagaaattcagaaggcggtggaagaaaaccgcagagaataaagtcctcaaccgcaaccatgcgacccaggacaggctggggttcagtacctcctacttccctctccgcggtcccgcgaccgggaagggcgccatcctcctgtagttttttcattgacgcactggtggaggtagacttgtcgagatccatggccaccggagatcgccggagaaaggaccgagatgagttggctagggtttttgcgagagcgaagaagacgaaggacgcttggaagctggagagtttttttaacaggcggacctcaaattagatccccaaaactcccttaaatagacgcacctccgccggtgcgaattccaaggaaaggagagatgaccgccggaaatttctaggtccgttacgcgcggcagtttttcggacttcaatttaaattcactcatgaccgttgaacttcacccgatgttgtcgatcactccttgtctctcggtcctcacaccgagaacgacgacaacttcgacatcagaagttgcgatcggtttcgcgagttcatttaagcagaagtcaggggctactgtcagggttacgggtaaggtataccctctacccttggatatacgtcacgtatcggta

SEQ ID NO: 24815 - DNA, 1501 bp, Oryza sativa
ccttctagtcatgttttatctagctccacgtaccagaccgtggttgcttctttttcccttttctctcaagtttggagaacacatttgctgcagctgtttttcttatgattcatcatgtgaaaattgtccgaatgaccggtcatgaggtttaacttgaagattaaggtagcttacattgttagcatgaacaattcaattgtcaatacaagttattcaggagttcatattaaaaaaagctatctaggttaattgttcaactcgcttcgtcaaaaataaaatatttgaacgatatacaaactgtgcgttgctagctccaatatagagaatggttgacatctcattaatttctcgtttaaaattcccatcttaggtcatatctctaagaaaatgtatagtagaaacaaataactcgacaagctgaacctcaactggctaggttccttgtggtggaaccaacccacccgggttcaaaccctagatttgatacgggtgctcgcatttacggctaattattctttcagtggtaggtgacgtacccgtcgacagcgaagcgtctgtggtgacttcgtcaatcggaggtgctcataggggtagggtgtgcgtgtgtgcgttcataggggtgagtatgcgcacgttgtgagcgcctgcatttgtacagtgtttctaaaaaaaagaaattactcaataaatcgtaaaaatatatactattaatgggtggctccaagctagacacaactccacgaaaatgattagattcctctgcttcttgttcacaagtgagcacttgcggcaagtgtatccctcaccacacaagagcatgtagctagtgacaaattcaacacgggcatcacgttgttttctacaaaagaatccaaaagtcgctcatgaattgtttttccaaatggttgttggtagcagtagcatagaaagcatgcgatatttgacgcaagtatgcttcaaataatgacctgcctgaagaatatataatgtattaattatgcaacatgcatgttacaatctattagaaaaatacacataccatacttggttgcattagagatacaaccaccaggtacaggaattcactattctacgactcatgcagctagcactcaaccagcttttcctattgtcaatgaaatatttttctaaaatctagcagagtttgcaggtgtattatgacaattttgtttagggcaactgttttatagagagtctagtgctttggcgctaactgtgtttgatcattcagtataaattgctaattaataaagagaatttgtcctcgaatataaattgctgatagagatattgttgcgtttcaacgaaatgtgccgaaagcaaaaaactgtataactgaatttgatttctccatgccacaaattttcacagttgtgctagcttccatcacagcttaaaaaaagtaagaaaagcgtagcacagttgccacaaaagaaccctaaaaatctccttggtaacgatctttgctattactacattc

SEQ ID NO: 24816 - DNA, 1501 bp, Oryza sativa
ggcaaagggttgttaaccactgcaactgcccccctcctctctctctctctctctctctctctctctctcatctctctaatatttccaaaaccttagcgtaagctaacacctaatcaaaagttacaacagactagtgtaccagtagtagtagtttactgcttgctctactttagtacaaaaagaatagctgtagcaaggagaaaaataaagtagggagtgaaaaaaaaatagtagcatacagttctcacctgcccaacctttgcataccctcaatgtccagtgggccccagcttgggctgaagtagaatgtagataagtattgatgaagaggtgccctactgtgattttctttcacagtgttgtttataatattggctctgtagcagtagaaacactagtgcacaactgcaaagtttgaaataagagggaaattttgaccaagtagcaatagtagtaggttaggtgatcacataaactatatcagacagcaatgcttctactatgttccagtcaagaagattttacacaatgtttagtataccattttgcggccagatacaaatagctcctcaacagctcaaccatttttgcgctcaacttctaatgtcccagcaattgtttccatatgcactatgtttcttattctagactagatataatcttcagtccaattttaccctttattagtaacatgctcatgcattacaatggattcatatgaagttgcagtgcgcaggcctataagttgggatgggatctagcatattttatttttaaccaatagcttagtttttatttgtttcctctttgactgtcgtttgtttttcttttctcgccgacaagatatggttgtgtgtgcaatatgagcgggagggaggttgcaattgtagagatatttgttgttgtagcagcattatattaacccctttgcagtagcataaggtcttttggagagcttgagattccaagtaatagccgataaaaaaagttgattttcctagctttttattaggcttgtagtggattctgtggttactaattcttaaaacttggtgaaaacctggattgtttggggaagttagagaaattgtagctgccacaaactccctaaatagggcctaagatactaagaagtggctgacgagaatgtgaaaagcataaagttttccaacttctaaattctattttattttctaggttctattactacatattcttatattctactatgtgagaattaatgtgagaatttaggttgtttacaggagctgttagaagaagctgccgatgctgtaaactttctagataggaccatgtaatagtcttttagattaaactacggtggctttgtttataaggtgggggagggaaggtgcttctcttccacaccaagctgcaagctttgaatggaggggagatctctttctaactgaaaaattttagttcccacgcaaaaattttatatcatgtcacatcaaacgtttaaacacctacatgaagt

SEQ ID NO: 24817 - DNA, 1310 bp, Oryza sativa
  unsure (1)..(1310): unsure at all n locations
aggactactgcatatttcagtcatgttagcatgggtcgttacgttgtcctttgttctgtttgaaatatccaatattattccatataggctcaaaacattattcgtatcgttcatcatatatatgttaatacatgattacaaaattatggaaatatgataatcctaaacatgcattgagtcaaatgaaaaaaaaaaacaaagccattggataactcctgtacttatcacaaccatcaatgtattagggcatcctcaatgtggtatgaaaatagtccacaggcaatataatattttattcagccagctagcaatatcatgtaatagtccatagtagaaagaaaatagcaaaaactacccattgcactatgggtaggcaagagcacaaaaaaaaaccatagttgggcagtgtcactattcataaataataaacaaaagtttcagtaacagttgcacaggtagccactggctttctggccatttcgcctaaaaaaactttcgcctacaaaaactgcaccaaaatacaccagctccattcatcaaatttgctagaacacaattagttccaatgaatccctcccacagaaacatctcaagtttcacaaattaagactccccaaaccaatactctaagagtagtgaccatatctcacctcatacaccacaatctcagtttatctttacatcaccaaattatccacaaaactttaacccttttggttctccaataaaccagccacctttggccactctcctccaggattttttttgaagagaacacagcaggggaggcccctgctgtttgaataattttattaaagaaaacaagaacaaaattacaacagattaatccaacttatgattacatcgtgatatctcgcagtaattctaaacaacaaaaggaagaggtcaccctttaagagttgcctccaagtgatgaaagaggggatcttttgctcgaagatgaacccattcctttgtttccatatatgccaagcagcataaaggaatttctccttgaacagctcccctgataatccaatttggcccttataaacattgcttccaaagggagagtagtatcccatgtaatgcctaaaagactccaacaattttgggcaaatgggcataaaaagaacagatgcattaggtcttcaacagccgccgattgacaaagaacacaagaaagatcacaatccggaggagcacaattcttataatttagcatgaacttggtgttcaatctattcatcatgagtngnncctgatgaacatttacttttgaaaccgctttgcacttccataaccataga

SEQ ID NO: 24818 - DNA, 282 bp, Oryza sativa
  unsure (1)..(282): unsure at all n locations
cgcgcgggcggcgacacgatagcggcgtggggctcggaacgncggtgtgacaggtggcgcggggctcgacgcggcgacgcgacgtgcgagcgcggggcgcaaggcggcgatggcgatggcggcgggcncggcgcgggacggcgatgcgacggtgacaggatgatggcgcggcgacgggacgggcgcgtggcgcggcgacagcgtggcagcggcggcgcggagcgcgaggcggcggcgcggggctcgaggcggcggcacggggcgcgaggccgacggcgacga

SEQ ID NO: 24819 - DNA, 1501 bp, Oryza sativa
ttcgaaacagaactgataattaccggtatcccaacagcccaggatttggccgcaacaactacagcgttccccacgccattgcgacctttcgcatcatccccgaatccgccaaggagataggcactgagcaaccatcctgcacaacaccccattctgtaagcaatccttcctccaaaaaatgataagcagggggagaaggctgtcacattttcctgaccagcaatgaagggatcggccgtcttgaacgtctccgcgtcaagaacaggcagcccatggctgaaccttcctatcgcggagaagacgaggaggcagagcacatcgccgctggccagaagccccagcttcctgcggaacgcaagtgcaccgctcagcgaaaccgaatcaaatcagcgagcacgaggaatggatcgaggtgcatcgggggagttattacgtacgcgtaggagacgagcttggactcggcggcggcgtcgccgggcttatcgaactggatgacgccctcgagggggacgccctcgtccgtaacgccgacgaggacggggtcctcggtggcggtggtggtggcgggggatccggaggggccctcccccgcggcggcgagggccccccgccgcgcgtcggcgccggagagcgcgaggcggcggcggcggcggtgcggaagaaggcgcgtggtggcgaagagcgggtacgggttggggacgctgctgctgccgctaccgccgtggcggccgggctgcttggagggcagccgccgcgcggagacggaaccattggcggcctggctcaccagcaacatctctccggtgggcggtggcggtgtcgccggaggcggcggcgggtggagatttttttgggggtggtggaatggaatggaattgggatggcggaggaggaaaggatttgggtgggtggtctaaaaatttgcatttcgcggtggtggtctaaaatggaaggaaacgaaagcgtggatggcgtcagcggtgtggacgagaagcggggggccccgatcgttggatgcggacttgccggtaacaactcacacaagtcacaacacaacacaactcacgagaccgtctacgtcggctcagctcctggcgtgggatgagctccgtccatttgtaagccgtgcgtccgttcattcgtgtccttgatatttaattaactagatgatgagaccccgcacattgctacagaaatttagtatgataacaataaaaaaataacgtataagatagctagataacatcagattaagtaaattaatatggtttatgataatttaaatttaaatagtatgtagaatggtgattcaaacgtaaaaagtaaggtggtatgactttatgaaagaagagaagtagggagatagtttggaccgtggattaatcatctaaagactaaaagcaattgatgtgatatgacttaattagaggaaaaaaggagaaagataatttagaccatagattaatcatttaagcactaactaagtgaggatgaactatat

SEQ ID NO: 24820 - DNA, 1501 bp, Oryza sativa
ccggtcgccgctcctcttgccgcgcgggctttgccggccatctccctcctgatgccactctagctggcactcttccatctacaagggtgttttagacatttggaaccacacataacgtgaaaatgaaggaaacctaacgggaggggcatggaagggatcaaagcaaaatttcaggggtacagagaggatcgtgtaaaattcgagggtatagaagggattaggtgagttttcatgtgtacacaagggatttactcaaaaaagaaaccaaacagaaggcggaagcccactactgccccctcccactgcccagagcggtcgcgttgctagccgtcctcttagctccaacaccgtctagccccaccgcctgcatcggtcatctccgtgaggactccgtctactaaaactgcgtgagctccggtcgcgttctctagcctctagctcctcgactgcttaaccacaggcttaacgaaatcaactcgtttttctgttgttgttaaactagtcgagtcaatcttattcaagtgcttgcattaaacttattcttcaagttccattgatttttttttttgcatatagcgagacttagtgtgataatgtttaacctgtcgtcaacaattatatttatggaatctccaaaaagcattgatactactcttagaagtatttaactatggtaatgaatcacattgatagctcacaatttatgaaaacatgttgattcagctaaacatgtgtatactagagtggtttttacaacaaaattgagtagggctaaatatttgtaataaaatggcttatgaggtggaatattgaacaagtgacttgtagagtagtattttcagggaaattgaagtgcgagttgattacatggaatctttctccagttgttttaatgcacaagatatggcttgtaccaagtccttgtttagtttgtgaaaagaaaatttttgggttttacatcggatgttggaccagatgtcggaaggggttttcgggtacgaatgaacaaattaatttcataactcgcctgaaaaccgcgagacaaatctttttagcctaattaagccgtcattagcacatgtgggttactgtagcacttatggctaatcatggagtaattaggctcaaaagattcgtctcgtgatttccatgcaaattgtgtaattagttttatttttatctatatttactgctccatgcatgtgtccaaagattagatgtatcgttgaaactaaaccaggcctaaggagaggaagaaataacaaaagggcaaaacatgaatagtaacctgatcatcccatgtcaagattttttatttttttgctaaaaaaatgtatttcagtacttcaatccaaagtagtcttcaggtaaaaaaagaggtctttttttaattttttttttataaaataactgagtaggtaaaattatgtcgtattgagtctgaacactttaaacggtatagtatagtcctactcctgtcactgaagagaaaagttttctg

SEQ ID NO: 24821 - DNA, 732 bp, Oryza sativa
aaatcatttagcatttgaaaatgttgtttgaagttatcttatttttaaattcaaaattcaaacggttcaaaaaaatgttatatagaaaaatgaccaaaataaaagttatagatctggatgagttatttaagtttgttgttgataattttttcagttgaaatcatttagtatttgaaattgttgtttgaagttgtcatattttcaagttcaaaagtcaaactattcaaaaaatgttatatagaaaaatgaccaaaatagaagttatagatcttgatgagttatacaactttgttgttgatgacttttccatttgatatcatttactacccgtaaaattattttgactcataaaatacattattatactccaagttaattattttgctatagttcaacttacaaatataaacatttcatataaaaaatggaaaaatactcattggtgacgggctttaattaatgcccgatagagattaagtcatgtcaaccggggattagtatatagcccgtcactgatgagtcatctgtgatgggcctcaagttggtgcacgtcacagatgattgtcatctgtgacaggccccaactcaagacccgtttgagatatggaatgttatctcagtcgggcctaaagttggtgcccgtcacggatgatggtcatctgtgacgggccccaacttcaagcccgtttgagatatggaatgtatctcaatcgggcctaaactacggcccgt

SEQ ID NO: 24822 - DNA, 1501 bp, Oryza sativa
ataatgcatcttgttgatcagttagcaacaggttgtgattactaaactaattgtaatttgaaaggtttcaaaggctccaaaaaggcatcttttaatgggggagaggaatttgaaggatctattttgttctggcattaagcaacgagtagtagtttagtggttgcacgagttagctggatcaactgtgcaagtgtgcatagattaatcagatcgatctggcacttttgcagttttgctccatgcatgctgattcattcacatgtcacatgtagatacaaatgaatagtactctatagcagatacaaaatgaatagttagtctattgcagatgcagctggtgcttcaagaaagaatctaaagataggagaagaacagaattaactactagtaatgctattgctttgcttatggcttacctaattctcattactggttcagaaactgtgggaaaggccaacagaaatgcctctgcatctgctccaccatgcttatacttatcttcctgcagtggcatgtacttctgttagtattaactattaccgattactaaccactgcattcagaatggtctcaagcttatactaattagtattcagtataacaggtcagttctaacagttactgcagcttataatatacggagtacatggacaagatgatggacgaggatgcctttttgtacttggaccatgccaaatgacttgtcaagataatgccagcaaatcagagtacaacaatgatatgctacaaaaatgcaagaaatatgggttaacacaactgagaagacacaatcgctgttgctgtcaggatcataactcactgacgaagggtagtacaaagttgccgttccagtacaaatatgatcaacgactcaaaaagagatggatgcaaactataatataatgttcaggcacttgatatatattaaaacctaatcatgataaggactagcttacagacacaagcaactaaacctacaatttagaagtataaatcacctggaggtaagatcataacttctgactaatacttacgatgtgctgacaccacctcagctccttaaagtcattcatgtaaactagtcgtccaagttccaattttcaacttctgtaaaaattagttccaggtaagagcacaagtcatgttaaacagttaaaacatagctccaaattccaaaaatatgaaagcagcagtcacgctgaatgtaccactacaatttgtagtatgattagaaacattcaaggacatgtacgtctcttgtctaacagaaaattcgaacaagtcgcatacgtacgacgcagatatataaaccaaacctactccaaaaattttggacaaataaattctgacagcaacagatacaccatcaccagctactctgatgcatgtatatgtactcatagcagtataggcttatatcatggctagaccgaaaagataacaatctttaacttcttaacatcgcattaggacaaatgactgaagcttaattagcatgcga

SEQ ID NO: 24823 - DNA, 1501 bp, Oryza sativa
tgttcagattatatctaaaataaaccttaacaagttttggcaagatggcaatattgctaaaattttggtagaattttttttgtatttaccaattttggcaacaaactaaacgtagacattttttgacaacttcacaaaaagaatggaatggttgaaaatagcagtaatctgaacagctccttaattattcgatgaagttgatatgtggacccacaatttttatttttttccaaatcaaatttcacataagcgccacgttatatgaagacatagtcaaattagatatgtaggcgtcacgtcagctgaaaccgtcgtccaaatcatcttgggacttattttttaatggttttgactgttgagggacccgctgtatatggtttttcggttgaagaaagaaaatcgaattcgtagacaagttcagggacatcagatgaacttattccccatgaaaaccgcacgtaatcggcctttttttttctcacgtgaaaccgggccaatagcccacgtccacgctaacgccgaaacggccggattcgttgacgcgatagcacgttgcttcaaaaaaaaaaaaaaaaacactggaacttgcgagttgcgagtgctggaagcttgtcggttaatgcccttttgcccaccacattgttattaggggctactctctccgtttcaaaatgtttgacaccgttgactttttagcacatgtttgaccgttcgacttattaaaaaaatttataaaatatgtaaaactatatatgtacatgaaagtatatttaacaatgaatcaaatgatatgaaaagaataaataattacttaaattttttgaataagacgaatgatcatacacgtacttaaaaagtcaacggtgtcaaatattttaaaacggagggagtactaattagttagggttaatttagtattgcgttctcaaggtaggcgatggcgtaaactagtccatattgcgtgcgtggagaggctcgaaggtacattgagagatgttttgcgtgatggtgttacctaggaagatgtctccctaccccatcggtctatggctaattttgcttagccacggtaaccgtgctacactaccactaacacaaaatatttttataaatctgcctttgaggatcctagggctccctccaggttatatatgtgaaagggaaaggcaagttccaaacctgcacaatatactcctactccattcgtctctctcatcatctcatgcgttgcgtacgtgcatggccgtcagattggaagccaacggcagagatctccctagcaccgaccattccccttttgtacaagctgtaataagctgaccatcaaatcgctcttataactggcaatgctacggcatcagtaactccgtagtactaataatcacccaaggaatgtgaattgaattgccatcagctggcctggatggatgattaaccggagtagtacaggcaaagttttctccatcaacagtaggagcagtgcagtacacggtggggtcaa

SEQ ID NO: 24824 - DNA, 1501 bp, Oryza sativa
cccacgctgggaggtggtcgccgccgccgtcgtcctgcgtcatggcctgcaagcggtggaagctcccgaaggcggcggcggaggcgaagcggaagtgcggcggcagcgcgtccatggaggacagagcgagcgccatgacgtcagcgctctcagagaggtcgagctccacgaacagctccagcttctcgccggtgccgccgccgtccgcgtacaggaacacgacgtgcgcgcgcgggcggcgccacggtgatgtgaggtccgggaacgcgaacgcgtgcgccgtggcgcccggcgacgccggcggcttgacggagaagctcaccgctctccgcgcgagcagcgacgccgcgaccggctggaacggcacaaaccgcttggcgcggccgccgctctcgacgagcttcacgaagtcgcagacgccgtccgccagccgctcgaaccgccgcacggtgccgccgctcagccgctgctcgtctccgccgccgaaggcgaagagcttcttgccggcggcccgagcaacgcgcctcggaaaccaaaggcggcgcgcatcatcatcgtcgacacacaggcgccgccgccgccgccgcctgtactcccgcaggacgcactcgccctcgtcggcggcgcgcttgagcttgtcgcgccaccgcacgagcgggcggttggtgatgtgccagccgtcggcctcctcgacggcggcctgaatcttgagcagcgccacctccatcctctcctcgtcatgctcggctccatcgccggcggccacctcctcctcaccgcggctgatgaggtacgagcatatccggccgacggcctcgccgacgaccgccgagccgacgatctccaccaccgacggtcgctgcatattcttcgcttacaagtactccaactatggtggtctctacgcacatggtcatgtcaatattccaaaagttttgacaaaattacaccgaaagataaacaatgtattcatgagtaatgtgaaactgaaatcttacatgttttggattattattaattatatttgatttgcatgcggttaagtttaaccctttcattgtcgatggatgacctaaagatccaagaaataatattcttatgtattatagatgtgcaaatttcatcctagagagactattatctgccacatagaaaggttgtgtttctaagtaggaagacagattgtgtgaaatcatgacctttgtagtgaggtttctagtgggaagcccaatgaggataacagtggttgactgaagaaacggagaaaccgtataatcaatcaaaaggatcataatcaagctgatgagacagtggctcctgatgttttacacatcgaaacaaccgtagcaccaaaacctatctattcccagctctccaagtgaaccagccggctggacgaccgacatctcgatgacaacgatgccacaccagatggcaaagccgtcgttcttgacataccaacttactccctccatcccattttaagtgtagttattgtttt

SEQ ID NO: 24825 - DNA, 1501 bp, Oryza sativa
tcgtacgctggggcctgtctgtgggaaacatgtatctgatcgtcggggagcacggcgacaccgatcacgaggagatgctgtcagggttacacaagacggtgatcatccgcggcgtcaccgagaagggctcggagcagctggtgaggagctcagggagttaccagagggaagatgttgtcccatccgagagccccttgattgctttcacaaagggtgatctgaaggccgatgagatcatgcgtgctctcaaggaggtcaccaaggctgccagtggcatgtaaattggttgcctgctgggaagcctaatattactctgaagcctggaagaatcaggagtgccagcttgatgaagtctcctggctctttaactgaaagacaagactctttttctctccttaatttacagcataatcttatggaccactaccacgaacttaccttgcagtgagaaataattatgacactgctgatgctactgttggctcaaatgtttatgagctgattcagttatatgtattttttcttttaatcctgcacttggttcaagtacgcatatcatggcaattcttttaataatttcggtccttgttcaggattggattacttggcacgttctctccgtggtttgtgaaaataacctaggacataaatgttttgtaacttaagtttcagtaaacccagtcaaaaggaaacatacaattcaaacaagctgactgataattaacactgtatttctgacactaggttcattttctgagactgtcctatcgctgaaaccttttttttattttttgaaagaactgaaactttaccaagctaactaatactctctccgtccctaaatatttgacgccgttgactttttagcacatgtttgaccgtttgtcttattcaaaaacttttgtgaaatatataaaactatatgtatacataaaaatatatttaagaatgaatcaaatgataggaaaagaattaataattacttaaatttttttgaataagacgaacggtcaaacatatttaaaaaagtcaacggcgtcgaatatttagggagcataaatgaaggttaagttatatttctttaataataacttacaggccacgtggcacactccaattggtcgacaaacaaacgcaaaactggaatgataagggaaaaataatctgctactagtatttatcttgcctacacaacttccagcatgatgctttctgaaacgtccctgaagcatttacataggcaattgattggttcaatatctgcttccctctgcgagacatgtctcttccctaatcaatatcagaacgaaactgccacaattttacaatatatacagggattggcagaggccattgtgcaagactgcttattggttccaatcaagagtgtatactaacatggaagaaaaggaggaaatgaccatgctttcccttggagttggagctgctagcaagcactcaatatccaacagaaaattcagactgaaagaagtgacagatc

SEQ ID NO: 24826 - DNA, 1501 bp, Oryza sativa
ttggtttattttggaccccagatttttcgggccaaattcaaaagccattaattattcgcatagttcaatcctcaaaattatattttgtgttttaaaatctagcatgcttaaggaaactcgatgtaatcccactactgaactgcattaataaataccagtataaatttactactgttcattatgctactgcaagaacatatctttgacattattgtgtgtgtttttcttttggccctacataaagcattcacttcataaagcacagacaactaatatcacatcaaaatcgtgaagtgcacatttgatacaagcaagaaacaagaatactgaaaatcacatgtttaccctaaccaatgatcttattattttaataattagacatgaatctaatctatagttagacttacctccttctggtccaacaatcaaaagcccactttcttcattgcaggacttcggcaaagtgcttaaaagaggaggtgattctgctgaagctacgaaagcgagctttgactgtgatacctgatgatagataacacaataatatgactttgtcaatcacacatcgtggtgtaaaagaagatgcaataatgactctggtagttctacattctagtacatacattaaaattttattcctatgttttattcttaacaaaattttcactgcacaatgcatcatgaccattcactccacaatgcagtactaaagattattgcgctttgacctagaacatttgctcaacaaaggtcaatatcatgcttgcccactttataaaaaagcaagttactggatccatacaaaactcttactatccaatgcatgaactaggtaacaaagttacaatgttatgtgcaaagataataaagcatatgtgaacacttacaacaggctgaaggtcagctatctgaattgggggattcagcaacattccatgtattctctggcctaaagaaacaagagtaatgctgtcaatttatttcagttcattttgctctgaaatcttggtgccaacagagacacatacattgtttaactgcagctaacacaagcctttgcaatctgtcaactctattttctgctattgtatggcatcgctctgtaagaagaggtgtaacactacaagctccaagctcctaaacagagaaagagtaaaataatgtttagaagtagattgtgaagagacaagacacccaaaattgtacataacatacagtacatttctctacaagccaatctgcacgtccacctttcaatgtccctggggaatggaattataaaatggtaagctatggagaagaaaactaccctgtattcacagtaagtgcgcataatttatgggactcaccaaatgcagcataaacatgccattgaatgccatcaggagcaatgagtctagcatcctcaagcaacttcacatctgaaccgcctttgtcaactttttgtatagatccttcaaccaaaccacccgcgccatcaaatagttcaacccttccaagt

SEQ ID NO: 24827 - DNA, 1501 bp, Oryza sativa
aggattgcgttcaacaaagacccattccttgatgatgctgtcttgtcaaatccaagcaccagtaatggcaacaagtaaatgaggtggcaagtcttattcatccccttttgtaacaatgaagttgtaacattccttcttgtttaatatactgtcttttgttttgagagaaataagagaattagagaatttattatatgttacaatggaaatttgaaaagcatatgcacatgtatggtgatcctgaagatgcgatttcaggaaacaacaacgatgacactagtcggtgacgtagttgttccccacatatgagctatttctacaagggagctcctatcactgtagctatagtcatgcacccccatggtgcgcatgctgttgctgttgtcgatgttgacctcatgcacctctgccttagaccccacttccaactcattctcttgtgactccaaaggcagcatgctgttgtctttctctatcgtctgtgccacgctactgctcactcccgggcatgggcctagattgggataactgtcattgccaataagagatggagctcgattaaggcaatttcatctattaattagaatgttgagtcggtttgttagagatttggtaagagaccgccgtatatggtcttatttgtattaactttaaaaataatagactgagtttgtactcggcatataaatatgaaccccatagcattgaaataagggagccaatccaatataacttcggcgcatcgccatccttttacttttctcgtttttagtgagttcttcgcaagaggaaacccgtctcaatggcctgcgctatcggggctaacatgttaggctcgatatcacgagtcattgctatcatatctcttagttaatctattcttagcttctcaatttagctctatcggctgctgctcgctttagggtttatgctggtttcggttaaattgtcttggtagattagattagctaaggcatctaccatcctgaaaagtgcctaattgcttgattgtttagattgtatgtttcttttcatactttgagatgcatcatttctagtcgtgcttagaaccatgcaaactagtctgcaattagacataataaggatagtatcggggtttcagccgatcttacctaatatgcatgttcactatctgtttcatgtatattcaccacttatatagatagatcattttatataagcatatcaagctttagtcggtatcggctagattcttgcaccttcatgcttgatttctgtttgatatgtttttatggatcaatttgtttatataagtttgtactagagtattagctagtgcattatcttttctgctctaaatattgtcacataagctactttcataatattgtcttaaatcaatctattaaactcgatagatagtattatagccgattaggtgtgtttagggtttattattctttgatatatccagtccatagccgatttggtccaactccatcggctaagaccatcaacg

SEQ ID NO: 24828 - DNA, 1501 bp, Oryza sativa
catttaggtctttttcggaacgcagaaattttagaggttttttttaacataaaacagtttaactcctccaagattcccgtgcaaaatcttccaaactgaatggcccttcaagttatatatttcctctaaactgcacattaaccttgtttgagatccaggactcgtccgctttgctcgtgtggtctagcgtgctaatcttcaaccatgattgatactcctgcgatcttagcctacggtatttcaggtgcatgtgcgcaacaaatatatatacacagatatggaccgatcgatccatgcatacgtgcgtctcgcgtggctgcgattccatggcctaatatcttaattagcgcaggaagatagtactactacttacttaccagctaattgcctaatttccacgcccagtgagcggctggagctaagcacgcagctagtagctaacaaactcatatatcaatcaaaactgaatctaacacaaatatacactaacatatactccatagtgcaatgataagagatgtgtgattctaactccaaggtaccataccgttcccaatacattcacattttcttcttaattttttttagagacgtctctttctccaaatttcattttctaaaactgaatctaacaccaattataagctctagataagtgatatgaagctatcggcatatcacacagtgtcactatgctacgtacctgccgttcaatgtgtagggaggagaacgatcgaacccaccaaatgttggtgttagttgctcttgttgctattgtcaactaccggttacatctatcagttcatctcttgcacaaacacaacgcttgtcctggttgatctataggacaaaatggtggtttcggcttagctattccagtagtactttcttctcggaaagataatgtcttttgaatcttctgggtaggaatcataatccttcttataaatgttgttgaatctagtagcatttggagcaactttacaatgcaaagataccggcaccctacattaaaggtaaaaaaaaaaatcccccagacaaataaatcttaccagctacagtaccacttactactgccacagctatacagtaagatctctccttaccatcaattttgccggtggttagagcagtaaaatgactcggttaaaaaaaatatggagcagtagcagtaaaaatcttcaaacaagtttccctttttacccctgggtgttgtactactagtacttggggcttgtggctagcctttgcccccaaaaggaaaaccatcccggtttcccgaacacgagccgcccgcgacgacgacgcatccgccattccaccggcgacgcgacgcgacgcgagagcacgcgcgcgctcgcgcggggcgccaccacaacccgcacagtgagagagggggggatgcggtcgcttgctccggtagctgcggctgcggcggatgagcgggggagcaggagggggcagtggtaggaggtggggatggacctgggtggcggggtgg

SEQ ID NO: 24829 - DNA, 282 bp, Oryza sativa
agaaaatgttcttatctaatagtagaaagctttgtcactaacgtgtgttgcattctatttgcttcatcttcttagctggattggcgtcatccaattttagtcttctcttcaaaccaagggtgatttcatcgctaagtatatcagccccagttctagacagaactccatcttcggaattcttgctcttcttaagactttttccagcatacaacccaaattttcgctttgggcagacctcggttgtacaatctgaaaccaacccaaattttctctttgggcaga

SEQ ID NO: 24830 - DNA, 1501 bp, Oryza sativa
tgtctgatctatgtcagccgatgcagtctttagccgatgtcctcgtagccgatgtgcactctattttcagaagacaaatccgtatcaaatcctcttcgatcccgatacgaatctagttcatggcttaccaaatttggtcgttaacaatatgcttgcatgttgatttgtagaattaaatagattgtagatgctcttgcatgcttgcatgaggttgaatatgtaattattgttagtagatgatgatgttgaagtatagattagaaagagaatagcatagaacggtgacacaccaaggtggtcactaaggggtgttaagcgacccggctgattattcctgcaagtgaaaaagaaacggctaacactaaactagacgctcataaaagagtaagcgaggagaagaagaacatgaaaagctaggtgtcaaacaaagctcccacagggctggctgtggcctctgggctctggccaaaactgtcctttctacgcacaatctgttcgaccaccatagggccgcgaccatggttagaaatttcgtttcaaaattttggtaattcgacccccaccgacaaacacaaatctctttgaaatttttggttttttatcaaatatttttaatttgatcaaaatttattcaaattcagtcaaaatatgttaaaagttcaaataatttcggttaaaaaaaaccctgaaaatcataaaattttcaattttttggcaaccaccgaagcattggaaatttctgtagcaaccgaaattgtaaaccctggctgcgacaggtttaacaacttaattgttccaattagaggagtcaatggtagtactccgtccgtcccattttaagtacaaccataagtttctgcgctctctcaattttgatcgtccgccttatctaaaatttttttataattagtattttttgttgttatgagatgataaaacatgaatagtactttgctcattacttatgtttttaatttttttttaaaataaattttaaataagacggacgatcaaagttagacgcggaaaacaataactacacttaaaatgggatggagggagtaagttggtatgtcaagaacgacggctttgccatctggtgtggcatcgttgtcatcgagatgtcggtcgtccagccggctggttcacttggagagctgggaatagataggttttggtgctacggttgtttcgatgtgtaaaacatcaggagccactgtctcatcagcttgattatgatccttttgattgattatacggtttctccgtttcttcagtcaaccactgttatcctcattgggcttcccactagaaacctcactacaaaggtcatgatttcacacaatctgtcttcctacttagaaacacaacctttctatgtggcagataatagtctctctaggatgaaatttgcacatctataatacataagaatattatttcttggatctttaggtcatccatcgacaatgaaagggttaaacttaaccgcatgcaaatc

SEQ ID NO: 24831 - DNA, 1501 bp, Oryza sativa
aaacctgctaggacgtgtggctaggttggccattgtattagatgtccactaggatttattagatgttaactggcctataacctttatataaaatgcttgagcctattcgttaagccatttgcaggagtatttgatactactgcaaatggattaacgaattggattgaagtagtgtataaaatgctatgccttatatgggtcagacctaaatctaaccggacttgcaattggacttagccatacgtagattgctcactacatggcccttaacatgtcaacagtgtgtcaattgctatgtttcagatggactaggcttacctctagccgagcttacaattgagcatagtccaaaatgatactatattgcccttataggccaagatgatgtttcttaggttcgatagtgatgaaaataagagtcataagctcaatgatgatagaagggtcatcacaagctcaatgacagaaaacaaatattttcttcaaagaagatgtacaataggtgatgaatgaatttccgtcatgtcaacatcatagatttcaaaacatgatataaattaaaaaatttcatgacgtaaatgaaacgttacctaccacagacaatccatggcatattatgattctacattgccctcgtctatctttcctttagaatcatatataaaacacctattgaaaaaaaatgtaaactacaaggattttctttttatttcgagttgatgtctctagctccaaaaattaatttaaactttagtatgaaatagagtaggataattaggacgacaaagacattttgttgacattcgagactaaaattagatcactaaatcacattatttaaatttacaaactgcattttccataatatatcaatacatggattggagacatgccaaaactagagggctttgcagtttgcacatgcaaaacgaataataattatccactgcgacctccgctcaaaaataaatataatgattctaacattagacacatgtattaaaaatgttagtgaaattaaatggtgatgaaaagttattactgattgagaatagtatgtagatagagaatttgaatggtagaagtttgtgattgatcgagaaaagaacgtaggagaagaagttgttatattttaagataaactttaaatgctagaatttgttatattttgaaacagagcttgtaacaaataaacttcattcaaggctgcctgaaacagtgaaaccagacccttaaaaaagacaaaaaaaaaacaatggaaaaagtacaccgaaggtccctcaacttgtcatcgaattacaaaattgtcccctgaccgcaaaatcggatacaacgtatcccttaacgtacaaaaccagtgcaaactaggttcttcagcggttctgtccccagttttgtcccaggtgacggctgagtcagcgtgggacccacgtggaccctacatgttaggtgtccacgtaagcacatgctatctttcccctttactccctctcgctctctg

SEQ ID NO: 24832 - DNA, 1501 bp, Oryza sativa
atcatcgctgccgccccagaacgggctaggctttcgcctagcaatcttcctacctcaacctgttgttgagtccctatcgaaaacagaaaacaacagtcattactatctaaagcacatttgttgacgattgttaagtacaaattttgaacaccaaccagtacaatgaataaaggaaaaattagcatatgttacatgtatatcaacaacaaataatgtagttgtattaggattgggaaacaaatgtggatgtagagaatatacatcaaagtgaaggagaaatgaagacaacatgtgaagaaacacacttccgatgaatcacgtgcgagcacacagattaaaggactcacaagtcagttcaaatcgactcaaagtggggccaaccacctggaaaccgactaaggggcccacatggcagcctctcgccaaaggcggttttcctggtttgaccgaactaggtgttcaaccgaacattggctagcaccgctcagcctgatcctccacgtgtcacctcctcctgcgcacctgatggcagttatgcacggctggcggaccaataaccgtcatataaccatcataagagtgctataaaaggagctctccctcacttgcaatacacacctcaaagaagaaatcccctcttccgctttgtattcagtttctagtaggaataaagtttagaatcttcggtccaatagtcttcttggagttctgggtatgtctctagtactttactctttgtgtaagattatagttgaattaatagaattatcttctttatttatttatgctcatggtttatatatttctttatttaatatatgttctatgaatagtatatactttgtatatatgcttcatcctagactttgtatattggtccatgctacggtaacggtccaataacctttatagattgatttaactccaacttattcatccgtagggtgagagtcttgggggagttagtgatattgtttacttgcacaagcatggtatataggctaaataaatgttgttggatccgggtgtgcctccacggaaagtgaggtaggtggcaggtggtgatagccatgtccgtcctttttattcctacacattcaagtatgacgtaagaatgcataaatgccataaccatgctggcagactagtagtgagtggtctctcggtagtatctgtgtgcctagaactaagtcctatgttgttagcatgtatatgttaagtgtatactagaaatgattagtattcaagtatatatgaatcgtagtttcctaatgataagtccctactagatattcttatagaggtgaatcttctgtgtgtgtccactaccttatcatttattatcctaaccactatttagactatggtgaattaattaaaggttgattaagagatataaaaaaacatatctttataccacccccttcgctgtggaagcacaaatacgatacccttgggagtactcgtgggtgaaatgctatagcgatatccgtgcgcttgc

SEQ ID NO: 24833 - DNA, 1012 bp, Oryza sativa
gttagtactcagtgcaaccgatggcactgcccagtgcccacccatatcggaatgtatatggaacaagaaatcaatcggattaatgcgtagaaatatgtttttcagagtttaagactgttccattcagattgacacaaattctggcaatagaaaatagtggcaggtatccatgtaacatatttttgacggaagaaggtagagtaggctctaacttatagtcatttcattaatagaaatgaggtttacagattacatattaggtgtgggaattatcagagagaaaaaaaaaggaacaaaaagcaggacaaaccaaaacagaaaaagggagaatttacagatatatgtacatgatccatgtaacatatcagggatattaataaaaaactttggactagtcattgaattaaaacaggggagtaatttatggctcattaataactatagttactgaatcaagtagtatcaaatctaaacggagaaaacaaatggaaaatggcaggaccgcaggtcaggaaagctagattccgtgcgagaagtggcgattataaaaatcaaacctttgaacataattcatggaattccgttactaaatcaacaattaagttcatggaattccgttactaaatcaacaccaatgcgatgtaagcatgacaactacctaaagagtataacgaaagcagaacagctaatacttcagaagaacaaacaaaagacatatggaaagaacttcgaatcgcaaaagaatcaactcaaaaattaacttttagaagacaattgaaatcataaaccatcacgtgcgcatcaatcccggagaaattcgatcttttagcaacggaataaaccgaagatagcgaagaaccagcagcaaagatagcagagcagcgtaaattcaggggaagaacgttacaaaccacaaacttaacgaattttaattcaacctctatcggaatcaactccagtaaccggaacaaataccccaagactctcaaaaattcagatgaaaaataaggca

SEQ ID NO: 24834 - DNA, 178 bp, Oryza sativa
ccgactagagggggggtgaataggcggttttaaaacttaatggcacttaaacaaaactaacctaagttgctaggcaaggtgaggtgcaaggttagctaagcaactaagttaagttttgcaaacctaagtgatatgggctcaaatatgtctctatgaatgtaaatagcacaaatgtaaa

SEQ ID NO: 24835 - DNA, 1501 bp, Oryza sativa
ccgccggccacagccgcgcgccgccatcaccgacggcagtgacttgatggcgtcgtcgtcgagtcgatctcagtgatgatggccacagccgcgcgctgacatcgccaaccgcacgagagggatgggaaggccggcgagctcgcgccgccctaagcccgcgcgccgccaccctccagccgtgcatgccgccgcctgtgcgagagcagagagcgagagggagtaaaggggaaagatagcatgtgcttacgtggacacctaacatgtagggtccacgtgggtcccacgctgactcagccgtcacctgggacaaaactggggacagaaccgctgaagaacctagtttgcactggttttgtacgttaagggatacgttgtatccgattttgcggtcaggggacaattttgtaattcgatgacaagttgagggaccttcggtgtactttttccattgttttttttttgtcttttttaagggtctggtttcactgtttcaggcagccttgaatgaagtttatttgttacaagctctgtttcaaaatataacaaattctagcatttaaagtttatcttaaaatataacaacttcttctcctacgttcttttctcgatcaatcacaaacttctaccattcaaattctctatctacatactattctcaatcagtaataacttttcatcaccatttaatttcactaacatttttaatacatgtgtctaatgttagaatcattatatttatttttgagcggaggtcgcagtggataattattattcgttttgcatgtgcaaactgcaaagccctctagttttggcatgtctccaatccatgtattgatatattatggaaaatgcagtttgtaaatttaaataatgtgatttagtgatctaattttagtctcgaatgtcaacaaaatgtctttgtcgtcctaattatcctactctatttcatactaaagtttaaattaatttttggagctagagacatcaactcgaaataaaaagaaaatccttgtagtttacattttttttcaataggtgttttatatatgattctaaaggaaagatagacgagggcaatgtagaatcataatatgccatggattgtctgtggtaggtaacgtttcatttacgtcatgaaattttttaatttatatcatgttttgaaatctatgatgttgacatgacggaaattcattcatcacctattgtacatcttctttgaagaaaatatttgttttctgtcattgagcttgtgatgacccttctatcatcattgagcttatgactcttattttcatcactatcgaacctaagaaacatcatcttggcctataagggcaatatagtatcattttggactatgctcaattgtaagctcggctagaggtaagcctagtccatctgaaacatagcaattgacacactgttgacatgttaagggccatgtagtgagcaatctacgtatggctaagtccaattgcaagtccggttagatttaggt

SEQ ID NO: 24836 - DNA, 1501 bp, Oryza sativa
cccaccctaaaatattttaccctatcacatcgaacgtttgaacacatgtatgaagtattaaatacaggctgaaaaataactaattgtatagattgtgactaatttgtgagacaaatcttttaagcctaattgctccatgatttgacaatgtggtgctacagtaaaacatttattaatgacggattaattaggcttaataaatttttctcgcggactactggcagattttataattagtttttttattagtgcccgaacatcccatacgataccctatataatatacccgatgtaacacgctattacacctctagtaacgaaatcatatccataatgcttaaactatctaaattactgcacaattcacgaggtgagatgagttgtctgaatttattgactgagctatcagtctcagatgtctgaagctggaccataaggctataaataagaattcagaaatgtacacaaaccattagttcatcaaagaggatacagagagatacaataaatacatggttccaactttcaacagacatatcaataataacagaagtaacaccaataatgatgcaggatgctggcataaggccgacacagcaaacaccgatatgagatgtcatgtacccaaaaggaataagtttattcgaggtcccttaacttacaccgaatacgattttcatccttgaaccaaaaaaccggaaacaacacatccccaatttacaaaactagtgcaaacgagatccctcggtagtgctgaccccggttttggttgacgtgatgcctacgtggctcctttaactaagtcttcatccaacgtggcaaagacgtggcaatgtgatctggaaaataataaaaattgtaggcccacatgtcagttacaacaaaaaataattaaaatggaggggtccgcgtgggcccaacatgtcattctcactcccctcctgtcacatcctgattttcgtttcaggatttataaattatttaataaattattattagaagttatattaaatgttcattaatttacaagagaagttaaatgtgggaaataaaattttctaaataaaaagcatggctggatttaatttctattaaattctccatggttaattatattctctggaattttttcggatttttcggagctcaactcttaattttaaccatacaaagaacatttcagtaattattcacatattaaattaatcattaaatggtctgcttataatttttttaagtactttgagtgtccaagtattttcaggatttttcttgaaactatttgagcattggaagtatttttaacaattcaaagatcatttcagtgattattttaattggaaagttgttaaatcctctcctaagccgttgggctgatttcagcccaacatctctctccttcgcgcgcgtgctgtgcagcccaagtcggcccagccgagctccccttctctttctttctttcctttgtttttcagccagcccaagacgaaagtctaattgc

SEQ ID NO: 24837 - DNA, 1129 bp, Oryza sativa
cttcttgatctggaagaacctcttctcctccataatttaaacctctcagtttttaaccatagtgaacgtttctttgcttctactgcacccttgcagtagaattcagggggagttttagacctaagctataatagacttccttcctcgattgggttttcagggaatatgcctttgctttctcctccggttcttgatttcctacctgaagatattatctctctgatcaagactagttcgagcagacagattgattcagagattgcttcatggctgtgaccttgttcaatcttgaagcaaactaaattcgcaacacatgtgcgattatgatgagctcacaagttgcttctgtttctgacggattaccacaggcacagggtccagctgcaccgaatgactcgccgcgcaagcggttctccggcgtcgcgccgccggcggcgctcatcttcttcgtgctggtgttcgccggcggtgcaatcgtcacgcttgatcacaaggaggtatgcaccttgatgcttctttacatcaagcacagagatagatgaatgataaaatcaattctctgaattctgaaagcttatgaatttgtttctgcagaatttgtcaattcttcagttacggccgagagaaatggtcgtaagcgagacggagacgagggctccgacgagcgaggtgcaagagacggagacgagggctccgaccagcgaggtgcaagaggcaggcaccggcgccgccgccggcggcgtccagcgagcggaactcgccggcagcagcatctgcgaggtcagaacagatgctcactccattccaatatataacaagagccttcaaaatttgttataaaatatgagaaactcttttaagcatttagatagacgtttcttacatatcaactaaatagttatcaactaaatagttatgaaaaactttcaaaaaaagataagaattattactctataaacatgtaagtttgaattcaacttctatatattataacaaaaataataaatttaactgaatatacgtatactagttagagtttaatttattattttttttaaatttatagaagtcgaattcgaacttacatgtttatgaaataatatattacctataattttttcaggttttt

SEQ ID NO: 24838 - DNA, 1501 bp, Oryza sativa
agctcgagttagtccctttcacattcatttttgacgccgcatttcaccggcattaaatttgctgggaccttcataccttcaagcttgtactctggaaccatactctccattaatatatcgctgtactgcacaaggaaaatcggtggtacacaacagtatcgatttgaagaacctctttaggggggcttccatggggactccaaggcgttcctatcgttgtcagcccgatttggtggcccgtggtccacagcatggtgatgttgctcgcagtgtcatggaatttaatttgatttgttcttcgcttgttagtaccactggactcctaggtagagatgctttatggcagctcagtgtcgctgacctgtttagttgacgggttctagagtcatttaatacagtatggcattggaaggaggttggttgtgtcctatcctaggcatggcactgaaatggaatcacctccatactccacccctgtcctgggtttcttgatcggattatttgctccatttctctataaaaatgtatttgctcggagtatttatttagtattgttccattttctgatatttacaaactgataccctggaaatcagattgtttttctgagagggtggatatcatagttactgcttaaaccttacccaaagttaaatttttctagttacttccagtagttaaactggcatgaatgcaagatggcagatttgactgcttggtccaattagttccacctggctgatcttatttctatttctgcacaccctgctgcagcaaaaattgtgttccccccagagatgctgcccatgcccagctacagtgatatgcagggcttccaggctaaaacgcgcaggaaagacatccttgctgtatatcaggatttctttagcctatgcattaatacgttcagtatggggagatcctcgcaccataatttatagagcatggcatgtgactgtagtgtggacaaggtcaatgatattagctagtagtactaacctaactgcattttcgctttgtctacctgatgaactctagagaggccaagaagctaaagcttattgcacacttcagttgttgtgcataatctaccgttttgtcaaaagaacagtccaaccataactgatttaattttaaccttaagggaaaaaaatattaggatgaccatcaaactagtacgattagtcttctttatcttgacaaagctgaatggaaaccgtacaggtcaccattctaagcatacctatacatatattttacaactcaggtgtaatctgtttcttttcttttctttgggagggtgttgcttttaacagtgtcccatcagtgtccctcttgtcaaagtttaaccttgtaaatttgtaaatactccctaaattaatgaaatttggccggcctagtctttggccagcctggcaaatgcctaaagctagaggtatattcatcatgtgtctggtagttgctgaaagtttgtttaatttttgtatcagggttgagaaca

SEQ ID NO: 24839 - DNA, 661 bp, Oryza sativa
cgccgactccaccgccgactccacggtggaacgtttgaacgagaacgttttagcgaacgatgacttagcgacctagcgacttagcgagaacgacgtcttagcgacttagcgacttaacgactttcacgaacgacgacttagcgacttagcgacttagcgagaacgacgtcttagcgactaaacgacttaacgactttcacgaacgacgacttagcgacttaacgactttcacgaacgacttagcgacttagcgagaacgacgtcttagcgacttagcgacttaacgactttcacgaacgacgacttagcgacttagcgagaacgacgtcttagtgactaaacgactttcatgaatgacgacttagcgactttgacagacaacgacttagcgactttcacgaatgacgacttagcgactttcacgaacgacgacttagtgacttagcgactttcacgaacgacgacttagcgactttgacggacaacgacttagcgacttagcgagttagcgacttagcgagaacgacgacttagcgacttaacgacttaacgagaacaacgacttagcgaattatacatgtatacttgtagggtttagacgtatgagctgtacatgttgatgtccatgacctcactgtctttttttctttgcacgcacaaa

SEQ ID NO: 24840 - DNA, 1501 bp, Oryza sativa
ccaaattttattaagaaagaaagatgttacaactttaacaatatcgacattaaactgtcgagggagagaacgtgggagaacagagagaagagaacaaaaacaaaaaacacacaggaccgctttatagcggggttcttagccaacttatctaaaaataacggcctccctctacaccaggatctcatctctaatatcattgtatatccctaacactgagcactctaaaaataccagcctccctccacaccatgatctcatctctaatatcattgtatatccctaacaccaagcataacctttgctcaaagatcctggcgttcctctctttccgcataaaccaacaaaccatcatacaatgaagtacggtggtgtttgaatcttctgaagatgaagatgaagataaagattaagtgtttcacgtaaaacaagatggtaataacgtgtgattaattgagttttaattattacaaatttgaaaaattgattaatctgatattttagagcaacttttatatagaaagttttcaaaaaaaaaccgcaccgtttagcagtttgaaaaacatgctacgagtatccaaaatttcatccaattcttatcggagaaacgaatgcagccagttgcatgcgctaggtggagctaagtttgatgaaactgaagagatgttgataatcaaaacgagtacgtcctttcagcagagatgattgtctgaaatcaaaatattttagacgacgacgttggttcagagattcaattcatagacatatatactagtaaggtaaactatagattcacgtataatatacatgaacaccctgaaactgaaaccgaaagctagctagtgatcagaccacacagatgatcactacttgcctttcggcaacggtagtcacacacacctcaagaacacatgcttgcttgcatatagcattgccagtttgccactaattgcatgcagtctccatcatcgaagcaaagcaaagaaaaacacacacatgtacacacacacactctctctctctctctctctctctctctctctctctctctctgcacgcgcgcgtgcatgcatgcaaagatttcaaataatcccaagcgcgcgagagcgagaaagcaaaaaagcgcgcgaacaagatcccgttaacctaaccggccgtcgcgtcaacttccaaccccccactaacactcacactcgcactcaccaccatgcagcaatgtcatccgaatcaaaattaccaagctagctaatccaccaatcctccccagccgttcgttcggatcgatccgacggccaccatcccactctgatcgatccatgcatatattcctccccagtgactagctcgcccccgctataaagcccagctcacactacacccactcatccacagcgatcaaccgcattacacttggttaattaattaattctccattagcagctagctagggttctagggttaatttagttgatcagttcgccggaaccggagaagaagaagaaga

SEQ ID NO: 24841 - DNA, 1501 bp, Oryza sativa
aagcaatgaaattttattatttatatactctcagtactttagtttatctgagtattggctttactttatatctgtatcggtacagttgtgtagttagcctaccacagatgtgcaatggtgtggttttagtgtccgaatgctcggttgctctatgtcatctcgggggatatagagtagtatttaataatgaagacatggtgtctagattattaagcatcatatctaggcatatatgctacaggccagtcgaggtgggccactgatggtgatagctcagtatgggtattcctccgagatagtatatattcctaagaaactttcatggggaaggtactcttctatatttagccccggttggacggccatgacaggttgtcataaggaacgcggcaacctgaggtggtctctcgaaacaccaggagggcactattaggggtattggctacatagttgtatactagcagatgtaaactagcattgagtgtatacttctagtataggaattgattttttttttctatttcttcttctgcatagcgtaggattgatttttgagagatatgagttctttgctatatcactctactcttataaatatattaatccctacttataccctgatcatacaagtggacactattagcatacactactggagaagaggtctttggagggtcggccaatttccacaatagtcccggttccaaaacgaaccgggactaaagtggcttattagtcccggtttattacctcaacgggacgaagggatttttagtcccggtaccaaccggaactaaagatcatctttagtcccggttcgcctcctgacagggcatgtcagacctctgtcggggggcttgggatctttagtcaaccgggactaaagatcatatctttagtcctggttggtaatacaaaccgggactaaagtgatttgagatctttatgcctggttggtaacaccaaccgggactaaagttgcatagctttatataccccttcttcctcctcccgcccgagccattgcttcaaaattaagctttgagggagggaggtgctgtcaaaattttaagcaaatttttttggtggtaatatataaatttgaggtcttcaaatggttagcaacttcatcctactctttgttttgcttaccatctacatttggagctattttttttacatatttttccctctagaaaatgtgatggaagatgatgagagagaaagtgtgtgtagggaataaagaagattataaatacttgtttgaataattacatataattttgtatgaaattataaaactaagctaatttaatattaaaataagaaaaacatattaaatatttgtttataatgtaattaaaacatgaaaaatatgtacaatgaatttaataataatgattaattgtatgaataattaattcaattattgtattattatgtaattaccttgtaaatcttggattttgtataattacgatttatatgtatttcatataga

SEQ ID NO: 24842 - DNA, 1501 bp, Oryza sativa
tcagctcccattgtgagcccaaagatgggatcttttgccttccctttgttcccgtatactggatgagcttttacctgtaatgtaagtatcatcatatttttgactagcatattggaacaatcctactctcatccacatgaagaatatgatgaaatgaaaatgctcatggtgagacagtgcattatcaagcaaaaggcacacggaaaatctaatcactccgtcaaactctggattatgtagtttagatatcaaacagtctgcaagtgatgagtgcacaacaacacatcaaaacagggagtgatcacattataccattctcccttgagcaaaccactcatcggacttgctcgggccatccgtatacttccctgcaccgatcccccgcagaataggaacaagttagcgaataccaatattgacatgatgtcagaacccaactaatgtggactaaaatttgcagcctctgatccgattccccaatgctgaaacaaaacctaactcacccccactgaacgagaagccgtccccgatggactccggcgcatcgatcaagtagtaatcctgcaaaaaaaccccaccgaatcaaaaaccaaatccaactctcaaaatcgcaagccctggtgtggcggctggtgcaggacctcgtcgttgggccgggcggcgcggcgccagcaggggagcttctgggggcgggtgcggaggcggaggcggaggggtagcgcggcggcgtggaagcgcggcgcggcgagcggcggcgccatgggaggtggtggaggattgccatgggggatcgaattccgctggggttttggagggaggaacgaagtggggatagggtttggttggttggcgctcctcccgccacagtttctgaattccccgtgtgggtcccactcgtcagtggctggctcccatttctcacttatttttttgtcactttgtattcggcaaaatttgataagttttcccaattcttttataaggaaactaccaccaggtcttacccagtagttgaaatcatattaaaggagcaaaaaatgttataaatatacaaaccaaaaggaaccgaattacaaggcttataaccagctacaaactgaaaatatatactgaaaaaaataagaggttcattcatcctatataggtgtagaagattttttttttgtttgaaacacctaagccaatcattaacatcatcaggaacagcattctgaaatatgaaagcatttctttatttccagatgtgccaacagactataaacattatttccaaaaacaccttgcttcgaaatctgattctggctagaacaatcatctgaaaaagctctatattatggttccaaataaaaccaatcatctcccagcaagttctccaaatttttgtgtgctgcaaaatgcactagacctcgacaagtactagcatgatatactatctctgaacttgacacctgtacttattctgtttttcttggaataatctgcagccaaattccagctatgt

SEQ ID NO: 24843 - DNA, 1501 bp, Oryza sativa
tgcttgacgtccttgatcatgatgctgccggtgggcttgccggcgtggtcgacgacggggatgccgccgacgccgcgcttgcgcatgaggcggaatgccttgagcgccggctcgtcgtggcggaccttgacgaggcggctggggcgtatcatggggaggccgagctcggtgagcgacttggcgccccagtcctcgaaccagtggagccccgcgcactcggcgagcatgtgcaccacggcggcctgcgtgatgacgttgctgatggtgccctcgccgatgtccaccacggggaggctcttcatccggtacttggacagcagcagcagcatcgtcaggaacgtgtccgagctctgcagcgccaggaatggcgcccaccggaacgacccggagatgtccttcaccttcgtcttgttgaacaggtccgacgacggcagcgcgccgaacgcctccgcgaccgccccctccgccgactgctgctggtcgggcgccctcgcggcggcggcgccctcaagcgcgacggtgccgagcttggccgccagctcgtcggcgccgaggtcgtcggccctggcggcggcggcctcggactggtggagcagccagacggcgatgccggcgaactcgacgacgccgatgtagcggtcgatccagctggcgtcgtcgggggcgtcgacgttgcggacgggggcggtgatgatccggtggcgcgacaggatgtcgacggcctcggcgagcgtggcgtcggaggggatctcgaccacctgcgcgccgtcgaacgtgtgcgggaacgacgccaccgggatggcgtcgaagcagctgttgagccggtcccggtcgctcagctgcggctggtccaggctgtcccagatgtcctccaccctcatcccgatctccgcctccgggctccaccgtgcgctccccagcgggctctccaccaccctctcctccccccgccattgctcctccttcgtcctcacctccctcctcgcctgcatccctgatacctcctcctcctccacacacgcgcaatgcttccttcttcttccgaggcgccaccgcgatctcagctatgtccttcctctccaatggcttcgcgcgcgacaagtgtttcgcgcgccgggactctcgctctcgcactcgccggagacgacgattgctttccagatgggctcaattccaccggtgggctgggccgggagatattttcctcctggaccctttcgcaagtaacacgcgtcgggtttacacttcactgacaggtggggccggatcgacccgggcccacgtgtcagcgtctccggtagagcggtgcgatcccccccccccccacaactaccaatctccacgcccacctcctcctcctcctccgtcctcctctctctccccaaatcgaacatcgagagagagagagagagaggtctaaaaccctaacccccgaatcgaatctcgtcggaagccgccgccgccgccgccgccgacgacgacgcccgcgacgccatggaca

SEQ ID NO: 24844 - DNA, 1501 bp, Oryza sativa
cgggcaattcgttccccttcggaagaatgttcttaacgagtttcaataactcgccgaatgccttgtcacttacaccatttttagccttccattgcaagaattctaggatggtactcaactttttgtagcccttctcgcaacctgggtacaacgctgttttgtggtccgctaacatgcgctctagtttctgcacctccttttcactttcgcagtcctcctgtaagacccgcaatatttgaccaagttcatcagcaccgtcattcccttcaacatccagctccgcctcgcccattgtgttttcttcaaatccgccatactgagccaagtccggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcgcatggacagcttataaaaccgttacgcttgttatcattggccccacccaaaaaataatgcacgccatcaataaactctttcgaccgccgatccgcgtacatccattgccgatccatctatatgaaatacatataaatcgtaattatacaaaatccaagatttacaaggtaattacataataatacaataattgaattaattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttctctctcatcatcttccatcacattttctagagggaaaaatatgtaaaaaaaatagctccaaatgtagatggtaagcaaaacaaagagtaggatgaagttgctaaccatttgaagacctcaaatttatatattaccaccaaaaaaatttgcttaaaattttgacagcacctccctccctcaaagcttaattttgaagcaatggctcgggcgggaggaggaagaaggggtatataaagctatgcaactttagtcccggttggtgttaccaaccaggcataaagatctcaaatcactttagtcccggtttgtattaccaaccaggactaaagatatgatctttagtcccggttgactaaagatcccaagccccccgacagaggtctgacatgccctgtcaggaggcgaaccgggactaaagatgatctttagttccggttggtaccgggactaaaaatcccttcgtcccgttgaggtaataaaccgggactaataagccactttagtcccggttcgttttggaaccgggactattgtggaaattggccgaccctccaaagacctcttctccagtagtgtatgctaatagtgtccacttgtatgatcagggtataagtagggatta

SEQ ID NO: 24845 - DNA, 1501 bp, Oryza sativa
tagggggaaagagagaggaatcaatggggtttaattccccctaatcaattttgtaattagccatttgaatcgagcggattggagggaggaacggcgctagggttcacaggagagagaggaaggaggccggcggctggaggtcggggacgcctgaagggcgggacccacgcggaaggcgcgcggtcaacgcgcgtgcgcgggagggctgcggctcggcttgggccggggcaggcccaggcgggaggaggagaggagggagctgggccgaggggaggggaggcccgggagaggagggaaaagggagggaggagagagggacttcagccgcgggctgagggagagagagagaggggaagactttgggctagactcggcccaaaggaggaaggaggattatttttagttttctttttttaaaaactctgataattgttgttgttgcttaatatttatttccggtgttctaaaaattaaagtaaaatttgagggctccttttagaccaaggagaatttaacaaaaattcttcgggccacattcgaatttttcttgtacgcattttaatgtttgctaatttctttttaaattttaattaattctattattccttttagagaatgatttttatttcgggatgaatttatcaggacgtgacagaaagtaggagacaggaggcgcccggcgggagatgggggaggggagaggcgtggcgacggcgccacaaccggcatcgcggcctatgcgtctgcagcatagggagcgcatccgccgccactcctgccgcctccggatgacgacttggactgccccgacgaggcgcctcccgacgccctcgccttcctcgtcgtgccgcacgaggtcccttccgcgagttgagggcacgacaggcagagaaagccagtgtctctgccattgccgtcaccgcgatcaggtacctcctcgtcgacaagggcctcgacgaggacctgctagtgtcggtcaactctggcaagagctcgcctacatgtgcgacgagtacgaccacctcagggcgacacggccatccacgagcttccaggtgttcgtctcgaccatcgttgctgtcattggcatccagcagcgggaccgcccacacccacccgtcgtcgtgcccccggtgatgtggcgcgcgtggagcgagcttgagcttgctgggctcctgttaacgaccaagtttggtaaatcataaattagatttgaagtcaaaaccaaagcggatttgggaggaaatcgttattcacggaaacagagtgcgcattggctattgtctgcatcggctgacaccgaattggatacggggaagccgatgtagccgatttcggcaagataatcatagaatcattgtcggtatcggtcgaagtgttgtacaattattgccaagtatggattgagtctgaagaaggcaattgtatatattaattaggatattttggtagtttccttatagatattttcagtaagagtctgcctaagggacttgttcgt

SEQ ID NO: 24846 - DNA, 1501 bp, Oryza sativa
tagagtccaatgatcaactctgctaatctttaaaagagaaaattatatatgtaccactaaaatttaaaatttagtagtatcgattaacaccataaataaattatgtatactctataaaataaattgattcaaaacatttaaaaaatattttcatcacctgtattttctcttactcataccctaaagggcgccaagcatggacctcaactggctacattatagtaactacggcaagagtacgcattattgagcagaagtggtccgagtaagaggtcaccattgataatagagctcaactagcctacttaccgatgcaatcctttataaaatagtgctccaagcttgtcttgaggagcacaactatatcaataagggacacatgaatcaaggcattggagaaaaaaggcttagcggctatagtcggcttcactggttattaaagggatattcatatataagttaatgattttatcatattaattaattattagatgtggtatttttaaatatttacatatagattcggatacctgtaaggtatgagtacttgcgtatgaagtacatatgaattttatatggtattaattatgtattgggtttatttgtggatagagatgcagttctaactattaaaaaatatctatatttcaagacaacgataataagtagtggtgatagatgagggcaaaaagatttttgtttggatatgatggacattattataatttagtatgtcaaaatttatggtttatttcttatagtgaatatggtgagataatgcttttttaggttttttttaaacaataaataaattgcccgcgcaactgcgcgggctttcttcctagtagatgttaatggatgtagatatatatatctatctagatttattaacatcaatataaatgtggaaaatgctagaattacttacattgtgaaacggaagaagtaggatgaaacatgatggatgcacattgataacaagcattgagaatcttcattttaacagcgattcattttttctaaaaaaaatcatcgaatatagtgaacagaaactagtactcagcagtcagcaccccgcaaaaaaaaaaaagaaactagtagtactcagcagtgaaggcctcgcttagataagaccattaaggcctatccacgtggtgccccaagaaggattgaggccacatgtggatgggccgagatactgaggcccattaaaacgaggcccgaacggctgaacatggtcaattttccctcacccgatgcgtggaaggcgtaatcccaaattacatttcaagctggaactactcgtatccatcaccggaaggcgtattttgatagttacgcctatcgaacggaaagacgggactagtgtagaaacaacccaaacccctcgtctcagtctccccaagtggcggcgagtcctcggaccaaaccaaccagagacgcggagatcgccgggatttttctccgatgagcggcggcggcggcagcagcagtgtccggc

SEQ ID NO: 24847 - DNA, 1501 bp, Oryza sativa
tcgcggccacccttgtcctggtcctgctatgcgtgctcgccaacacggggggatcgccggagatgccggcggcggcggaagtctgcaactgcagtcagattggaatcgcttcttctcgcatatcagaagaagttactggtaccagcggtaattccaacgaggtaataatgcttttgtactcgatctcgatatgtatggtgatgttttttttctttttctttgttctgtttaattttgtgctctgttgtatggttctgtacttctgtgttagttcatgacagtagcaatctgcaatcttcagtttcatataccatgtttcttacagccccaaatgattaaatcttatatcttgtctttgcttaagcagaaaaaatgtttatttatgaagaggaaccataagtacaatttttcgaaccattagatttgcgcggcaaaagaaaggctttctttaagaagggaaacacgaatctttgatcacatctaacggttagaaaattgtattatatcttcaaaagtaacggaaaagcccgcgcaatcgtacggctatattatagagcgtagctgtattgtttatgtctcatgatcggtatgattataatcatggtctattgatcatatttctgatacgactatagttaacacatattattataatctaggcctgttaaaacaagaggcgcatcatcgttttttctcgagataggtattgcgtatttgataattagcagaaaaatagaaaaacaaatggcatatgtgacaattgttgagtaggagaaaggagtaatgcaacatttatgtgcattgacaaaaagggaaaacaatgatgttattccgattaccattaaagatccagattttattccacagacaacattcacatgtgacaaaatcacagaaaaagaaaagatcaacgtacatatttagtccttaccttcttttagagcttatataatactgtataaataagtataaagtgaggttgatttcagttcagttttgcaggaacgtacggaaaccacttcaaatagtcatttttttgtgcttaataagaataatgatgctttcatcatatatatgtgaatatgccacctctcaaatagtgctgaaaagattcagtacagtacttcccttcacaaaacacagttagctagctcattaaaacagtcatgatcctacttcctagaaatgaactgttagccgtgtacattcatttaggatgaagaggtggggttatataatccattatcaagaaaacaaatagagatttactccgatccagcaaaacagtatcttgctccacgtagacatgatgcctatataatctgaacacacaagtactgttctgaagaaactctgaacactcaaatattgattcaaaaattgtactgcagttctcatttaggaagtgaatagctacacttcaaaagaatttatccttttttacatctccaatcgacacccttaatttggatttcaatattccagtcaagttttgcagatt

SEQ ID NO: 24848 - DNA, 235 bp, Oryza sativa
accctcctgctacacgaagtaatccaagagggtcccgtaattatataaaagtagagactcaaagtttaggggtgagactctctttcactattcaatcatccgatcaactgtataatgagtagccccctcctctctttatatagtgcaatctaatatatggaaagtttggtgataggcccaataaatatatttaggccaggccttcatgggccaagcccaaagtttcttactcaga

SEQ ID NO: 24849 - DNA, 1501 bp, Oryza sativa
gccaaaaacgctcgctagatcgctagctagcgcgtctgcgctaattagcgtttccggtactcatcaatctactatagttcatttagcgtttcgaaaaaaaatgattcatttagcgtgccatgctttacctaaaagatattacatgtttttcagttgaaaacatgcatcttagaaggacatgaggatggtcatcggaatgggcagcagcgagctagaggaagattaggaaaaggaagagaagcaacatcatgagggatggagaaaaaatggactaaagaatgaaagagaaacatgaaggaaaagaactcaaactcccttatcaaaataatgaagaagtgtaaaaactaattgtgagaactccaattttgtacctgagggcaaacaaatgaggggagaggccgccactacctgttttctcctctattatcttttctacttctcttctcttctcttctctttagcgatggcacagaggggagaggcggcccgcaagcccggccaaggtcactacaagaaaacggagtgcctccgccaccaccgccgtctcgagcgcctcccaactggaggagggaaagtgtcacgaccgagaaaatttgcattttcccgaacgctagtgtattaatccctgtcccaagaaaagccggggtacaccacacaaacatgatataaaaaacacatctttattccatcgataatatttacattattacaaaggcgcttcaggcctgacaatcaaaaataaacagcagcagactagcgggcctacggctccatcttcacaggtgctcaactggggtataagccagggctctacctaggacttcttctccaaagcttctgttactaaaggggggagagatagagcaaaaatgattacaaccatagtactcagcaagccacaccgggagatgcatgattaatgcaatggggtacaaggggtaataatataagggttaagttttgcagtaaacaacatttaaaagtcacttagttgcccaaagctattttataaagacgatcctagagctacacagtattattaatcaaggccgtgaacccacacggacctgccttaatccaaggcctacgatgattcagaccgaactggcaacctgacctgggtcccagctcgtcccaagcaaacccaggccaaccattccacattttagttgttaagcaagttttaagaattaaaccactaacttgggtacattgctaggcttgcccataaccgagggcgtggctattcgaatagattatactctgatcagaggtgtacatctttacccacaagacacatctttactccgcattccacggccgtggaaccccgtcgtaaaggatgtgacataacccctttacccatcctagtcgtgacaaaagcactgacccaacctcgcctacggccggaatcccgagataggtaggtaagattgagcccctagcagcaggacaccggccctatgccatgacatctcgactaccgagccgcagcccgtgt

SEQ ID NO: 24850 - DNA, 1501 bp, Oryza sativa
taggcagactcttactgaaaatatctataaggaaactaccaaaatatcctaattaatatatacaattgccttcttcagactcaatccatacttggcaataattgtacaacacttcgaccgataccgacaatgattctatgattatcttgccgaaatcggctacatcggcttccccgtatccaattcggtgtcagccgatgcagacaatagccaatgcgcactctgtttccgtgaataacgatttcctcccaaatccgctttggttttgacttcaaatctaatttatgatttaccaaacttggtcgttaacaggagcccagcaagctcaagctcgctccacgcgcgccacatcaccgggggcacgacgacgggtgggtgtgggcggtcccgctgctggatgccaatgacagcaacgatggtcgagacgaacacctggaagctcgtggatggccgtgtcgccctgaggtggtcgtactcgtcgcacatgtaggcgagctcttgccagagttgaccgacactagcaggtcctcgtcgaggcccttgtcgacgaggaggtacctgatcgcggtgacggcaatggcagagacactggctttctctgcctgtcgtgccctcaactcgcggaagggacctcgtgcggcacgacgaggaaggcgagggcgtcgggaggcgcctcgtcggggcagtccaagtcgtcatccggaggcggcaggagtggcggcggatgcgctccctatgctgcagacgcataggccgcgatgccggttgtggcgccgtcgccacgcctctcccctcccccatctcccgccgggcgcctcctgtctcctactttctgtcacgtcctgataaattcatcccgaaataaaaatcattctctaaaaggaataatagaattaattaaaatttaaaaagaaattagcaaacattaaaatgcgtacaagaaaaattcgaatgtggcccgaagaatttttgttaaattctccttggtctaaaaggagccctcaaattttactttaatttttagaacaccggaaataaatattaagcaacaacaacaattatcagagtttttaaaaaaagaaaactaaaaataatcctccttcctcctttgggccgagtctagcccaaagtcttcccctctctctctctccctcagcccgcggctgaagtccctctctcctccctcccttttccctcctctcccgggcctcccctcccctcggcccagctccctcctctcctcctcccgcctgggcctgccccggcccaagccgagccgcagccctcccgcgcacgcgcgttgaccgcgcgccttccgcgtgggtcccgcccttcaggcgtccccgacctccagccgccggcctccttcctctctctcctgtgaaccctagcgccgttcctccctccaatccgctcgattcaaatggctaattacaaaattgattagggggaattaaaccccattgattcctctctctttccccctaattacccccttgaa

SEQ ID NO: 24851 - DNA, 1501 bp, Oryza sativa
ccggacgagacgcactgtctcacccgtgtcgtttgagaagcactcacttagttgtttttagaaaagagctcaaataaaatcaattgcaaaaacaacagcctttctttgaagcctgcattaaacacttacttcccttggcttactgagtactcccatactcacccttgctctatataaataatcccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagtttcggtcgggactagttcggggcgtgacatagtgcatgcaaccctaatcgatggcaataaacgaccgcaatagctaagccaatgagatttattttttggttatcccaaaaatcgaagggggttgaagggaggaggcgaagggggttgggcttagagggatggtaggggaggcggtagagccaaagccatagcatcggagaaggcagggagagggagggcaaggtcggcggttgtgacatgagatcaaaagtggttagaacttatgagtggaggtggatgtggaggtaaaggtggtcgcggcggcatgagccaccaaagatgaggaagaaggcgggggcacctcaccaccactttggcttcgggaatagtggggaaggaggaagagtgggtcatctagcgggcctcatcggccctggcgtagggcgaggcacatggaagaggcactgcaaggtagggaggtggcctcatgcgcgagctcaagatctagtggtcggagacgtgcgctgcgaccatggaaaaaggaaaagaagaatattaggttaatatactttagtcgtgatctatattgtcaaaaagctttaaatttgtaaatatttttaggtgtctgaaaactagataaccttttttctatagtttgttcatgccgttataatataggggcatcagaataatcagagtagtcgtcttagatttttcttggactaatgataggtatcacacagtaattttcctaaaagaatgataggtgtcacgcacttgataattagcagaaaataatgttatagagaacaacggttttcaacttttcatcgaggaaaggtgtaaatatacaatgcattgaagaaaaaaaatcctgatcgataagcatttaaaagccagcttgattcacaatatgggacatacgttactacaaaccatagaagatagttgtaagtttctatcccatatatataattaacctgtatcatcattagctgtattctgccaagttcataaaaac

SEQ ID NO: 24852 - DNA, 1501 bp, Oryza sativa
attggtaggcaccgggaactccttgagatctcaaacacagaaccttagccatctagctagtatgatagcagcaacgcagcacacagtttcctgcctcatgactgttttcagctccagcgtgtgatctccatggagcacctggaggaaaattggctgcagacctacaataaaagaccagttaaaatttaaaaagttcagagtacagataaacctttttagtcaatgtcatctccgtagtatttgcggcgaatatttgttttttcattatctaaaggagctgaaaatgcaactgcaagaaactattacatggccagcagcttctacagcactgtggccgacatgtatccgtggatccatagtaaactccattcatttcatcagaatctaatctctctacaagaaaaatgttcctcctcctaatagtagccaggcacaagaagacacagcctcaacaccctgataccataattcaactctggcagcacatgggctgtttgcagatacccgatctccagcacaggggtgcagcaatgtgtggagtagttaagcagttaaatgatcctacaaagaggacaatttatttatgttgtcaaagttagtacaagaagtagcaatataatgtgtggagcagttaaatgatcctacaaagaaaaaaaaattatgtacatgttgtcaacgtttgaaccaatcatataatatcccagctactttttctgttttttaggaacacataacagtaacagccccacttaacaactccattatgtattttttcataaataacgactccattatgtagtagtaccccaaaaacagtcaacaaatggtcccaacactaataccttcattaagaagcaagaggcataggaattacggtgtgacaaatgtttaccactgttacctaacaaggaccaggctggtgttcacagaacccaaagcagagcttgaacaaagagcaataggttaaaccagaagcattcagtgagaattcgaaaaaactgcaagcagagggatgcagccaagcatgccctaccatctgaaagtccatgcactgctcacacagagtcaaagaaaggatgattaagatcccagaatagaattttactccataaaactttacctatacaagctaaccactccaaagcagaggtttgcttagtgcacattacctctactgtaccagtctacagaagctggatgcatgacagacaaccatgcagtcctgcaatgcaaaacgcattatcacaatccatctgctcccaacaactcagaagattcttcattcttgttctcctccccctctcctaacccctgcttcagcaaggagatgctcaccttctccacttcatcctcatcacagccacattgcattcgcaaccactccaccatctctcgccgatggagcaggcacgcgttggctcagccatgatcttcctactcctcgctttcctgtcagaggtttctgcatccatatcgcagcagcagcagcagcaatgcggtg

SEQ ID NO: 24853 - DNA, 1501 bp, Oryza sativa
acatgcaaaaagatcacacgtcaatatattagaaaaaaaaaggtttagttacacaaagcaacatgacagaaccgaccactgctgggttacaaggaaaatgaatgcgggggtgaagaaaaaaaaatgtaaaattgaagctgaagctactgctcctatataaaggtagagaggtggtgaaggaaccccctatatatccggagatttttttttgttggaatacacaataaaacatcactggtatgtttgtgttaactataaattgtgatacagttgctctcaaatagatatgttgctaggtacaatcaaactattctagtgttaattatcaatttttttaacatatgcctggacaagaatatttcttcatgtaacattatgccattctgttatatatacaataaatctgtactcccaacacgcaaaagattcgagtgtcaaccattttcatccaaaattatgtcacgtgaggcctggtgccaattttttatatgacctggatatttatgcaaatatatttctggtcctaccaatattgagactacccagtagctggaagtgttaattatacttggaaataaacgcattgcataaaaacagctagtattaccactaacctttccatctccaaaatcagtttaacatcgcctaatccacgtcggtttaccgccatatccgtttaacagttccctccgaccttttagtacagtttagaacaatcaataacgatgcgatatgtaccaagtactaccatccatccacaatatcgttactgaacaacgtaaaagccgtactacacgatcaatacgaaagtgaacctgtccttatattttctagtagtatttttttttcttccaaaaaaaagctgcctttcaaaagcccagcacccggtgtttccccctcaaaactaggttattactcttactccctctatttcaggttatacgatgttttaactttggttaaaatcaaagttttttttaaattttttttaatccgagataaatttattgtaaaaatatatttaattattaatttaataaattgattttgtgatgtaaatattactatatttgactataaacttaattaaagttaaagcagtttgactttgatcaaatttaaaaacatcttataaactgaaacgaatggaatatttactatttgcattattcggcaggagaccaggagaaagacaataacaaaaccgactagataaaaacacgatataaaaaaaagaacagtattccattctgggtcactgacatcgtgggcccacactctgactctctccgcatcggttatactacgcgcccaacctcctatataaaagagtctccgcttagctatctctttaacacaaagccattacccaaacccgcgctccgctcgctctccaccgctcgccgcgcacgcctcaccggagaccagcccgacggcggcggcggcggcgtcggcggcagcagcgggagcttggactgagatgaggacgaggagtggatct

SEQ ID NO: 24854 - DNA, 1501 bp, Oryza sativa
tgcaggcttcaaagaaaggctgttgtttttgcaattgattttatttgagctcttttctaaaaacaactaagtgagtgcttctcaaacgacacgggtgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgtagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatattgtgccaggaagcccaggggtcctccccgacaccaccccggcgaatccacatgtctctcggcatcaaggctcccctgataagttagttactcagccaggggtgtcccattccacccatgtggtcgtacttgtcttatgtttggatgaaattacaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactgaacaaacggcgaaaataaagccctattaatgacctctaagcgtgccattagatagatctcgagatttgagaaattttggaatttgaacggagtcaaacggatttacggttgggaagatattgaatttctaagattattggatttttggtctaaaggttggaaaagaaaagaaaagaaaaagggagagggagggaatatagacttccctcgggcggctagggcgcggcccgatagaaagggcagctagggcgcggcccgagaga

SEQ ID NO: 24855 - DNA, 1180 bp, Oryza sativa
aaacttattcctattgatgatcgtcactgaaagatgtacgtacacgagaccgagcgcttgctcgggtgacaaagcgtcgctggtgggcacgctgggttcgacccttgtgctcgcccgggggatttttcccctctttccccggactgacttcggttggtcccggctagataataaggtatacatgtgcacgttttccgtgcattgaggtctagtgcctccaatcttattcctaacgtgtgttaggaacgcgtacgcatgtgtgtgcgtgtgtcgtggtgtgagtgcggtgtgtgtaagtgtgcgtacgcataataaattatgggattaattatgttggcttattaaacagatgcaaatgcatgcgcgagttttctattttctatagaaactcttcattaattgtagtacacgtacgtactccctccgtcataaaagagcgaatgagtttagacagaggtatgccacatttagtattagatgagttttttttaataggtggagggagtatataaaggcactgctacgttttaataaaataacatcattgacttttaattaacacaatggttgactattcatcatattcaaataatttatataaatattatttattttattgtgatgtattttatcattacataaactttaaatatgatttatactatagcacatttatactaatattttaataagacaaatgatcaaactcttttttttaagttaaggatgtcatttatcaaaaaattgaagtataatgtcatcgcgtagtgacgcaactttcgtcttcttgtggcaggaaaaagggttaattagatccatgtcactgtaactttgctaaattaaaaaaataccattactatttatcatatctgctacgtgtcattaaaaatttctaaaatttaaaccataccactccagtcaccttttccatcctcttgcctcacgccgtctctattccgtcctcatcccctaatctccatgactatgcgctgctcagccgcctccgcagccccaccaggcgcgacttcaccgctaccgccggcaacgcgcggctccgacgcctccacggccacgcgagcctagtccgcgagcctagtgccggacccacgcgtccgcgcctgccgccctccccctcgcttccgcgcgcgcatctgacgactcctccgcgaaccccgccagg

SEQ ID NO: 24856 - DNA, 362 bp, Oryza sativa
tgtgtgtgtgtgtgtgtgtgtgtgtgtgtgtgtgtgtgtgtgtgtgtgtgtgtgtgtgtctgagatatgtatccaagccatgtaatctatatatattagccctccgaagcacgatacaatgtgtccaatatcttcaatacatctatctcttcttataatattcaacatggcatcagagtaggcgacctatgccagccactgcttaggcttccgccgtcatcgcccttgggatggttctgatctctcggaggcaaccacccgtttatgtttttctttgttgccgtcatgccttacctaggggattgatcgtgatctcctaggcatgccttgttcttcgtcatgttgtccacacaacagcaaca

SEQ ID NO: 24857 - DNA, 1501 bp, Oryza sativa
ggggcgagttctgtgagccacctttttcttcaagacctatccgttcatttggccatgaacttcatcctagctttttagccatggttcgtgaacaataacttctaaagacatgaaagcgaaatacctaccatcatctacatgagtttgagcaattgttctcgtgcctaaaaatagtggacatgacataagaaatcttaaagtggaaattgtttttcttctctattatagagaggatgaagcaatggtacgtccatactgtgagaaaactgcatggtgaatgggaggaattaaaagctagctctgccttgttttcttcccattaaccactgtagtctcttaatgtaagaaggttctcagctttcaaaagaataagaaggaatccattggtgcagtctgggctcgtttctccatgttaattcaagatggccctaacttgtctctacccgatcacgggttcttgtaacatttccacttgggcttagacaaggagtttgtcatgtatctcaatatttttgccggaggtttgtttgcacacaaaatgacgttagaagatagggaactcttggattgtatcatggagaacacctccttcgtttgttgtgaaactgtcctggaaatcgaggatacgcatgaggaacctccgatggccaaatcggagaatacaacctctacatcccatgattcgaccgttgaatcatcacccgaaccacgggaaccgaaggtagaaattcagccttcggaatttccattccagtttgagggtgatctttttgaagattatggaagcccctcaaactattcatgccaaaagagtgcaccggtcctgcgtagttctcccatgccactcaaggagattctgttcaaagagatgcaacaggaattaactaccatcatgagggatgagtggttaagggaggtggagctttcttctgaagtaattcggattaacaccccatccttaactattacatgtctcatgagagaggccatggtgcaaactctttataatccaactattggcgcaaacattatgtctacaatctttgcattaaattgcttaggggatgaaccattggcaccaatagaaaaaacactttcagatcctatctggtcctatcatcgaaggttatgggattctttgtagatgccaatccggcacaatgatgtcgaggctatcttggacttccatgttttagaagtctttgacttcgatcttctcatgggccatcccatagagaaacttcgcattgatgtgccgcatacaagagtcctcaacatcaaacttgggaaaatggtgttttccatcccgatgttacgattgaaaatttgttggacgtaacccattgccaattccgagtcaactgaggaattgttggccatctctcctttcgagtccaatgaatccctcgtcgaagatgatgacaatccatttattgaagaggatcggaggacaatcctggagagctgatcgagttacccaaagctgatccatcctcacgac

SEQ ID NO: 24858 - DNA, 1501 bp, Oryza sativa
attctagacccacaattgcatcatcacaccatcgatgcttccgcacatatagaaaaattttgacaaccgatttacttaaaaaaaacatccgaatgattcttaagacaaagaacccatgattttctaacctttagatcttgctcaaagatttatgcatcacctcgtcaatctatctctaacaaacttcgataagctcttgggtttctccagtgacgacatatgacagatttagaatataaggtatgatatagattggaggggaggttgggatggagagagggattagggagggaagaggaaaggggtgaagattacgagtatagagggaggctcatggatggtgtggtgccgtggatcaggagaggagtgtggttagcggtggaggaaacaaggagagagttatcgagaggcggcggtcggcagtgaaggcgaggggataggagcaatgtaaacctaggtggaggcgatgggaagactaagtgcaatgtgaatcgggtggcggcgacgatgatagcacgtggttatttttctcctagctattagtggtatggggaataatgtaaatggctagattttgatccaatggttgaaaaaaaatgtttcagagaaaaaaattcaaagggtggttagatcatcccttttggaatgtttccttgtgattgaattaaactaacatgtaattttatatagaattttttccttaaaataaagctaatctatagatttctcatgagtggcctagaaaacagttgggcaaatttaaacccatcctaatgcagtttgttttgatgctagttttttaataatagccacaactattacaggggttgcagccttgcatgataaaatactataaactaaaaaaaccataatatgattaaaaataagacaactatgtaaaacaccaatccagagacatagaaaaactaacttccgtctatgttggcaatggcaaggaattgcataacttttattttttgagcggctttacaagttgtttgatgccactgtttgtcagatcaattactattgagacccatttttgttacttccagtttcagtagtgcacacggtatatttggattgagacccatttttgtccaagtcaaaacaattgagtttacacccgtaacaagaagctcacttgtgcattttcgcttgcaaacaaaacatttcaaaaactgccatatttcggaggaaaagaaaaatcctcgtcatcatcactgagacttcatcagtcacatatatggtggtgttagaatattctgaagataaagatgaagatgaagataaaaattaagtatttcacaccaaatgagatggtaataacttgtgattaattgagttttaattattacaaacttgaaaaatgtattaaccttatattttataacaactttcatgtaaaaagttttcacacgaaacacaccatttagcagcttaaaaaatatgccacatgtatccaaacaacttttattggagaaaaagaacaagacctata

SEQ ID NO: 24859 - DNA, 305 bp, Oryza sativa
gcattccctctaccgtgggaagcaactggacgccaatttgattgccttctggtgtctgtaagtgctacacttgaacgtgttaatagatcactacacctatatgcgtagctcatttgatcatccattgttggtaggatgaattacgcggaagccgaagcgatgaaaaagcctgtcgcctacctaaacccgtgcaggataagtaagccacacatacacgctagacgagaagaagctaccggaacacatcaaggcgatgactccctaagagaggaaagcttacatagcacaaaagcatcttgaaaaga

SEQ ID NO: 24860 - DNA, 681 bp, Oryza sativa
catacatggctatttttgtcttagcatataagattatttgagttttaatataagattattatatttctaattagacttagtatataataattgactagctagggtcctacaatatacatcacctagacttagcatatatcatcactatttgagttttagtataagattattagatttgtaattagacttagcatgtaagattgtgtagggttctaatatatgacagttacacttagcatacatggctatttttgtcttagtatataagattatttgagttttaatataagattattatatttctaattagacttagtatataataattgactagctagggtcctataacatacatcagctagacttagcatatatcatcgctatttgagttttagtataagattattagatttgtaattagacttagcatgtaagattgtgtagggttctaatatacgacagttacacttagcatacatggctatttttgtcttagcatataagattatttgagttttaatataagattattatatttctaattagacttagtatataataattgactagctagggtcctacaatatacatcacctagacttagcatatattatcactatttgagttttagtatacgattattagatttgtaattagacttagcatgtaagattgtgtagg

SEQ ID NO: 24861 - DNA, 1501 bp, Oryza sativa
cttgctgacatcgtcctcctgtgcttgcgattggaagccaagctggcatagtatctccttgaggacgtccctcgcactcttccctgctgcggaaacccaggcctgtggttcgaattgtgtgcaaatggtggtgttctcatagatttgcttggcgaggagggtcttccctaacccgccaaacccgacaagggagatgaccttgagctgattgggctggctttgtgtttccatgatcagctcaagaatctcatcccttggcccgtccattcccacagggacggtgtcagctgtggggatatgtgtcgtctcaaatgacgacatggtcccggaggtgcttgcttggcaatcaccattgccgttgccagcggttgtgtagtttgctctcagcttagacagatcctccgatttcttccggagcttctggatcacggtggcaaacttggtgcggacggccattgtggcgagcctatggccacttgtcatacggtgcatgaagcggtcgatgcagtcctccatgtcgtaggccagctcgcgcgcgccatggatccaagccccctgcagagggccaccgtggttcatctgcccgcgttcgtgctcatcgatcaccgcgccgatcatccggagctcgttccggatgtaccgtatgtcgtgttccaggttccgccgcagctcatggttctcttgcaagaaggtgtagagcttcggccctagcatgttcagaagagtgctcagcacagcagtctccatccccgaaacttcacacttctgcctagcttgcacttgattgatggatattgctaattcttctcatgcttgattcttctctcgccgcttctgattaatttctctccttgcggaaattggtggatatgagaaagagagcacagaaaaatatagctggcatggagccatggagtagaagatatcagggttagttcgggtgatagatgaactgtggagagcagctatggttatttttaagaaaaataataagagaaagaaccatagatccctctcttgggctagcaaggggatatatattattagcgttgacttcgtatttcgtacttcaatttttcagctggaataattactcgttgttagctaggcttgttatcagtgggtcggtagtagtttcagaccaactgtacctttttaagtgagtaatactaaataaatcatttattataatccttttttgcaatctgccccattgaaaattacttgtggttatgcagctagctagttatcggtgggccgctagtagtttcaaagcaatttgcaattactttttagtgtggaactgtggatatctcgatgaattgaatcacttttttatccctttttgcaatctgctcccatcaaaatcttgatccaccgtacccctaatgctataaatattctgtagtgagagcaaacgtgcttgcttatcaatattattattcctattaactctttttatgggctgtttacgttaacttagcaatataacggcttccca

SEQ ID NO: 24862 - DNA, 572 bp, Oryza sativa
gtactgtagtttctattaattgctctgtctgaattgaattatgcagtgggtgaacaaatctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactgttgcttttacatattgttaccaactatggttggtaagtaatgatattatctttagcaaccgaggagatcacatgttggttacaaaatacatttagcaaccgggttgtagccaccaagatgcgaccaaggttcattggtagcgaaaactcaatagcaaccagcttatagcttattgtcaccaaccaccttggtaactaatggtctgtttccttgtagtgcttggaagatgttggtggtaagtactacacttttttaatcattttaaatcatagagttttctgatttgtcaatgtcgaaagaaccttt

SEQ ID NO: 24863 - DNA, 1501 bp, Oryza sativa
tcctccaggtcgtaggacagcatgcgcacatcgtgagcccagagcctgacctgctcgtcaagctgatgatcccgtggaatgttggccaccaagcgtagggtggtatccatggtcttgagacccctagagaactgcctgacccggttccttacgccctcctgcagctggttctcctccaaactgagcagctcggccagcctagagagcaggctgcccatcgccgcggttgctagctccatgctcgatcgatccccttcttgacacacacggcagttggttgagatgattaattggttacttggatgagtgatcgcttagctcctctcgccgttctatcgccaatatttctccaatatctacagaattacaaatgaaaggcatttaaggaagtgaaattcataaagagaggtagctatgtggaattggggaaaaaaatggatgaacactactcaccaagctaacagcaaaccaccatatgcaatttcatcgatccttaatttacttttgcttgtgaatagaatcagaaggttctatcttcttcagctgaaatagtaaagatatagaagctcacagttttgttgtaggtcagacagacgaagctaactgatggatgcgtgaaaggatgatttagctatattgtataaacacacgcatgctgattacaccaatctcgatctgtactgtattattataatttttttcaattggtgtactgtattgtaagttgtaacgccttgagaaattgcatgcaacaatacctccttgtttagtgattaacccttacaaattttgcatatagggactccaatttcacaaggataacagcaaaaataataaatgcataattagtcctcagtgcattatattaaatatgtgcaaaaaagcatccatgttgtctataccaattttttatggaaatctataatgcctattatctggtgagtcaagattatataactgtgcagattgcttgaatgtataatgaactaataaaactatataacgattgcatacccaattctatgatatagtcttagtcttttataaatagaaagaagagttggcacacacaattctaataatctaataataaactataacctatctttgtgcagttatgcggaaaattaatttatctacctatctgaatgcgtatgtaatatcattatattttctagtttaccaaatataagccattagggtatgcctctaaatttaaggagtaaatcatggaagactttctagtattccatttgtaatttaatttttcagcttactttttgatggatgtagtttcagcttattgcgtcttttcaataaaccatgtatatatatttacaaaatgggaagccgttatattgctaagttaacgtaaacagcccataaaaagagttaataggaataataatattgataagcaagcacgtttgctctcactacagaatatttatagcattaggggtacggtggatcaagattttgatgggagcagattgcaaaa

SEQ ID NO: 24864 - DNA, 1501 bp, Oryza sativa
ccagcatatattcattcaggcgatcgatctccatatccatcatcagcctgatcgcatgatggaatctatacttctttccattatttgatggctgcatcgatggccagcacagcacagcactggttcgaggcgccgcaaaggaaaagtagatcagactagcatggcccaacaataattcgttcacaataaagtgggcagtggagctaacatatatacctggtctcatatatactccctccgtttcgaaatgtgtttgacgccattgactttttaagcatatgtttgactattcgtcttattcagtaattattaatttttttcctatcatttgattcattattaaatatatttttatgtagacatataattttacatatttcataaaagtttttgaataagacgaacggtcaaacatgtggtaaaagtcaacggtgtcaaatatttcgaaacggagggagggagtatatggcaacataggaaaggacactaaccaatatatcatcgtcaccatgaacaccaagtacatccaatggtccccaatgatcaaaatgcatgcttagtttgaagaattagttggttaatggattactcgattcactgtatgacgggaacacacctgttgttttctgattaagatttagattttatctcggtttaatttctattagcacgctttttaaaactactatacggtacgttccgtgcgaaatctttctatatagaagttgctttgaaatatcaaatatatctatttatcaagtttgtaataattaaaacttaattaatcatatgttaatgactttctcgttttacgtgcgccaacttaatcttcatcctcatcacaccatctctaataatcaaataaaaataattattattatagacagctcaaatgtccgcaacacatctaaaaagttattttccaccaacttaacatatatatctagctcagctggtaaggttacttatggtgtaacttgtccacccgattaaaagttctagggttggcatgtgtgctcgtacttacaacaagtttatgtactctaaaacttggtatatgcactcgtatttagggttagttattcttgatatttaattctggcattaatataatatacgtttatcgcaatttttgttttataaacttgttgattttgattttgatttgtctaaaaaaagttttttttgtcacttttgtccgtcctcttttcattattgctaggaagatgactaaaaatcacttaaaaagtgttcttaaaatcacgttattatttttaaaaaataaaacattgtatcaaaggaagcactagtgttgtgttagtggagtcgtgggtgtatttatgtacgtctaaggatttaaatcttggtgctgatacgtacatggatgtgttatccatatataggaattactgcgacagaacgattatcatgaaattttttaaaaaaaactatcgtaaaattcatccttggctgattttggtgacgacttaaggtctttgtg

SEQ ID NO: 24865 - DNA, 1501 bp, Oryza sativa
atatcgtgagttcatgaccctttaaactaatctcggcaccaggtaagtaaattagacaaccaaacagcacggattgcatacattgggcacggccaaaattgtttagaagctacacgtaccagcctgcctctgctgaaggtgaaatctccaactccgtgacccttgaagaaattctccacctcctgcagcaccggcggcttgtccagatccacctcgtgcgtgcaacccgaacacctgcagagatcgcgcatcagaaaaaaaaaatcaaaaaaatcacttcgccgtctctcacacacgcgcacacgcattcgaggagagagagccgtacgagttgaagtggacgcattcgaggcacgtggaggtggagggggacaaggtgggggtgatgatgggaggcagcgtcgcggtggccgtggttgtgctcggcgcgacgacgacgacgggctcgagccgaggcggtggcggcgggggaggagcgggagggggtggagggcgaacgcgagtgcgaggaggagggcgcgtccgggtcggggcggccaggcgcgcggcggacggcgccggccaggggagcagccccgccggtggaggcattcgccggcggcgaggaaggaggtggatgaggaggcgggaagagggaaatgaaggggataaggcggtgaggaggagagagatttttttcccgctttttgtcggaatataggtcttgttctttttctccaataaaagttgtttggatacatgtggcatattttttaagctgctaaatggtgtgtttcgtgtgaaaactttttacatgaaagttgttataaaatataaggttaatacatttttcaagtttgtaataattaaaactcaattaatcacaagttattaccatctcatttggtgtgaaatacttaatttttatcttcatcttcatctttatcttcagaatattctaacaccaccatatatgtgactgatgaagtctcagtgatgatgacgaggatttttcttttcctccgaaatatggcagtttttgaaatgttttgtttgcaagcgaaaatgcacaagtgagcttcttgttacgggtgtaaactcaattgttttgacttggacaaaaatgggtctcaatccaaatataccgtgtgcactactgaaactggaagtaacaaaaatgggtctcaatagtaattgatctgacaaacagtggcatcaaacaacttgtaaagccgctcaaaaaataaaagttatgcaattccttgccattgccaacatagacggaagttagtttttctatgtctctggattggtgttttacatagttgtcttatttttaatcatattatggtttttttagtttatagtattttatcatgcaaggctgcaacccctgtaatagttgtggctattattaaaaaactagcatcaaaacaaactgcattaggatgggtttaaatttgcccaactgttttctaggccactcatgagaaatctatagattagctttattttaaggaaa

SEQ ID NO: 24866 - DNA, 1501 bp, Oryza sativa
aatataaatataaccatctcatttattaaaaaatataaaaaatatgcttaagacttttaaatggaaggagcagaccatatcattaattttaggcaaaattggttatatagcatcgaaagttcacgtttttggttttatagcaccgaaagataccggttcactttaatagcaaccaaagtttaccctgttcccatttttagcacttccgtcaatttttccgtccgtcttgatcgttattgacctagctacgcacacgatatgacgtttctacccctcattaacatgcattctacttgtacttgtgaggggtagaaacattatattgtgtgtgtggctggatcaagacggacggaaaacgattgagaattgacggaagtgctaaaaatgggaacagggtgaactttgggtgctattaaagtgaaccggtatctttcggtgctataaaataaaaaacgtgaactttcgatgctatataaccaatttttccttaattttacgctcctctcaaaattttgtcaaatagcaacgtccaaaaaatgccattgctgttgtaggaaatattcccttatttgatatggtaattttatcttaaactatttttcctatattttttttatgttttgaactaatcagcatcaaatattaagggataaatgtagtgttataagagttcgtgggtataaaatggagatcttatatgagccatgaaattgactctagctaggtgaatggaaatgtcacattgcttggtcacatgactcggtcacttgaaaggtgactccatgaccaaacggaggaaggttcgaaatataagatgagaaacaatctttagaggaagagttagtaggagtacgtgattattttgtactccgtcgttgacatgcatatatattgttgcgttgctatcaagcgagaaaactgacaggtcagctcaccatggccgtaatatttggaacggcaacgaattgtttccctttcaagaacaacttgaactaattttgaattgtcacttacgtgtgtgagaaatttcgtcatcgtatcacatgaattccctctaaaatactactgctttctgaaggttggcttcaagcgagtgagagagacccctgctttattcttacatatacttgccaaatccttttgcattcttccacagagaaagggtggaagagatgcgcgaggacttggggcttgtttgacattttgattgtgacactagtaaattctgctgctaaggcccttgtttgtgataactgaaatcgatggattatttgatttttatggtaaccatttgaggatatatacagatgaataaattaactgctatagagttgaaaaagttgctttaaaaagtatcccatgaaaaatttgcatactctagtattttatatgaaacgtatcgtttagtagctttagaagcgtgcaaatgaaaatctagaatccagaatcagaaaagaacatggccgaattcatgcacttgcacctggagcatcaaagctag

SEQ ID NO: 24867 - DNA, 1501 bp, Oryza sativa
aagatatacacattcacaatattgcatacgcatgtcatatattggcccccacaactagcttatcaaggccatcgttgcaacaaaaaataaatgtccaagggacacgttgactccttttcagttgagctcatccaaacaagatcaatgtgctactatgacatcaagcacaaatgataaaagtgaactacagaaaagagttgacaaaggaaaagggttgtaaaacccaggatctgtaatgtcatagtttaaggggtcactttcagcaatcaataccaaaggtagcaaaacattcgagtacaccagaataatgattggcaaatcatgaggtttggacttactcatgtcatttcccctctccttggaactgtttacacattctgaaacctcagcgttttttttcctgattgggtaaatgtttcctctgaagtctcagcatgaatctggagtactgtttgaacagtcaaatggtcctgagttcgcatgaatccaacattcatttcaagtgattctgcttcagtttctgagcatgaatcctctgctttcttcaaaaacatagttcagtctgaagtgaatggtcaagtaaccaaatactgataaaaagcaggaagccaatccataaaaaaaaatcaagaaagacatgtacaatacctgaaaagacagggaagaccgacatggaagaaatcgatatgtgtttctggcaaaaactagagaactgataaataaacctggttaagttctactcctaagctactaggaactgcaactgcaattcgagatgcaacacagaattaccggattgaagccaatgccaaagatttcataccacccagaattaacgaagaacctatcatgtatccatgtctcacatccagaaatcaagagtttgaaattctttctgttaactgtttccgaactaggcataaaagaaagaagagtttgcagaggcttcacgaaagcgagaagcaaaaccccaacagtcaggtaaaaaactacacaagattcatcatcaacagcataagcatggatgcactgaaacaattctgactgacagtctgaatctctctctgtctataactacgataagccaatggttgatcttgcttctcggaaaatccatctcctccttcttggagcaactcagaatccccccttctgcagcagttcaggaatcagaatcgaattcaccaactcgaaatctcccagaaccagtggcgaaagagatgaaagatttggacttttgtgcgtacctcgttcaccttgtagcgatcgcggctcacctcccagagcgagttcccagggcaaatcgactgcggagaagagaaagcagggaagtgatcagcaatcgaaagaagaagtaagaagaaggagagaattcgtgggtggcggatgaagaaatcgtgctccatctatggctgcacacgcacgtcgacttgtcgctggacgctcctgggccgcttcgccggcttgcgcggcgccttccggccggtgatcgcgaagaagt

SEQ ID NO: 24868 - DNA, 202 bp, Oryza sativa
ccgcccctacggtgagacgacgagcgtcgacgatcgcgcgtggcggcgtccccacccgccggtaacgctaccaccgggagcaccgtcggcggcaagcggtgcgcgggagttggcggcggcggcggcggctgcccccacggctcgaggtggtgcgtcgacgtcgccgcgggcggcttcgcccgcggatctgccgtcgccgcca

SEQ ID NO: 24869 - DNA, 1501 bp, Oryza sativa
taatggatgggagagaaagtagtaacagaaatgacttcagaaaaagtttgttgtcctaacctaaaggtgtgttcagtttctgaaaaaagttgaaagtttgaagaaagttggaagtttgaaaaaaagttgcaaatttatatgtgtagaaaaagtttttaatgtgatatgatgtgatggaaagttgggaataggagatctaaacacggactaaaaatcaaatccagatagaactttatgtgttttcatggtgctcaacgatttggtaccattggtgagaaaaaaaattatagctttgtcgtcaccggattaaatcgtaaattacaccctctctattttcaaacaattgataatgctgacttgttgtttagttttcaataatatttttttaaatggaccaataggaatataagattataggttcaataaatcgataaacgttaacaatatggtatcttttcaggtattcattcttatttgaaaaaaaatatgagcggtgaaagtttatagataaacaattttcgttaccgctaataaaaaacatggccatgttgaaacttagtactttgaaatgtatagtagttctgtatgacttgaataccaccattgagaaaaaacaataaattgcacaaaacaagttgaaaattccagtggtgaaattggagagtagctagtatacatagacccgaaagtgaagtttataggttttctttctcattataccctgtttaaatggaactaaaactttttaagtccctatcacatcggatgtttggatattaattataaatattaaacgtggactattaataaaaccaatccataatcttggactaatttgcgagatgaatctattaagcctaattaatccatgattagcttatgtgatgctacagtaaacattctctaattgtggattaattaggcttaaaaaatgtgtctcgtaaattagcttttatttatgtaattagttttgtaaatagtctatatttaatactctaaattaatgtctaaatacatagactaaagttaagtccctgatccaaacaccacctaattaatctgctagtcccctctctctcctactcctactaagcaatcggtgacaaggcaaagaatttgacacttgaagtgttggtacgtgtgatagctacggagtacaatgcccaacccccctatgtggctttcatcttggaaaacttggcagagacacgtgtgatttttacgttctgtctagagagctagagattctaacaaataggtagtgagtaaccaattgatgagaataaaaaaactaggtttttagtttctaactattaattcgtttcctaaaatctatagcttataattatttgaacttaggtaaaagaagtatgaatgtttgagttgagctggagattccgaggcaatctacagctgctacaaacttttctaaacaaacaatgtttctctcgttctccacgtacacgctttctaaactgttaaacaatgtttttttaaaaaa

SEQ ID NO: 24870 - DNA, 1501 bp, Oryza sativa
tttgggcaggatttcttatgtatttaccaaatttggcaaaaaattaaacgtagacatttttttgataaatttaccaaaaaatggtatggttgaaaatggcatcaaagtgagcaggccctaacatgggaaaatttatagcacatggttaaatttatacttgttggcatatcacatgttggtctactctataaatttttcaataactagtataatgtccgtgcgttgcaatgactttttttaattgtttaatattttatcattatgctaattttgctatcattttataaagatgaaaatttcataatattctattgtcatattttcatgtcgacatgatctatagcatgtggaggctaagagacaagcaacttacaattcatgggtctcgcatggtagttgcctggtggtggtgaccaccactgccatcttttatattagtatagacaattaagatgagaaaaaaaataattgaagagacgttctctcttgcaggacaaatgtctttcctttcacagataagtattgaatacgcactatagaccgtgtaaaatatccgcgaaaaacatgactgttctctagcagtggtattctcttttgatttaacgataaaattatctatatttatattactttaaaagatagtagttggtacttgtgtaacacatgtcggtacttgtgtatatgtcactaaaaattaactatggtatttatttctttttgttttttatgatgaataatcttgtttcaaccaagtagaatccattttttttaacaaggacttcaattatttgctattttgaataatctgttgcaacagttatttgacaagtaagttgtaactcacgcaaacctaacatgttaacactgcatactacagttgacttatgtatcaaatcgtcgcatttgtcttgatcctaaatttgtccaccaatatttccaaaaagttccaagaaatataattaaagtgaaagctcctaccaaattttgatatagcaaacaagattcctgctctaaatgttaaactcgaaattaggtaaggaaaaaaaaaacaagactagaagtattatttccaaagaactcttatgttcaccctgtttgactctcaaaaagcacaacgtagcataccacccaacccagcaacacatactagagtcagccagccactcagcccaactacagcaactgcatgtgggccctacctccctccaacccgtatggaccccacctgtcagcgacggaaagtctcactttagcatcgttagcttccacgacaagcataaccccacgcccaatcagagcgcgcctctcgaaatcgcatagctatttgcgcgaaaaagcaatttcttattaaagagagggaaaaaaaaaggaaaaatctaaaccccccctctagcctagtcccaccactaggactcaacgagaaggggggcaggtgtccgaagcggatcacggcggcgggagagagatccggtggcccgatccatggctgcggcggcggtgg

SEQ ID NO: 24871 - DNA, 1501 bp, Oryza sativa
ctccactgcccactttattgtgaacgaattattgttgggccatgctagtctgatctacttttcctttgcggcgcctcgaaccagtgctgtgctgtgctggccatcgatgcagccatcaaataatggaaagaagtatagattccatcatgcgatcaggctgatgatggatatggagatcgatcgcctgaatgaatatatgctggatcactagctagctatctagctgcatgctttaatttgacgatttgtgcatgtccaccctgtatatcatatgcatacaattagtttaatttttttcagatgtgtaaaacatatggactataataagccacgtttgagtgccacttacctactgcacaatcaagtttcagaaatcagattaatttgtactagatgactgaaaagtcactactattctgcaagtgtatgcaataatgtcagaaatctgctggcatattcctgcagggagatcatcagttgttcatcatgttttcttttccactgatgtgcatgaccgtcaattattcatcaagttttcttttccactgatctatatgatgtttcaccaaaaccatactgtttgaagcatcacattttcttctccatatatatgatgtttctccaaagccatactgtttgaagaattatgtgtttactccttattatgagttggctttattatttatgttattcttattgcttaaatgcttgctatttttgagagaatattataataattagatgtagcttcattgaagcaaaggccgaatttaattccattataaaaagaaaactgtttgaagcattgtcgtcacacatatactgttaatttgctcccgtgcatctttaccagttcatagtagcatcgttgccgggttaataagtaaccaacggtagtttttgcaaaatgctaagagacaattcaatatctttttttctatattgctcgttttgcatggcaatgtatttcctttgtttctaatatcctctccccaaaagtccaaaatgctaaaaatatttttggtaattaacttgggttctacctatatctttggaaaaaaaaactggttttacttagtgttagtatactatgttggtcaatttagtgttaccggaatgataaaatatttgattaaaaaaatgtctaacatcatgtacgctatttcttctcgtgttccaattagcttcaatatcagtttatcactactaaaaaattgatttttcatggcgtttggaaaatatttttcatagcagccacgtggaaaaaccgccagcgcagaaaatcgtgggggtgggggtcaagggccgccagcggaaacacatcttcgctagcggtctatttaagaaggccgccagcgaagataggatggaagagatgttgcgtcatgctgaacctgaggatgttgctgggtccgctcgtgggttggataactttgatgcattgaaaaaggcagcgaatgatcttttgtacgatgaggcaaagggctgtgagaaggatttc

SEQ ID NO: 24872 - DNA, 515 bp, Oryza sativa
acattgtataagatataaaacttcgtttcttcatttttcgtttgtcctaagtcaaacttttttcatctaaccaagattttaaagaaaacatgctaacacctacaacaccaaattaatatcattaaatctatccttaaatatatttctatagtatatttatttcgtgttgaaaatgttgctatattttttataaagttagtcaaacttgaagaggtttgaattagtacaatgcacttggtgtagtatgacagttctaatatatttgatacatattatccaccaatgttttgttttggggaggggacgtattgcttcggttactatagagcatgtgaaacattgaaagtcttgatttctctttcacaaattttgtaagtcatttcgttatattttacatagatcatagcaaattgaatgaaaattttgcgcattcaatgatgtggatatttaaatttctacatagtaaatgttagtcaattttaaatatattttttgcatattttccaatttgcagg

SEQ ID NO: 24873 - DNA, 1501 bp, Oryza sativa
atcaactgatcatgtactaatagtgaacactttatgatgtagtaactttttttaaaaaaaaacgatatgatatggagtaagtaactttcctttgttgattcctcgccgttgcttgaattctggttttctgctcagctttggtacagtatcattatcatcgtaccatctctgcatctcaccagcaagcttgtcggaatgtttgctgcttcactatagagttttaaggaaccaatgtccagagctcacgtgttataggtgcagtaaagtcggatgaaatcatgaatatctgtttcggtctagacacttttcttttaagaatggtcaccgggggcgaaatgcccacctgaatatgttacttcaaacaatcttacacagggcaggcttagcttatgcaagcgtaggtggccctggaggataatatggaagaatacacgggatatacaaagaagagaatacaaacgtatcacaacctcccccacctaacacaaagaggcacaatagatagaagacagaagctttgacgtttgccacctgcaaaatcacccaacaaaattccaaatcaagcaaatgctagaacccttgttcgacatcatccacttcacatgcagtctggaaacaccaggaatcgaaagtgtcggagggcctctccgccatacgcatgcggctcggtaccctggcagtgtgaaaggctgtggttgtcgaagaccacccgcatcatgcaatcagaataatgacttagtcatgttgctgctgggatcaatgcctgtcggcgtcctttgggggaaggaagccccaaaggagggagggccactgaaagattgaggccataggccatccgcatcaagtcatcttcaatcagtctttaacaaattgctactccctctgtcctaatatattgcaacctaggatgggataaatttatcccattctaggacaatgaatctggacataccatatatccagattcatagtcctaggatgggttgcaatatattgggacggagggagtagctagtttaacgccctccaacatccttcgggggaaggaagcgccaaagtaggaaaggccgctaaactttgcggacacattgatacactgttagtcttgatctcgtctaaaaatttaccatggtaacagatcaaacttgtactacctccgtcccaaaataagtgcagccataagtttccgcgctcaactttaatcgtccgtcttatttgaaatttttttataattagcatttttgttgttatgagatgataaaatatggatagtactttactcgtgacttatgtttttaatttttttcaaaaaaatttcaaataagacgaatgatcaaagttggacgcagaaaaccatggctacacttattttgggacggagggagtatttttcctttagaaagaagtacagtatataccttcatcttggaaatgacaaagttctcagtagtgtgtgtgtgtgtatactaatattttttcgaaacgttcgtcatgatatgat

SEQ ID NO: 24874 - DNA, 359 bp, Oryza sativa
tttttggtgttttcaatttatttgaattacactcgtttttagagtgctagtttataataattggctgtagctcttttgagcaaaggccgaatgttatattctattattaaaaaaaacacaccaccttttcagcaagttttactgcaatcaactagtatgagtggcacataagtaacgacggcgacctgatcatccaaagtcaaacactcgcacaggcggcagcgcgctcggccggtgacggcacgggctcagggcggcgctagatcgccggtgggggaggcggaggaggtaggcgcggatgccctcgccatcgtcgtcgatgtcgccactgatgacaaggtctgcgctgctcaccagct

SEQ ID NO: 24875 - DNA, 1501 bp, Oryza sativa
tcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgccgtgcccggctccacgcttctcgcgcccactatttcgccccctcgtttctcgcgcccacgcttccactaatcccattcgcccgcttgcggcgcatgaggtggatatgcggttgtggcagtcgagatagatcatatcgtgcgtgcgttaattacgctcgccgaccgaagcgacgttaccatatctccagacgaaacgaatcgccatgtccagattcgtgtgctactcaagtaatgtggcggtattgaagagaccgctcattattgacagccgagttaccattgccgatgtgcgtggtttgtgaccgttggttttctgcccaattgtggagaccggtcccacctgtcaccaagccttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggcacccccgagggacgtcgggcccgagggtgatgtgttcgccctcctcttagtccccccgagggggtcgggccgcacccgcctcggccccgagggccgaggcgccccgacccctcgtgggtttttgctccgagtgtatgggttaggtgagcacagtggggctcacctaaccacattttttgcggtttggctgagcgtgtcacgccgcatgtaacgcagtgcagtgcactcatttatccggtctgtgaccagtcacagaccggtcaaatcgcgggttaggtggcgacaggcgatctgacgcacgcctcgccccatcccgtcaggacgagggcttctaggcgctcgcccccagctggagctagcgtgttacctcccagagatggcacgat

SEQ ID NO: 24876 - DNA, 1501 bp, Oryza sativa; identical to SEQ ID NO: 24587

SEQ ID NO: 24877 - DNA, 1501 bp, Oryza sativa
tcatggcatcgagatactatatctgaatcaataatcctattgagtatttgcctaatttgtattcgcatcggtaatactactaattcaaatccacatatttatcacttctatgtacgttcctgaatatctaataaagggaaactattaaggatagtctaagaaaatccactatccctccctttttttttgtcaccacgcaatataggtatcattgtcctacatattactgtatctcatattatcctaaacagaaaccaggacatggcgagaaaccagctggttcacgccaaaattggttcctgccaaaattgtgttccctgatcgaagcaagtgatacataaaaacctaacacaccatacctgcatcggaagttgttccaccaatgtcttagaaaaaaaaatagtcaatacaaccaccaaagtattcagttttcacatagttttgtgaaaaacatacttattcacgcctcatacacataatgacaaggctgcaagattcttgtaactagatcaatgatacaaactatttttattataaaaaaaacatggcataacatcgcaaattcacatgcagacatgaagtcaaccaaaaaataatcaaaattcacaagcaaccatctcccctaacaatcgcaaccacccatcgcacaatgaacccgaccatacaaccacattccccgcacagaattttacggcgcggcgctgaatcaaaccaaaattagaatatggaagcgtgaaattgcaatgtaccttcggttggtgacgaaggcgcagggcttgtagagcagctgcttggggtcgaagaggatgtgatcgaagcagtaggccgcgaagggcatcgccttggcgccgcaattcgccgcggagcaccccgccctggcagccgcaatctcgacagcagcgccgccgccattcacagccggatgaggaggagggggagcgccgccaccaacggcattcccggcgtcggggctggagccgtgctcccaccagtactcggcgtgcctcgcggagagctcgtcggcgagcgcccaaagctgggcgcggtagagggagtggagctgcaggaggccgcgccggcggcggcggatgacctcctcgcgtgacagcgccgcggcgcggcagagcttggcgtcgcccgaagcgccggcgagcaagaccggccgcggcggcggcggcggcgtgggtttatcggcggcgtggccgtcacccatcggaggcggtggcgggctagggtttcgaggggagggtttaatgagggagaaggtggtgggcctgatgaattcggcccgctcgattgggccggtctgtctgggcttatatggcctaattgtttttgaaaaaagtacaccaaaggtccctcaacttgtcatcgagttagaaaatcgtcctccaaccacacaaccggacacaacgtatcccccaacttacaaaaccaggacagactagatcctcggtagttttgaccccggttttatccgacgtagccactgagtcaccgt

SEQ ID NO: 24878 - DNA, 591 bp, Oryza sativa
aaattttctttctagcaatttttttcattcgtgcacaaatctcgaggtgatacgatggtcacaaatctgagtgtttttgggggaaaagaacttgcagcctgtttggttggagggagatggtgatggggaatgggagtttatgatatctggaagtttaagtctgtagtttggttgtagtttggttggaagacttgggatttgagagtgtttgagatggggaattaagaggtccaattcctacaaatctcttacctgggggaggcctattaattcgtgaaacttggtgggattcgactaaggctgtgtttagattcaaagtttagatctaaatttcagtcttttttcatcacatcaacctgtcatacacacacaatttttcagtcacatcatcttcaatttcaatcaaaacccaaactttgcgctgaataaacacagcgcaaacaagggatgggaactaaaaatgtaactcccataaccaatcataccaccaactccctccttgaaactcccattcatcttcccttctcttgccaaacaggctgttgggggaagttttctagcaaatccgtgaaaaaattactaaaattcatt

SEQ ID NO: 24879 - DNA, 1501 bp, Oryza sativa
acataatgaaatttctcccacacctcccaacccaaatccgtcacccgccgccgccgacaaaaccctagacccgccccgccgtccaccgccgcccgtcgcatcccgcctcctccccgagtccgcgacaactattcccaaggttggtgtactccccgtcctctttctcctaggtctctaaatctgcatattcacatgttagtctcatccgtatggtagttttttttctttggtttcattgccgtcatccgtaagttgacatttatcgtcaatctttcactgtaaaattgtggctaggaaatggtgtgcctctgatagtatgtgagacaaacctataaattaatagccgcacaaatagaaaaaaaagcagttgtcacaggaatgctttggtgccgtttcattattcctgttctggctattagaattcatttggcttttgccactgcaattggccatattcttacttccagtgtcctttggtaacaatattagctcaatgcacaattctgtttttctattgattagaatgatacaaggtttttttttcaggtcatgaacaaaatgcagttgcacttttacttgttttattactaattcactaagtttaagtcacttttgttctggtagatatatttccttaatctgtactcatttgttgtttgatgactctaatcgatgatcatttatgcacattgtgactttctagcttaccatttgatgttatggtttaaggcacagaggagtagcgaaacatgatcccctttatctagaagtcactaagtcagtgagccccacctttatttgtgaagactacttgttagctgttactttgtattcaggattggcagtttcagtaacagctttaggcttagttcgtttcccctcgttcccaactgcccactctcgtttttcgtgcgcatgcttttcaaactgctaaacggtgcgttttttacaaaaagtttctatacaaaagttgcttaaaaaaatcatatagatccagcgtcatatatacaaagatggtggtagtataaatttagttagttttatttcgataataaaacgaacgagcgatatcgtagcgaacactcttcgtttaacttatgatattctatcaagcccatttaaacaatgatattataacgaaacacttctctatctctgctattataaaaattgaagatgtttttatcggtattttggtacgtcatccgtgtttgagttgttttttaagttcgtacgcttttagaaatacagatatgtgtttgagttagattttaagctcgttttcttttgaaaatacaaaaggagtcgtataagaaatcttttttttaaagaacactcacatgctaacttgagataaaagttggacttgtaattgtagcttgtgattttcttaaaaaaaaaatccaagcgaattcctatagtgaattttatcctatctaaaccgtataacaataataatgttaaaatagtattcacccattgcaatgcacgagtattttta

SEQ ID NO: 24880 - DNA, 1501 bp, Oryza sativa
tgttgtttttcactttctttttaatctaagttggttagtttctaagacatttattcactatattctcgttgttaattgaatgatactcccctgtcccgaaacataatgcgcaactaccactaacacaaaaccaagaaaaattactatcactttcttgtttggatcacgtcaataaatataatacatgtatccaataaaattaaaaatcttaagggtgaaagttttagaaaagaattaaaggagagggggagatgctagttaattgcacgtatgaatgcgcgctttatattactatgaaacatcgaaaaggtggttgcggagtatattttaaagaggacggagcgagtattattttcgtgaaagaataggatctcattttcagtttcaatgtgcaatgaatacagagcaacaatgtcacgttaactgtttaattactcctgtacacatgcaagtctaaaacgacttgtatctggagagtattactacaatggagttatgacaaatttgtgacactcaatttggcaatttgtcacattcctttcccattttgctgggcactgaaatttgtggttggaaacattttttttttatcaatacacaagtggtagttcccaacaactgccccattatcttgacccttttttggtgcctaatacatatatatccaacttggtaggtttcagatgaaggttttcatgtgaaatcagcaatgattgttttatgggagtacagctcgtattgctgcttgccactcgagcaggagatgacacgatgcatttaactccacattattaattgggcatttgggcaacttgatttgggagttaaaataccggaggcccataatgagggagcaaaatgatcaaagtaatgccttggacgtcgtcacctattcccatttctgaggcgcagcatggcacttactaattaacattagcaattggattggtacgagttgaattttatagtacttcataagtatatttgcagcctgttgtatttttctactatatttggtgtgaaaaaaaaatgcgataatcagtatggctttttgcatctttaaatgcagtgatggggataaaaagagatcatcatcttcttctgtaagtcttttttttaaaaaaaatatggccaaatatgttaataagagcatattacagtcctattgttacaagaacgagaatgtaaaatctgttaaaaataaaacgtagagacaccgcaccttatattgccacaagacatgcaaacacacaagtacaactataacactgagtcactgaccaaactagggtacatgcaaaacctgcatactccctctgtgctgtaaaaacctacacagaatttgatttttttttttacgtaacagatggagtataaatgatcaaccacttctcccttttttttctacgagtctcagtaagcacatcagcaatatatgcctaaaaatttatctccaaaattttgttttcggattcttgaggtgtaagattcctcttttcaa

SEQ ID NO: 24881 - DNA, 457 bp, Oryza sativa
ggcgacatcgacgacgatggcgagggcatccgcgcctacctcctccgcctcccccaccggcgatctagcgccgccctgagcccgtgccgtcaccggccgagcgcgctgccgcctgtgcgagtgtttgactttggatgatcaggtcgccgtcgttacttatgtgccactcatactagttgattgcagtaaaacttgctgaaaaggtggtgtgttttttttaataatagaatataacattcggcctttgctcaaaagagctacagccaattattataaactagcactctaaaaacgagtgtaattcaaataaattgaaaacaccaaaaaaaaaaacttgatatcataggtagtagcagaaagacttgatattttgataattcgtggattaaaacgatcattgaattcatctgcaatataatgtattcaagcaaaagagaagtgtaagaatttgtaacca

SEQ ID NO: 24882 - DNA, 1501 bp, Oryza sativa
gcttctggggccctccactcccagccagcaacgagggctcggaggacgacggtggcagcgaggatccggcgtgagagctcgtcggcgccctccacttccggccggcgacaaggagacggagcgccgagggcgacggtggcggcacggatccagagcgacggtgaccccgacggtggagagagaggtttgtttcgatggtggggaggtgggggtgatggtctacagcctggattccatgcttttatctgctttttccgttgagcttctcatgtcttaagttagggtgtgtttagttctagggatgtaaagtttttgaagtataaggaaacacatttgaagtattaaacgtagactaataacaaaacaaattacagattccgcctgtaaactgcgagacgaatttattaagcctaagtaatccatcgttagcaaatgtttacttagtatcacattgtcaaatcatgtcgcaattaggctaaaaaaattcgtctcgtaatttacatgcaaactgtataattggtttttttttcatatttaatgctctatgcatgtgtcataacatccgatgtgacgtttttagctaaaaatttttgggatctaaacaaggccttagtcccgtgttcctcacaaagaaatggtcccccactgccacgttagcagctgtccttcgtggcgagatgccacgttcctgcaccgtgaaggcctgaagggacaacatcacaaaagtcagtcaacttgagaatcatatgaatcattgaaggcggtgacagccaaaaatatcatcttgacttgtgctacgatttagattggatgaggccagagcagaggactcatagcctccttgctttgcttcttgggtgtatcatcaataggtagcagagagagtagcagacagcctgtgaaagagagcaattgtatggcagaatcgctgcttctccccgtagtgcacggggtgatcggcaaggcgaccgacgcgcttgtccagaaagtcacccgcatgtatggcgtcgacggcgaccgccgcaagctggagcggcagctgctggccgtcgagcgcctgttggccgacgctgagtcgaagagcgagaccaaccccgccatcaagcgctggatgaaggacctcaacaccgccgatgacgaggccgatgacgtcctcgatgagttccagtacgaggtgctgcaccgcgaggccatgagcctcaagtcgctagggcacaaggtacggagctacatgacccccctagagttccattttaccatgagaaggaagcttgccaaagtgctcaagaagatcaacgagctggttgaagagatgaacacgtttggcctgttgctgcgagatgagccacaacaactttcttaccggcagacgtactcagtgctgccatcaaatgaattagatgatatctttggcagagacgacgacaaggaggtagtggtgatcaaactgttgctcaatcagcgagatcagcacaagtgggcccaattgtggggatggggg

SEQ ID NO: 24883 - DNA, 1501 bp, Oryza sativa
tttctctgcttcttcaattcgcgtttctccgccatttcgtgcggtgaaggctctcaccttctctgcgcatcaacattttttctttcgcgtcactaatcgttttggtgtttttgtgtggttgcagctctacgaggacgatgtgtgcttgtgcatcctggacaccaaaccactgagcactgggtaaggcgctagctagttgcgtgtcctcgctctcgatttcgtctctgcaacttttaaaatccatgactcgttttgtctctcttgttaaatttctagtgaaatttggttgagttttaacacctttgattgtgtcgccgatgagtaggcatgaatgaataagtgctagattccgtttggatgaataaactgatcgtgcatttgtgatttgtgcatgcctgcatggtacgtcgctaacttctccattgtgttggattatgtgctgcatgtattcttcatgtgcgcaatatagatggcactttgttttttttttcatttcactaatgtggtgggttgaacaaaaaataataatactccatattttccatgttgttgaagtatgcaaggcacacgtggcaacacgttataccatgcatcaattgtgtgatggttgcatagttacgtcttgtactcattttcagttgatgaaattgaattgtacatctcccaatgctgtaatattgctactggtccggtatggtggttttggtttttggtagttcagtaaattgcatgccattgatgcttttactagttcattactccctccggttccatattaattaacgttttggacaaggttgaggtcaaacttttataactttgtccatcaataactttaaaaatatttagtttaaaggaactagaacaacatatatagatttgtcttttaaagcactataataaaagtaaacatgcatttatttattatatatattatagtagaaaaataaagttaaagatatatcttgtagaccgtgtcattgtccaaaacgtcaattaaaatgaaaccggagagagtacaaatttaacatagtgcgtcaggtcaacatgattaactcctggttctgcttggatgtgcatactctatgctgtattggggtgctttacattcatgtgttcaataagtatgagacatttaagatgttgcatttgtttgacatcattaatgatcaatgtaaaatacgactgctggatgtctgggcatgattatttgatctgttggaaaatttaaatacttactacatcaaccatttttttctgcttttgcagtttgtaaaattgtgaaggaactaatgttttgtagtctgtatgccatcttaatcttgatgtaaagatccctttgtgagaaatgaatttgcatgtttttccccaaaattattggaaatgtgaatgtcatttttcatcaatcgaatttgagcatgtgcttgatgccaccaaatgtttgttgccagttagtctagtatgatggtccattggtcatatcatggtccctagtattaag

SEQ ID NO: 24884 - DNA, 1501 bp, Oryza sativa
attacacgcatgctctctcatacatgaatacctacatgcatagccactgccccctcagtctctttgtgcgacaatttaaaaaagagcaaatctacggttcttgaggaggtaacatgaggtaccaaaaatttagtgtaaaatttggtacctcatggtacctcatagtacctaggtaccaagaggtaccaaatttacaatagaaaaagtgatacctcatggtacctcctcaaaaacagtaaaattgctctttaaaaaaggataagacccttgtgcagctcagttagctaacttctcatatttccatcttccgcactttaaaagttttttttcttctaaactatttatccgatttataatctaaactagccaagcacaagtgctttctcaacttaacctaatattagctgacaatagtattacatatgcatagtaatcatatagaagtcataacatgaagtaatcatgagtatccaactaaacagctggaagctaactccatacatgagctaacctgttagaccgttgagttacctgatctgaccatccgcacaaccctgatctgaccagcgcacactgcgcggtctgatcgactcaaatagccaaaaaaaaaaacatgttcatcgtaaaatcccactgttcacctcgttactttactcttgtttacaagtattgagggttaaaaatgtggttctataattaatttagagggctaaattgaacaagtgcgtaagttcagacggataattttgtattattattattattattgctgctgctgctgtcgctgtctgtttttcagccttaagtgtattgaagtggcgatgtccaaatataacagcaagtaaaaagtacggatgtaccggtacatatgccgttagtcttaacaaacaatgtggttaatgtgactgtctaggtcagctgtcctttcgagaaaatatggcgcaaacatccgttactgtcattgatcatgcccactacaaaatgcagaatataaacatgcatgcacgaatgttcctatctaattcataaatcacacgatatagtacggtagctatagtagcccagcttgacacttggaagttacaacatcaaagagctactagcacatagaggcatatagaaaaatacaatatatcgcaataaatccatcatgcaatatatggcgccctatcattagtatagtattattgatcgttagcttattctgatcagaagatgaaaaggcaaagcaaacctcactattggtcccctctccgtatatgtttcatggataagcatgcaccaccaacataaccacaacaaaactggagacgtctcccgctccaactagaaaaaggatggtcgaaccaacagtttggccgttatttaactgcaagaaattattgaaagccctccttctccaactctcactccctacttaaaccccagccctaacaccgcacagtacagtagtagctatacagaaagcaaattaattaagcatccaaaatggcttcctccc

SEQ ID NO: 24885 - DNA, 1449 bp, Oryza sativa
cccctacacaacaacttacaaggcaagcaaggggccttgtagattttgtggtggctctcctgggctgggtgtggcattatgacgtgtacagtccgggcatgtagagcagcgcaaggccgccttaaatggggaggaggtggagagatttgagtcatttaaggtcactctacttgtcatcttcaatgcccggcctgccctccccttaatggggttggatgaaggccatttaagaacccttctttagtgtccacgccctcccctgcatgaccccatcaatcaaaagcccattgtagaagagaagcagtcccccctccctccactgaattctcttctcctccatctcttagtactacaactagctctcaagagctcacaccctagaactacttgtgtgtgtatataagagcaggagctagcatcatcagccaagatgaccactgaattccttagagtggagaagtacctgagtgtgaagaggatggagctgcagccggagctctcactagggccgacgtggccggcgccaggcttcgtctcctccaccaccaagagcaccaagagctcatcgtcggagtcagacggcagctccaggaagaagaggaagcacttcacctgggaggagcccgtgtcgcacgccaacctggagctccagctcaatgaccccctgcccctcgactgggagcagtgccttgacctgcaagtgagttcctctccatcacactaacatctaaacatatagttatgaaaaacaatttagtgcagagacttgttaatgattgtaatattcctactactagctagttaagtataagcatgatacattgcacattatacttcatatatagtattataattagcttatcttgtcgtgtgtttatgccttgatgcaagctatagctcctggctctgaaacaatagttttaagaaatatataatttatggcgtgcaactcctattcttagaagtgtccacctgccaccgccatggcacgtgcgtacgtgaaactgacgtaatattgagctggcagaagtagcagagcaactagatagaccagcagcacccacatggatattggtgggcaacgcatgcagcttaattcaacgtgcatgatgccacttgtgatatctagctacttgctcaacgtccaaaagatgcaaaacttgttgtatgatatgatgctgccatgattggcttatcatttgatgtaatagtccccgttgtttatcttttctaatgccatgtgtatatatgattctgtcagtctggaaggatgtattacctgaacaggaagaccttgaagaaaagctggatcaggcccaaggagcagagcgtgaacctggagctcaacatctcgactacccagccaaccgtcgtcgtcgtccccaccattatcgatggaggaagcaccggagctgctgctactccagttgctgttgctgttgttgcaga

SEQ ID NO: 24886 - DNA, 526 bp, Oryza sativa
tggtcgtgtagacgctgcagcttcggaagatccgctcttcgtggaggttgaagccgacgtttgggaaagcgagcaaggcaagtcacattatccttgagcatattgaatcccagtttataaaattattttgatttaaattattgcattatcgcttttcttaaattcccgcgttatcactgtttttatctagccatgcctagttacctttgttatgaccttattattgttattgttattattaccttgttcaccctagattaaacaaaaccccaactagtggacactccactcatggtaccactagtatgattttaggtagctgcttcgctggttaattaggcaacattaggtggttttacaactctagaccttgggaatactcttatcacctggacactatggaattgttggattattgtggaattggattcacacctccccctcattcaaaatccccaaaatggttttaggctgggctcggggtgcatggttttgatagtagcacctcggccatataagggccggt

SEQ ID NO: 24887 - DNA, 1501 bp, Oryza sativa
ttggcggaaaagagagacatatgtacacatgtatctccagtttatctaaacaaaggaagtcgtgaagaaaaaaggaagtactactccgctgatgttagccagctcgtgaaatcacagtgttgagaagataagcattaagcattgacgagcctcctagctctctatagaaggagtcagtctagctgaagagaacacaccagagaagcaagagtagtagtttctcctgcctctctaggcagttttacccaaaaagaacacttctctatagatacaaggaccaccggatgcctatacaagatgcaagctaagaataagaactaccaaagaggtttctcaacaaacaaacaatgatatataagaaagttacttcatattaaacaagtaagcttacatacggttttctctttcgggaccccaaagaaaggtacagacaagttttctcaccttagaccgtttatataacatttgttgctcccaatatactagaaaggtaaattattaacattactacaggactaagaggctgaaggttcttaaagactaagctagaggatcttgcttctctggtctgtgctctttagctggaccaactccgtttatagaggctagagaaggaggctttgtcggtgcttcgtgcttatcttctcaacactgtaatttcacgagctggctaacatcacagagtagcacttccttttttttttcttcacggcttccttcatttagctaaagtggagacaactttgtacatatgtctcactttttcggccgaaagttatattcttcacaatattcttagcagtgaaatgtcactcaccgaaagaattttgtgatgaatctgcaaacgttatcactctttgcttgtagtgttcttctgaactattcttccctttacccttgaaatatagttgaggtagtttacttgtagactattaggcttgccacccctgaatgattgataaatccttatcaattgaacctttcttatatattgaactttgaaatctatctactacctatatagtgttagggggcaattgcgtttttgatcctattttaaggtctaactatcaatttaaccctattttcctaagtttgctcttttgactctcttttttaaaaacgaacgttcggtctggccctattccgttaaggcaacgtaacagtgttaattcagaaaaaaatagcctttatgcccccactcattttcatttgactctactttttcaaagtgcttgcctaattttgtgtatttttatctaaaaatgtgacaatttttttactaacataagtgacaaatttaacttaggtttgagtgatttgacaattttgaaatagatctaacttcttttggacgaaattcacttagatttgatatatttttgagaaacttaacatacatttgacagatttttgataaatttcacaaaaaaaaattacataatccctccagcaccagcagcatgccgtcctcctgaccaggagagcaccgggcaagaac

SEQ ID NO: 24888 - DNA, 1501 bp, Oryza sativa
tccctagtgtatttttaagtcttaaaagggtatccatgatggtgccaaatcatctcataccgtattattcacttatggcgatagactattggatgtttttttttgattgaggtaaatgtaaatagtatggtgcatttgtcagctattaacacttttggatctaaaatgaacaagtgatatgataatgttatagggaatcactttgtttttcaaacgtaaacagaagatataaagtgtccactagtacgagccaaccctaatgtaagtgatcaacacaccccattaggaatgcagagtacccacctttatcactgttcatttcatgctttgaatcactatatctaacttagggtgtgtttagttcacgccaaaattggaggtttggttgaaattggaacgatgtgatggaaaagttggaaatttatgtgtgtagaaagttttgatgtgatggaaaaattaaaagtttaaagaaaaattttacaactaaatacggccttactttactgtccttccggtgtcgtaatgcagaggattcagatccattatgtcttgtgtttagtatttaggaaaagttacggagtctatttacaatcactttttttttctaaaaaaggtgctagattgtaaaaaaattgtacaaccgttttaccgctgctgacatgattgtatggttagcctttgttggtttgttattttttttttatgtaagcctttgttggtttgttgacaaatgacaactatctgcaggtatcgaacttaccgaagctgtaggggtaaacgatagaagtgatttcacactccaagaggcaaatttcgtgctgcagtaatgcttgcaacagggtcgacaggtgcatccatcttgttgcagtacgccagtacccactccatgagtgaagaaaaatcacctctcaaagagctctccactctccagagcgacaacaggaggaacaaagactacacctacaaaatcaagaaagagattttctctccctctctctcttggcttggaactgtggactcattcttcattcttcaatggccaatggaatttgttggataggaagaacctacaccagaaaaaaaaataaaaccttttgaatcaagagtgaagcagcatatttaaggtacgctttatgcttctactcccttcatttcatattctagcattgcccacattcatatagatattaatgaatctaaacacatatatctagattcattaacatctatataaatatgggcaatgctagaaagtcttataatatgaaacggaggaagtacttagttttaatgattaaaagcaacaagcccgagttgaccaaaacaatgaaagagctatcaactaattctaaattaagttctaaaattcaaaattatctaccaaaacgagtagttgagaactttctgttcaaaagaagaaaaaaaaagaacacatgaaaatatcagagcatatggatgccatttggcaactgcaacaatgcttaagaacaaaacggctagt

SEQ ID NO: 24889 - DNA, 1501 bp, Oryza sativa
tgtcctcgccggcggtggtgacgttgacggtgcagacgccgcgctggccggaggcctgggtgcgcaccgggttggtggtggtctcgaacgtgacgaagccgtagtacctggggaggacgtggtacagcaccagctccgcctgcgcctgcgcgtccatctggttgagcgtccccggccggagccgcccgaacgcggcgtccgtcggcgccagcaccgtcagcccgtcgccgttccggtcgttgttcagcaggctgctcacctgcgacgtcacctccgtgtccttgagcagccggacgaaggtgttgtagtgcccggccttcgtcaggatctccgtcaggttgaggggccccgtcggtgccgggcttggcgcttcgccggcgccggagacgacgacgacggagacggtggctagggttagggacagtacaagaaatactgtgcttggggaggaagccattttggatgcttaattaatttgctttctgtatagctactactgtactgtgcggtgttagggctggggtttaagtagggagtgagagttggagaaggagggctttcaataatttcttgcagttaaataacggccaaactgttggttcgaccatcctttttctagttggagcgggagacgtctccagttttgttgtggttatgttggtggtgcatgcttatccatgaaacatatacggagaggggaccaatagtgaggtttgctttgccttttcatcttctgatcagaataagctaacgatcaataatactatactaatgatagggcgccatatattgcatgatggatttattgcgatatattgtatttttctatatgcctctatgtgctagtagctctttgatgttgtaacttccaagtgtcaagctgggctactatagctaccgtactatatcgtgtgatttatgaattagataggaacattcgtgcatgcatgtttatattctgcattttgtagtgggcatgatcaatgacagtaacggatgtttgcgccatattttctcgaaaggacagctgacctagacagtcacattaaccacattgtttgttaagactaacggcatatgtaccggtacatccgtactttttacttgctgttatatttggacatcgccacttcaatacacttaaggctgaaaaacagacagcgacagcagcagcagcaataataataataataatacaaaattatccgtctgaacttacgcacttgttcaatttagccctctaaattaattatagaaccacatttttaaccctcaatacttgtaaacaagagtaaagtaacgaggtgaacagtgggattttacgatgaacatgtttttttttttggctatttgagtcgatcagaccgcgcagtgtgcgctggtcagatcagggttgtgcggatggtcagatcaggtaactcaacggtctaacaggttagctcatgtatggagttagcttccagctgtttagttggatactcatgattacttcatgttatga

SEQ ID NO: 24890 - DNA, 1501 bp, Oryza sativa
agaatatgccccaatacaagataataatttaacttcataggggtttgctaatattatcaataaaaaaaagtggtcaaagttgtattttgaagactgttccatgtccaaaaagacatgttctcgtggccagaatgggtatatggtaatctgcaaaatctctgtcctataaattttgttaaaatgtaaatgttcatgtacggtctgcataactatcaagatcattgtcatcataaccaaaacttacagatggcggtgttgcctgtagtgatggaaagtgacgttttggaatgatcagtgaatgcctacaattgtaaacagaaaggactgatcatgagttaagcgcaaaagcatcttggcatgtgaaaaggaaccaattcgttaaatctcagatagaaatactatataagggtagattcaatgcagaaattatttaatcagtcagttggcccaagctgcccagagttgccgcattattcaaaaatactttggaactaattcaccacattttatgcaatctatattcaatttgtaatagtttctattaacttttgttctgttctgtcaaaaacaggcattagaacataaatctgcaaccagtatcagaatcacaacaatgcaaacttttcttcataaaactgatatatcagctcttccatttcgtagtttaagtattaaagactaaagagtgttaaagaggtcaagacaagaaaggaccgagagacaactagtagagcagccgaagaggatggcttgaggagggaagcaagaataacatccattaagcaaaggctatgacaacagaggtctgaaactacagctctcagtgaggcacagacatttttatcattctgactctgatattctatctctaagcacaattattaggttaacatgaaaaacatcactggttcttccatgattggcttcccaatccttcaaatttacccctaaatattcagtttggcttcaatttggactagggattgacccagcaatatggccgatcatctcatccccacaatgatcatacagcaagccacatcaacagcaaactggccaaaaaaaagctatgttgtacaccactatcaaataggtaaattgaggtttcagcgagcagaaccattatcttgttcttttaagttttataagcaaagtagctatgattgcaaatacaataaaatatttgaccaatactgatgcaactttaaactttattatttcccatttttaaacggtcttaatactagggaccatgatatgaccaatggaccatcatactagactaactggcaacaaacatttggtggcatcaagcacatgctcaaattcgattgatgaaaaatgacattcacatttccaataattttggggaaaaacatgcaaattcatttctcacaaagggatctttacatcaagattaagatggcatacagactacaaaacattagttccttcacaattttacaaactgcaaaagcagaaaaaaatggttgatgtagta

SEQ ID NO: 24891 - DNA, 1501 bp, Oryza sativa
aatcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcatagggtcttagccggtcaaaaacacgcgctttaatcccttgaagtatcatgccattggctcgctccacctgtccattgctcatggggtgtgccactgaggcatagcaaatcttaattccaaagtcttcacaaaagtctttaaaaactccaccggtgaattgtgtgccattatcggtaatgatccgattgggcactccaaatctatgcacaatgttgatgaagaagtctcgagcattatctgctgtgattgtgacaaccggtttagcttcaatccacttggagaatttgtcaatggccacaaagagatgcgtgtaaccgccaactgcctttttaaacgggccaaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcatgagggatgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcgaaattcattaacaggatttttagtggaattttcagagctctagaaataatttttaaccaattaaaaatcactaaagtgcaattgttaattccagggaaaatcctttttccttttcttttcctttttcctctcttttccctcctttttgtcaagtgggccgtcggcccacttctcccttccttcccctcccttactgggccggcccaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgaga

SEQ ID NO: 24892 - DNA, 1501 bp, Oryza sativa
cagggcttcgccggagatcaaaacgcgacggcgaacttcgggtttgtcgaatctagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtatgatttagggaaaatcaacatctgcccctagaggcacccggaccccccttatatatggggaggagtccgtgttacaaaagataatctatatccctaacggaatatgcaaatacagatgaaatatagtcgtaaccgactaagtctcagggtgtttccttgatacacaagttaagaaacaaacccgagatacagataagatattctatctacattaggtatcctgtacccagtccaaataccatcgccgtgtagatatgggatatccataatctccacagtagcccccgagacctttgcagtcagccatcgtagccatctcaaaaatagtccgagtgcttcaaacttttcatgtcaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcagatggcaaaagcatacgcggcgcctaaagaggcattctagccgactgctttttagccataataaaagaaatccgagtggttaacactctaaaaggttcacgaatgaacacacttgatagacatccgaatataaaattctaaagattacccaccaagtattataaaaattatggtaatgaataagtctaatagcctaggctatgactatttaccataatgaaaataggtatataacataccaaggaagtgactatgataaaaataagtcattccaaattaaccaagacagcttttgtagcctaataaagctaacaaaaagcagtataacacctttctgtcaggcaccttttaatctgcattgcaataattctaaagaattatatgaccgcataaaaaggattttatcaacattgggcaacactattgtgcgcataaattgccaaagcaaaaaatgcctaagtccctaaggaacacaatgggccacgctgttaaaagtattgggctgaggtactgttcaggcctaggcccatttgcacttccgatacccttaacaagaaatccgagatccaagcgatgcttcgtcttccccgccggaacgctcgccattttccccactccacgctacagtaaagagctgcgccggcgaactagggttcaccaatccacccaaatccaccttcaaaacgtgatcaaaatccttcccgtgatccaccgcctcaattcctcacctctcccaagccatccctcgaatcaaatcagcgcatttgagaaaaatcga

SEQ ID NO: 24893 - DNA, 1501 bp, Oryza sativa
acctccggtaccactggctgaacctctggcggctgatgctggagcgaaggagagagtgaacgcgggagttggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcgtgatctgctgtgcctcctgatgcctcgaccgccatgttagcgaggcaagtccccacgtagccatggacctccaagcggacacggtaaggaagctcgccactgagcggtgggatggtcgtgtattccggcgcgtcggggtagcccactaccagtgtcatgcgtgccaactctgccacgaaatcaatcatgccttctccgcggtggttgggtgggtgaccggccatctagagaagacaaagaagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttctccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacg

SEQ ID NO: 24894 - DNA, 1501 bp, Oryza sativa
ggcccaccggggtttgtctggtgctgcggaggcagagagttcgcgggggtgatacgtgttactgccactgacatgtggggtcagttttgtggaggtggggtccactgccagtgaggttgcgtgcttttttgagtggggaccatgcgctgttgcggaagacgccagtagcggttgcaaagcgtgacgtggaatacgggatactagctcatgctcactgacaggtgagagaggctcccatcggatggtctaataagccaaaaaaaaaaagctaaaatttaaattttcaagcttaattttaatattaattttaagatatttttaatatatttttttcaatattagcttttaagtcactaagaacacatttataaaagttttacctacaaattcatttttattttctaataagccaaacggcttattagaaaataagccaaaggatggtgactagagggatttcgttggctttcccttgcacgtggggcttattaaaaaaatgatactaataatgatattattttctactaatagatatcatagagttgtttttcttctttattttctgatgattttttttgtattttctttgttttcctttgaaaatctattagattctatgtgaatctctataataagatgatacttttctaaagtacagcctccatttcatattatatgtcatttgacttttctcttagctaaagttctttatgtttgactaagtttatcgaaaaaatatagcaacatctataacatgaaattagtttcattaaatttaacattaaatatattttgatacaatgtttgttttgtattgaaaatattgccatattttcctacaaaattagttaaacttaaataactttgactataatatttacttcataagtactccctccatcaaactttttaagccatgaataacaatattatcaaagtttcaaactttttgcttgaaattgaaaacctcaatgtcaaatcagtcttatttttttcaacatgtataaaattattctaaaagatattgagaaataggagataggttataatgcatccataaatcttacttcctccgtttcacaatgtaagtcattttagtattttccacattcatattaacaaaatgacttacattgtaaaatgacttacattgtgaaacggagggaataccaaatagttggatgcattatccaaaaaagaattgatagtaagctgaaccatttcaatagtttggagactaaagtttaaaggtttccggcgaaatatactcctaggtcagggagtaaatggacttctgtttttttccaaaggaaaagcataagttgtaattttccttgggctgggctagcccactactcatcagcccacgttaacacgcgttctccggtggccgagttcctcttcctctgcggcgtctccgcccgccgtctcgtctcgtttctcatctcaaaatttcgcgcctcgtcgccgcgccgcgcggcgggcatgtcttgacggaatc

SEQ ID NO: 24895 - DNA, 1501 bp, Oryza sativa
catataccatctctcgttggcgtttgccctgtaaataattcttggggtcacggagaatgtaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgattgagtacctttttctaacctcgaaacctttttgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagctttacagacctgttttcttccatcttaaatatgcagattttgctggaggcttctttgatgaattattccaacactgtctaatggaggaggtggaagacaatcacataatttgctgaaaaaaaggaagagaagaggccatattacttcacctgtgcttgatcaacggtggaatccgtgctgaaaaaaaaggaagagaagggttcagatgatcgcctggcgctgtggcctcgtttggcgccaaaaaggcgagtgcgccgccaaaacgcatctgttcgcggtaaaaaggaataggagcgagacagacggcgctggagaacgaggcttgttggcccgcccttggcccagactcacaacgcgggcgtgcgctttttggggcggacggttcgatcaaacgtggacggctggatgacctcggctgctctctgccgtcgtgagggctgaagtcagaggagctgattccggaggggaggggggatctttgggggtttggattccgattccttgttgttgtgcagttgtagctcaactgcagcttgggcagttgggtcacagaaccacacgatctgaaacgggcggcccagattaagggcatgtttggcagggagctgcagagcccaacggggccctcgtttggcttatttagggaatatttgcaaacgaaaataatctgtgaataaaattttcatatgtgtgttctcggtggtttaaaagcaaaggctgaaaaataaactacgatgaaaaaaccctaaaatgaactctaaatttaaagttaaaaattaaaattttgtcttataagcataaacgaaatgataaagttgtaaagctttaaagaaaagtttaattggacccatatcattacaaatatgccat

SEQ ID NO: 24896 - DNA, 1501 bp, Oryza sativa
atatgtttgctatttgctcctcactatccatctgcaatgcatattgaaatgatgggttcttagcaattttatcttgaaaatgcatgagcatgcttcctgcttgaccatataccatctctcgttggcgtttgccctgtaaataattcttggggtcacggagaatgtaattgagattaagtgagccaccaacttggatactagccaactgatgtgctgctttgggcccaatgcccgcatcgtcagctgtctcaatttcaaaaccttgtaactctgaaattttcctttgagacaccatcaagtgcgaggtttctggcaattgaaggatgtgattgtgttccaaaactagatcagccactttataattccctttctcctgatctagcacaacacccatgcgaacttgacaatcggttctcgtttcagctcttggacactttgttagatgatcccttttatcctcctttctatgaccctcatttgcacaaacatatctgcatgacctaacctttccatctgatttccttttgattgagtacctttttctaacctcgaaacctttttgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagctttacagacctgttttcttccatcttaaatatgcagattttgctggaggcttctttgatgaattattccaacactgtctaatggaggaggtggaagacaatcacataatttgctgaaaaaaaggaagagaagaggccatattacttcacctgtgcttgatcaacggtggaatccgtgctgaaaaaaaaggaagagaagggttcagatgatcgcctggcgctgtggcctcgtttggcgccaaaaaggcgagtgcgccgccaaaacgcatctgttcgcggtaaaaaggaataggagcgagacagacggcgctggagaacgaggcttgttggcccgcccttggcccagactcacaacgcgggcgtgcgctttttggggcggacggttcgatcaaacgtggacggctggatgacctcggctgctctctgccgtcgtgagggctgaagtcagaggagctgattccggaggggaggggggatctttgggggtttggattccgattccttgttgttgtgcagttgtagctcaactgcagcttgggcagttgggtcacagaaccacacgatctgaaacgggcggcccagattaagggcatgtttggcagggagctgcagagcccaacggggccctcgtttggcttatttagggaatatttgcaaacgaaaataatctgtgaataaaattttcatatgtgtgttctcggtggtttaaaagcaaaggctgaaaaataaactacgatgaaaaaaccctaaaatgaactctaaattt

SEQ ID NO: 24897 - DNA, 1105 bp, Oryza sativa
ttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggta

SEQ ID NO: 24898 - DNA, 263 bp, Oryza sativa
  unsure (1)..(263): unsure at all n locations
aatatcatctcatcaaggcacattttagcgaaaatgaaatcgaaaatggagaaaatggcaaagtagatgtggtcacgtggtccatattggcattttaacgaatcgtgtttttggatggcattttagcgaaaccgcgtttcgagaatgaccaaatgtccattttctcnnnnnnnnnnnnnnnnnnnnnnntttggtaatctaagtatcggagatgaagaaggaatcgaaacggagttcgagatagagatcgtcccggaaacaga

SEQ ID NO: 24899 - DNA, 297 bp, Oryza sativa
aatagtttctccactttgcttatgacaaataagaggacatactgtttactgcttactgaatggcatacatgagatctttgtagggtttctgttgtttgcaatgatgatgtcaagtagatcaagaggggatccttgagaccggcagcaagaaggaagctggggactcgcgggttgatgggagattctactaaatataattcaattgatctggttccataagctgagcgagacgaagcccacatgttagtgacgacaaacatgatagacccacctgtcagtggcagtgtggcaccacga

SEQ ID NO: 24900 - DNA, 1501 bp, Oryza sativa
ttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagcccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaaggtctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgttctgctcacatttccttagctcacaaataacagaggatttttatttcgaaaatactgctaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgacc

SEQ ID NO: 24901 - DNA, 1501 bp, Oryza sativa
ttcaaagttcctcaggattgatactcacataaggaatctccaaagtcttgtccgattagtgccgcttctttgtacgaggaccacaaccaccttatggtcctcatttctaacatgattagaagtgtggttgtggatgcttttgtttatcagaaatattgcaaatctcgtattttttttgtggcactaatcttgcagctagatgtctccatggtcgagcttgtgaccataaacaaagcactacgggagatatcccggattatcttggtacgttttccttccaataaaagcaagaaccagttctaaaatagtatgcatcttcaggtattcttggtcagtaaccatttcaggttaagattaagaacgagggacatacgatgcctaagaacatgggagctacatcaactattcattttggagatccttgatgttggaacatactttatgaagatcccagtctcagacacttggtttttgacgtctcatgacataaaagtccaagtgtgggggagggcgatcgacaagattttcatgatgagttccatcaaggttttaagttggtgtcaccttgcttaaaaaaagagaagaaaagagagacggaagaaaagcagaaaaagatgagagaagaggaagagagcaagagggctgacgggctacatctagatcaaagaccgcattatgtgcgagtcttttctggctatacacctcgccagttgtgatcatgctgcttagctgcacccagcccctctcttgagctcatgtgccgccttggttagccttcatccactcttagctatgcacagcttcttgcttccgcaacacctactcgcacacaagaaagaggagatgccctcttcttttctagctgtttgctgctccggtccagttggtacttgcatatttgcccaaaaagagatgcatcccacgtctctacagcatagtgccaatggaacacgccttcaaggcacaaggttcttgcaccagaggttggccgcttgaggttgttccctagatgttgtcgtagtcgacgtctgtttttccgtaggcaaaattgtccctaggacacccaaaaattatgtaattggctagaagacactataaaatcacgtcactgctgatggacgccataaaatttatgtaatttgttgtagaacacccgagacaattttttatcatttcttatcaaaaaggggagagagaaatttcaaaaagacaaaattgcccttggccctatctaatccccgcctgcttcccagcgctgcccgccactgcctccgtcaccgctgccatcaaaactgcagccgccggcctcgttgaccatcatcgaagccgtttgtcaccacccgctgtggccttcgccttgacctccgcctcgaagccactgccgtcgggctcgcgaaccatcatcaaagctgcctccgctgcgtgctttctagagccactcaccaaccgccgtctaacccgccgctgccgccatcggccaccgtcgaagccattgcctccg

SEQ ID NO: 24902 - DNA, 1501 bp, Oryza sativa
tatctgggttgtgtttcggcaagaacggctataactggggattgctagtttgtatcttagtcgatctgtgtttccatgtctcaagaaaatgttttccactttaattggaatgttagaggtctaaatgccagagccaaacaagatgctataaaacttctcattcaacaatacggcgcgtcgattgtctgtctgcaagagacaaaactttcagctatctcttcccaaatcctcctcaactctcttggacagagatttgcatagcaatatgctgcactgccggctgatggcaaagaggtggaatactgcttgcctgtgatgaaaattatttctatctctctgatgtctttctcagtcaatactctgtatctgctactataaccatgcgcgaagaagggcttcaatggtcgatcacagttgtatatggccctcaactcgaagctgaaaaaattgaattcctggctgaactagagacacttcaacccaccatgaaaccagcttggatggtgatcggagatttcaattttatctacaaaatttctgacaaaaataatgatcgtctcaatagaaggatgatacaacgttttagtggtctcctggataaaatccaagtgaaagagctgcaccttcctggtcgtcgcttcacgtgggcgggagatgggacaaatccaacacaaacaaaaatcgaccgagcgtttatcacaactgattgggatttcatgtttggagaagcacaccttttccccctctcctctacatgttcagaccacgcacctcttttccttgttggaaaagagaaaagaagcaaaccacctcaattccgttttgaagccttttggttgaaaattccaggttttttggaagtagttcaagaatcctggcacagatcaatctttgccaccaaccctcttgcagttttcaggatcaagctttgtcgactagcttgtgatcttaagaggtggaacaaaagtcaggtgggggacattgcgctgcaatttgcggtggcgactgtagtcatttttcagcttgacgtagcacaagaatcaagaagtctatctgacaaggaacgtctgttaatctctaacctgaaatctcgagtgctagggcttgcagtgcttaacaaaattaagatcagacagcggtctcgactcacctggatcaaggagggtgatgttaattcaaaatttttctacctaaaagccaactcaaggagaagaaagaatttcattcagtctttacagaccccaaccggaattgctgtcacaaaccaagataaagaagaggaactttaccgtttctacaaagaaagattgggtaccaatttccaaagaagtgtgcggttgaactggaactcactacaaataccttcgggacttggctgatcttgaaggagacatttctgaagaactcaggaacacaattttcgagatgccatcagaaaaagcacctggaccggatggttttatcgaagccttctataagtcagcttgggagataatcaaag

SEQ ID NO: 24903 - DNA, 1501 bp, Oryza sativa
gggaggcaagaaaaagggaaaagaagcatcagtacatgacaatccagcagggcaaaatatatatcctagtacctctttgcccatggaagaaatgtgtgaaccatacatggccatcaacaccttctctcaactattgacggtaatatttcgaagctatgatccattagtattaacatcgacagagtttaaattttctttaatttttcagggagcaaccgtcgatgatcttgatgttgaattctagcaatggagtttggttttggtgaataggcttttggtctctgcgggctgcggcacctgccgagattgttcttttggcacgcttgatgaacagcttgatcttttgggcaaggtgagcatttatgcatccattggttgtacctcccttgtttgttactgaacatgtgcagatgcccccattcaccactgccaacaggtgctgaacgcaggggatgacatgattggtgttgagcacttggaagaggattctgatggcaaggctcttctgaaaggacgacgctatgccggatcaatgagcaccttcagtcttttttattaactgaatgcacacgcctgtggttagtgtgtacagtttagtatgtcatatacacttggtactggacagcagatagcaagcattttgggggacaaaaactgttggttctcttgaacaggccatatgcccagaattggaacataatttcattgcagtgataagttacaaatggccatttcatcattttgttggacaagccattctcactacaaacaatttacaaagtttttttgctttctatacaaattacagaacacatgcaaccccatttttcagaacaagtggtctgctgcctgtgtaaagaacaatctatcattctaataactgcacattcagtatctccagaatgccattcggtttgacatacaacaaagcaacactcctggacgcagcattaaggagctgaagaggaggccgctgtgttcctccactcactcgctgctgagagacggcgaggaggagttcctcctctccctgactgccgaggaggccgctatgttcctccactcgctcccctcctccattcgccgcgcgctgcctgtcgcggcgcatggcctgctcgagctcggcacacgcacatcgagctcgtggcaccggtgcgccgtgcccgtgaccaagcgctgcatcttgcacaccttccggtccccatctcctcagctgagtactgcagcctgacggtgagagcgcgggcggcgaggaggacgagcacgacggcgagagcgagggcggcgcgggggacaagaatgacggcgatggcggcggccagacgaggagtacgagcacggctgggcgatggcggcggccaaacggggacggggcttgttgggccggccttggcccagactcacgacgcggccgtgcgctttttgggcggacggttcgatcgaacgtggacggctggatgacctcgactgctctctgccgtcgtgagggctgaagtcagag

SEQ ID NO: 24904 - DNA, 539 bp, Oryza sativa
agtcgtgaatagaatatccatctttagcctgcttaatgggtgctgaatagggtaggatcagggtttccaccgatcttacctgaattaactaaacctgccttatatgctttaatgacatgttaaatttgccctttaaggtaagatcctaatgcatttaagtaaaataggccttcgtttgaaaaaatctgcttaccttaatatcttaaaaaaaagttgtatttgagtactagccgatacatgctagatctatttgatcagctatgctataaacaaaaaagtcttgttggtggtatatattcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccccgttttc

SEQ ID NO: 24905 - DNA, 1501 bp, Oryza sativa
ttcatgggaattattctcaaagaaagcattcagtaaagaggtacaacagcaagctgaattggtaaccgctggcaaacttattgtcaagaaatgtaaggggcttcctcttgctttgaagacaatgggtggtatgatgagttcaaagcaacaagtcaaggaatgagaaacaattgcaagaagcaattaggggacaatgacaggggcgaagatgatatacctatactaaaattgagctacagacacttattacctaaaatgaagaatgctttgccttttgttcagttttcccaaaggaccatgagatggacaaagaagtgttgatccaactgtggatggcaaatggtttcattcaggaagatgaaacaatgggtttggaacaaaagggggaatatgttttctgtaatttggtttggagatccttcctccaagacgtgaaaccgatcaagacattttctttcactgctgatgagtctataatttgttgcaaaactcatgatttgatgcatgacttagcaaaagatgatataccgaattttcctatgataatgaaatgagtctaacagtgggattgctcaaaatatcatcttctatccacactttgataactgcatggttactagtacatattaatgacttaagacagatgtcattaagagattttggtactgacttgagacttatgtcattaagtgctttgggtattgtctgtattcgggcttgcccttctcatagccaggtgatcaatccaaagcatctacgatatcttgacctttctaggtcttagatggatgtgctgccaagttcaatatgcacgatgtataacttacaaacactaaggctcaacgattgcctacttctgacatatttaccggaaggtatgagaacaatgagcaagctcatccatctttatcttcttagatgtccattgaagaggatgccaccaaatattagcctactgaaaaatcttcgcactctaacaacatttgttttggacactgaacctggccgtggaatcgaggagctcaaggacttgaatcaccttgccaacagattggaactggagagctacggccaagctggaaccggtcggttgggctactcagagagttctctgataggggagagggggaaaatggctggggagcgagcgcgtgagggagcgccctcaccgcccggtggacggccactccggtgtccgacggccacattccaaaccccagtttggttcctggcgcgacatcgtggtggggattggggaccacacgttaggtaaggctgagaaggaggcggcttggatagaggtgagaaggaggaaaggagttcattcaatggcgacctaccggcgcccaaccactcgtccatcagcattcaaggcggtgagggatatcccctagtggttgcagggaggtgtttcaaatgccttggcctagggcatcagaaggcgcagtgtaccggccagattcgttgcttccgttgttggttttcgggccatcttgcgagt

SEQ ID NO: 24906 - DNA, 1501 bp, Oryza sativa
accgtagacggtaagctacgattctggattagtggtaccgtcgtacttctctattccagtcggcttgaagccggctggccaatccactcgacgcagatcgtcggtgaaggctgctactccgtcaaggtcgtcgtcgtggcggttcggcgaatgatgatggcctcgagctgctcggcgctgtatgattgtgtcgcgaagatcgacggggcggcgacgaggtggtgagcgaggccgttccactcggcgctccctatattggtcgggaggtgagtgaatggaccgctcgtcgtgacccctgctcctgcgattagatcctgcgccggtgatgctgaggcttggatgacggtagtcatgagatcggaagtgagggactcggctaccagtcggcgtgtggacgctttcggagttaactgggactgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggcgtcccttcaacatcttgctggccgatgagatcacgcgcccggcgccctgcttccaaagctcgctgccgtcgatcttcagcctccttcgcggtccgctcacgctcctgctgctcacgccgtaatcgttcttgttcttgtgcttgatgctcctcttccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccggatcgtggtagcgagagctaaactcgtcgtactccacgatgttggtggggcgcgagtcgacggtgggagagctgtagtcgccatctagctgatccgtcgaaaccgtgccgagtggttggaggatgacgccaacttccctgaagctaggcgaaatcagtgttgaagccgacttccgcctaggcctacgggaagaagacgctgtcgcgatggagacggccaccaaatcgtcggggagcttcatcaggactggtgggtaagccccatcatcttgatctggtgtcgttggagaagatgcgatctcggccgagtggtttgaagccgactcggttgagatggttttgaagtagctttcagccgcgttcgggaatccaaacgggactgaaagccggttctctcccgactggtttgattccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctaggaaagtgtatgggtttggagac

SEQ ID NO: 24907 - DNA, 348 bp, Oryza sativa
cactacgagaaagaattttaaaaaatatgctaaaaatgtctcaaaagtttctctagagtaaaagtgttctaggcatttttaaaatgtctctaaaatgtgtctctacttttcaaactcttgattttagagggacctctacaaaagtgcctctacatgagtttcttttggaagtaacaagattgggagtatgttctttactactaataaggaaccatattagattttttgtagaaaattatcactttgcgttattatcaccttgatggttgggcccatcatgcctttgtaaagatcgtcatctggagtacaggccgtcatacttcagcaacaccgccgtggtctccacca

SEQ ID NO: 24908 - DNA, 1501 bp, Oryza sativa; identical to SEQ ID NO: 24882

SEQ ID NO: 24909 - DNA, 1501 bp, Oryza sativa
cacaagattattgtgccgattgtgaaaatgctgatcaaggaacttctctgctcggaaggctttcttgcagaaaccacagcgccattcatttatatcaaagtgaatcttatgctgctcctgttcccgaaacatgtcattaccaggatgaagtctacatttgcttgggagttcatatttctctttttccacaaagggcatcaaatactgcatagaaaggaaatgttaatctgtcatattattatagaggcaccaatgcactgggcattttcatgttacacatgctttacctcatcaatagctttccaagctgcacggcttctttcccttgagcaatgcacttgatttgtgtgttcatgtgacataagaagagttctagaatcaagttaaaaggacagagggtcatgagtcaagcaagagcgtttccaatttccattaaggctccaaggaatgaactactttaggaattaagaggacctaatctccgcaaggatcttgcttgtagtgtcatgccttgaaaaggcaaggtacaattttgggagggactaggtgagggtcttattttagaatttagactggcatgtataaaataaaacattaaataacatatttccctccatatgagtttgtgagcttaagtacctggatccagcagcttcatgaaattcctatagcacaaaaggaatattcagattagctagaataagggaattaggtgttcatcttaaaatcaaagagaattttctagtagatatagcagcaaattgtaatttgcactgtaacaaagtaaagatttacttatttcgtgtttatcatgagaagcatgcatattcatatcctgaaatgtcatttgcttatcagctaatacaaataacagtgtgctgctttctaatagaatgtagccattgcaagtatatgcaacaactcaaaggaagtgatgattgaacataggatggtatatcaaataattgatggcagtacgctgcacacctaccataagaacttaacttcacataaaaaacatgcctactcaacatgcacaccattagtatcaacattttactgaaataactagtagcagggacaccagagaaacgtttacatgcaacagctctcctttttgttttgcataaaaatactactataataaattaccacggcgaatttccatctcacaatcaatcgttgcaagaaaccacgacggacatcacaaagcaaattatacaaggaaaacaagtcaggtaagcaaatcatatcaacataggcaagcttgcaatgttccctttaggcatgaagcaagacaaagaacaaatctgcagatagactagctgatgcggacccaacgccaattaattctcttaatggaatgaatgacaccgtctcacgtaatgctcacaagttgagcccaagctcagaatgttgaatcatttcatttatacttatcaaatcaaagtaacctaaagcttaattctacatacaaaagaaaaaacacctcttctgcacc

SEQ ID NO: 24910 - DNA, 1501 bp, Oryza sativa
ttcgtctcgcagtttacaggcggaatctgtaatttgttttgttattagtctacgtttaatacttcaaatgtgtttccttatacttcaaaaactttacatccctagaactaaacacaccctaacttaagacatgagaagctcaacggaaaaagcagataaaagcatggaatccaggctgtagaccatcacccccacctccccaccatcgaaacaaacctctctctccaccgtcggggtcaccgtcgctctggatccgtgccgccaccgtcgccctcggcgctccgtctccttgtcgccggccggaagtggagggcgccgacgagctctcacgccggatcctcgctgccaccgtcgtcctccgagccctcgttgctggctgggagtggagggccccagaagctctcgcgctgctgccgtcgccctccgagccctcgttgcctcccgggagaggaggggccccgatgagctcccgcgccgccgccgtcgcccgtcgagcgctcgtcgccggcaaggagaggaggggtctcggcgagttcttgcgcctccgccgtcgccctccgagccgctgtttgggaggaggttggggagccgccgtcctttgttggagctcgctgtgctgccagccgtcatcgagttgtggtggttggggaatagagagaatgatggaaggggagaaattgtatccttgtttctgaaattgagggtgtttagtgctaaattttatacgttatgtagtttaaaaacatgtgaggactaaaatagaagatggcaaaagctgacatgaaaagctaagaacacccttagggcgttcacaatgcgccgatgtggcgttcagcctccctccccaaaaccaaatatttgttgccacatcgtccatccgcgtggcctcctcaagaacgcggagtaagttttggctacgagttcctcatctcaggcggcgggacccacacgtaccagaggagagaggggagaggagcgatgatgagggaagatgcagtggccagagtgaggaggggagatgcagcggcgtgaagccatccccaaccatgccactgtcgtcgcacgcgtgcagtactcgaactcggccactgccatcatcactcggtggtatgctcacccgagcgcaatggcatggagtgcagctccggcctccgggcacgatggcggggatgacaaacaaaggcgaaagacgtgcgccatggcggcaagggagggcctggagatggagacggcggcgccctgcattggtgtaaacggaaggagacgaatgagctgtaaatttgacgggagtaggggtgaaaacggtacggaatatttccggattccgggtaggttttcgaaaacggaatcggccgatcggaatttttcagaaacggaaacgaatacgaaaatattttctcggaaacggaatcgaaaatgataagagcagtttccgtcggaactcggaatcggccagaaactttccgaaaattctctcggaatttcgaagttacaaagtcca

SEQ ID NO: 24911 - DNA, 962 bp, Oryza sativa
gtaggaaagttttgatgtgatggaaaagttggaagtttgaagaaaaagtttagaactaaactcggccaaagtttgaatctaaacaagggccgagtttacttccaaactattttaacttttttcttcaaacttctaacttttccgttacatcgaactttcctacacacataaacttctaacttttccatcacatcgttctaatttcttcaaactttcaattttggcgtggaactaaataaaagctaaggtaaactaataagttttaaaacaggatcaaaactaatagaccatggctgtgtttaggccgactttagttccaaaatttttcttcaaacctccaacttttccatcacatcaaaactttcctacacacgtaaacttccaacttttccatcacatcgttccaatttcaacgaaacttccaaatttggcgtgaactaaacacacccttagatccacgctaatattggaagcctgaagaaattggaacgatgtgacgaaaaagttgaaagtttgaagaaaaaacttttccgtcacatcgaactttcctacacacacaaacttttaacttttccgtaacattggccgagtttagttcccaactttttcttcaaactttcaacttttccatcacatcaaaactttcctacacacataaacttcaacttttttcttcaaacttccaattttagtcaaacttccattttggcgtggaactaaacatagcctatgtttcgtgaaaaccttaggtcacatacactaggaaccctatccatgtcccagatctggccgccaccctctgcctgctcgagtccatcgccacttcaacgactcaggccacgccggtgcggcatcccgtcctccgtcccatgtttccactctcctcatctcatcctccccgctgcttccttgccaccgtcgtctacaccggggtaccgcgccgcgccatgcgaccgtcgcca

SEQ ID NO: 24912 - DNA, 362 bp, Oryza sativa
acagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgtttaatttttacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttccccccaacctcaga

SEQ ID NO: 24913 - DNA, 1501 bp, Oryza sativa
atgtcaactaaaacatggtaacggtgggttgtgagcacatggttttgatggtcgtgctcatgacaattaaggaccggttcacaattttcggttgtgaaacattaaccgtgccaaccacaagccagcgtgggcaacagctttaccttttgtatagtgtggttcattgtggggcaccagactgagaagtggcggagataagcctacgggggtcgctggggagtccatggtgcactactttgaattgtgttatgcggagggtattgtcacaatctctattcgggtacttgtcaagtatcgcgacgcatggttgacatgatgttgaggttgtgtcttgtgggtatagtggtacacctctagccagagtaaaaactatccgaatagccgtgcccgcagttatgggcgggtctaacaatgtctttcgtgattagtctcacacctctcaccataataaatgatgctgtaattggtaataacttgcttagctcctggtttggagatagaactgtgcagccgggaatggttgtctagaaatgttgggcctatgcaacgggtatgttgtgtagcgttgaattaatattgtttaattaaatactttactgtttttctaaattctgaagtatttattgaatgccatttatgcaaatgagactatattatgccatcctttattatcccctgcacttgcatatttgctgcgtggcttgttgagtatgtcatatactcatcttgcaatcattcatcagagaaggagttctacagtgatgctgaaggtgtggaggattaggcgtagccctggtcaagctgcttgtgggatggagtcgcctgtgctctttattttattttccgctgcttagatctttattgtttgagaggaactatccatctctgtaatgactttttattcgcctcttaattagattaataattgcactctattatcaatttgttattgtgtgcctcagctgattcctggacgagggtttacacacatgtaagcgtttggagttttggatagaaattccgggcgtgacaagttggtatcagagcctccttaaccctaggttatgccaaatggttacctatagaagccctctaaaaatattgaaaaagtagaattattctcctctctttctcttttaattaaaccaagctaatggcacatgcagattatagtctcttcaattgttctcattcaaaatttactcattattcctgtgttgttggtattgtacatctattactgtactaatggcccatttaccagcaaaagttttacaacattatttattttcattcaatcatgttgaaatatcataaacttagcatgttgattttataacactcttttattttatgtcttttgaaacctgttattcaaaagtgcaaaatttgtgatcctgttttcaactgtttcaacttatcttgcaagattagtttactttatttacctttcactttgattttctgactttattcaatttaatccaaaaacttgtgctat

SEQ ID NO: 24914 - DNA, 1501 bp, Oryza sativa
tttcatgtgctttctttttctaaaaagaaaaaaattcttttggaaaaaaaaatagaaggagggaacggaatggatatgaaaaaataaataaagttatgctctcacaagcatgagcatgatgttgaaaaaaaagtgtagccatgccctctcctaatcaataaaagaaggatttttaggagaagaaagtaagcacaaaggagaagcattttctttattttccttcataaaccatttccaccttatatcacacaatttgcacgatcttgatcttgagtatgtttagttatctgctttagtctaagtttttgacttagtaataaatgtgaatgcaagtatgccatgtttgatccctaccgggctccacatatcaaaccttagagtaggaatcaaaaaggcaaaattggtgaggaattcatattgatacacttagagaaactgagtgaatcatttgaggaacttggctttctttgcaaattcatttgaaaacttccggaatgaaagttgaataaagattgggtaattggtgctctaattgctgttatgtttttcaaccgcccaaggcaaggagaagcagtgtctcatgggaatcaggggtaagggtaagccaccgtgccaaagattatttaatctgagagatagtacatataccttggacctgtacctttgagatatacagcatagtagcaactcctgatcaacaaccaagtttttatttccttttgtccttcactcgggacgagcaaaagttcaagcttggggggttttgttgacgatcgttatcgatcagtttcgaccgtcaatattaccaaaatagaggaaaactagtgatgcttgcaatgcatatacatgttagaataataatattccactagtattaggtttactaaccttttgcagagaataaccataaagtggaggagaatcgacatcaactcagatgataaatcaatcggacgatgtcgacgatcagacttatgtatgaatgggccaagaactcagaattgacactaattgggccgaaattcacaagtctacgaagtgaagcaatggaggaggccgccaaccaaaacttgagcttgttgggccggcccctggttcggccgaacgaggggattcggctgaacctcccgtggcgccgatgaatgcagggttttgatggacggctgggattgatccccaatgacggttggagggtattaccgaccattccaaccgtcacaaccgtcattacctgcctataaaagaagttaccattctcacttcacacacacacctcaagcaagagctctctcccattctctcaagttagtttagtgttattatgctaatggaataggaataaagtagaaatcgggagtccggaagcctttggaagagtggggattcggccgaacctcccgtggcgccgatggatgcagggctttgatggacggctgggattgatccccaatgacggttggagggtattaccgaccattccaactgtcacaaccgtcattac

SEQ ID NO: 24915 - DNA, 271 bp, Oryza sativa
tgaaagctaattgtgattttcacttctatatatgtttgatatctcctcgctcgttagctgtctctcatatagaagggataaggagatcggcgagctgaagctgtatcactttctctccagttgcatcggcagataaaataataagatcgatcgcctgaaactgttgcggaccacctccacacaggtggaagcgtcgagacctccacagccgcactccaagcccaccgtgtccattctgttgacgaagccagttatgccttccgcctaaaca

SEQ ID NO: 24916 - DNA, 322 bp, Oryza sativa
ggtagggtggaagaccagggaagaaagcctatattataggggggtcgttaattattttacctttttagtgttgactaggttagcacgtatgcgccacacaaccgcttcagattgagttaggggttactcgttggtttagagagtttgggatatcaaatatcctgttttgttgtttaagttggcaatttcagcccttcgcaataggttaggagtaatttagattttttttccatctacataaatagaacctaccaaaatttattttccaatctttcttggagtgacatttatttgataccagtgcttacaatcaaaaggaaaa

SEQ ID NO: 24917 - DNA, 306 bp, Oryza sativa
ctatcatatttgactattctttttctgtggggagatttaccaggggccatatgttgtgcatacaacatttctttgtatgtagaccaactaataaatatcactgaaaattctagaaacaactatacatattcttccaataatattacatatatttctaaagccctcacctcaaattcattatattttagccctaaaaaaatctaatagtttaaagagtataaaattgtcggaattttttctttcttgctccctatgtacgatgaatttgaatatgagacactcacatatatgggtgtaatcgtcagg

SEQ ID NO: 24918 - DNA, 1501 bp, Oryza sativa
attaaatggtctgattataattttgttaagtactttgagtgttcaagtattttcaagatttttcttggaattatttgagcataggaagtatttttaacaattcaaagatcatttcagtgattaatttaattggaaaagtatttaaaatccccttctccttttcgggccgaaataggaaaagttcagcttcagtcctcggcccattctcccattttttcggctggccttatccctcctccaaagtctgctttgtgtccctctttcaatcgggccaagaagtagaagcccagccgaaagtctagttggcctccctgcgctactgttcatcttccagctctggacagagcccgagccagccgagcctgtgcacagtgccgccttcttccaccaaatccggcctcctcgttgctcctctttccaaattagttgcgggaatggaatcctctcaatctcctcttccttttccccaagaaatccccaaaattttatatggaaatcctttccaatttcgcggttcaacctttcctttttccggcgaaccctacctaatccgtcgccgattccatccgttcccgagtcgttctctccctcttctggctatataaaggaccccctagtcctcctctttcgtttgccccctctcccgtggtctcccgtgcctcgtagcgccgccaccacgtgctccaccccgccgtcgtcgccggcgccgctccagccgccgtgcgccgtcgccccggccgtcgccggtcagtgccgtcgcctccctcagcttcgcaagggtgagagctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccaaaatccaccggagctccatcgtcgccgtcaaccctgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaa

SEQ ID NO: 24919 - DNA, 159 bp, Oryza sativa
aggatgggaaactagggttcactattgtgctgggctcgcatggatattgccgatgataccattgttgtgggcaggacatggaatatcctaagcattattccaatggaccactactttccacccccacgccaacattcttgggacttgtggttttttagc

SEQ ID NO: 24920 - DNA, 1501 bp, Oryza sativa
catagctgactttctcttggaagaactcctcatcagcggggtccatctcatcttcttcagccattggggggggaattatttatatagagcaagggtgagtacaggagtactcagcaagtcatgggaattatgtatttaatgaaggcttcaaaggaaaggctgttgtttttacaattgatttttggttaaactgctttttaaaacaactaagtgagtgcttctcaaacgacacggatgagacagtgcatctcgtccggtcggagtatgtgcaatgtatcagtctttgattgattcaagattggcacccggccacaactttcaaacggccacccgggcctagctgatcccgtcagctacagatgttccaaacatcgaactcaaattcccaacagcaatttcacaaagcagtagtcgaacaaaactacgctaaggaatcaccttacatccacccatgaccgtgggcacggctgttcgaacagtttaataacctctgcagagggggcacactttacccacacgacattactaacccggatcacccagcccgtggagaacagccacacctggtgaccttaaggctttcatgacaaggcatttcgagagccgacacaggtttaccatatgccgacgagaggggtcccagaccaacaacaggttaggtcccagaccataatgtgccaggaagcccaggggtcctccccgacaccaccctgtgaatccacttgtctcccggtatcaaggctcccctgattagctaattactcagccaggggtgtcccattccacccatgtggtcgtacttgctatatgtttagatgaaattccaaaggaatcggtccttaagtgcaagagcgggaaaccgtgctcccggcacgtcccccggtctgcgatttttggaaattcatttagttcgcaagcaccgacccaggcgtcgggtttttccaagtcttttgtaaaacccaagttttaccaatcgttggatattttaaatttgaggggaggactccgacgtgcgtgcccgaaggcccgtacatcgaagtacaacagtcgacaaaggaggtttaagtgttcaataattcaaggagggtaattgccgcaattaggattggggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcacactccgggtcttcgggctccgaagctacacgtgaacgagacgactcaacaaacggtgaaattaaagccctattattgtcctctaagcgtgccattgggtagatctcgagatttgaggatttttggaagttgaacggagtcaaacagatgtacggttgagaaaatattgaatttctaagattattggatttttggtctaaaggaaaaaggatttaattaaacccgttgaaa

SEQ ID NO: 24921 - DNA, 1501 bp, Oryza sativa
ggccatttagaactggtcaagccaaaattccatcttcccaagaaaccaaaaaactaaagcaccgggtggtaatatatagttatgaagtactgagagagcgagaacacaagtagccgatcaaacacttcagagtccgccagtccggcgaccccatgccggcgacggtgaggccatatatctttccggtgaccacatcagctcatcgacttagtgtcatcaggtcaggagatcttgtcaacctctgaactgaccacagcttcttgctggcttcactcctccctttccaatccaagaaacatgtctcctggaaatctcttcgccgacttcacggtgctggtggtcgtggtgctcgcagttgccgcaccaccggtgtccgggcagcgctccgtctatcccagtgccaacctctcgacactgtgggtcaaaaacaaagtccttgacagcgtcccatatgaagatgggttggtacgtgccatagtcctccgatcaccacaaacctccgatctctcatttgccgcagggttcttctgcaccccaccctgccaagaattcatcttcgcagtcttcattttccctgacacagattctttcccggtaaataaaatggcacgggttgtctggtgtgccaaccaggcaagccctgtaggagagaatgctacccttgagctgactggagatggcgacctggtcctccgtgaaaaagccaatggcagactcatctggtcgagcggcacttcagaccaatccgtgcgacgcatggagatcactgagcaaggcaaccttgtgctgtttggtcagaggaacatgacagtgtggcagtcatttgatcatcccaccgacgcattggtcccagggcagtcactgctgcagggcaagatgctcagagcaaatgcctcccccacaaattggactgagggtaagatatatataactgttctccgtgatggtgtacatggttatgttgaatccacaccaccacaactatactttaagcatgagctgagcagaaacatgagccagagagatccaacaaggattacctttacaaatggcagcctcagcatctttttgcagtccacacatccaggaaatccagatgaaagtatccaattccaagaagctaagtccacccagtacataaggttagagtctgatgggcacttgaggctgtttgagtggtctcgtggagaaccaagctggatcatggtgtctgatgtaatgaaggaattcctacatgttgatgattgtgctttcccaacagtgtgcggggagtacgggatatgcacaagtgggcaatgcatctgtccctttcagagtaattctagttcacgttacttccagctagttgacgagcggaagactaatcttggttgtgcaccagtgacaccagtatcttgtcaagaaatcaaaaatcatcagctcttgactcttactgatgtttcttactttgatatgagccaaatcatcatgaatgcaaaaaatagagatgactgcaagcaag

SEQ ID NO: 24922 - DNA, 804 bp, Oryza sativa
cggctcggggcacgaggcgcgtgcggcagaggacgaggcaagggctagggacgctctcgaacacctagcgcgcaatgaatagtgccagattccaattaaccctattttagcctatttcctatataaattttattctataaatcctaatttttgcataaatgaagtttactcagtatttgtgttattctaaccaatagattcaccctagattaatattacccatattatatttctatataatttatttgaatccttaattagggctaactcttattccaacgcacttaaatttaattgatactaatatggtcgcgataatatttttatttatttctatcctcacctaatatttattttaaattgtattccaattatttatttagccaaattaattttagggtttattcctaattagttattcttttattcgcgattaatgaactccaaaatcaaaatccaatgaaataggcgaataaaaccggcatgatgcaatttatttaaaaagtttttgaagatccgtatttttagagttttgattttgttggtcgcattttcagggtgttacaagttttacccgtaatgattatcgttaacaattaattgcagctggcaaagtagtactcagtgatccaacactccatgatcagttgaacagaagcacgtcaggttaaaaactcttacagtcatttaatttacttattgtaatattcgtattcaattagattcatacaaaattaattggtatcatctcttctaatgtttctttgaatttttgttcgctgatcttgttatttcttgcacagg

SEQ ID NO: 24923 - DNA, 1501 bp, Oryza sativa
tttatagtatagctgtggtggtttggatccaacataggcatataaaccatctgggagaacagtcatatacaacttactctcagtccaatttgtggtagatgtatttgctctgagcttcatgccctgcagcaatgactgcccagggaccaatacatcggttggatgatcaaatgactgccacactgtcgcattcctctgatcaaacagcaccagattgccatgctcagtgatctgcatgcctgccacggattggcctgaagtgttgctcgaccagacgagtctcccgtcgatttcacggaggacaagatcgccatctccagttaactcaagggtagcattctctcccaaaggacttgcccggttggccgaccagataacccgtgccatattgttttcctctaagggtaagccataaccgctattgaagttggcgatgaagacagcgaagaggaatgcttggcagggtggagcgcagaagaaccctgcggcaaaggaggggccatataaagtttgtgttgaccggaggatgattgcgcgcacggctgacccgtcggtgtaggtgatactgtgcgggagcaccgcggcgttgttgacctaccgcgtcgagaggttggccgtgggatagtcagggagctgcccggagacggacggtgctgcagttgcaagtaccactgcaaccactgccatcgtcgtcacgtctaagcaaaagagatttgctggacgcatggtgcttgaattgcagaggggactgcaagaagaatctcttcttaatttggttacatacaagaagccaggcagcaaggagctgtggacattggagaggctggcaaagatgtcctgacctgaatcctgatgatactgaatctatgaactgatgtgctctccggaaagatggcctcgtcgtcgcaggcagagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctgtctcgtcgatttttcatcctaaaaagaaaaaaaagagaagtcgtgccgattatattcaagcattcttagtcgaaaaaagattatattcaagcattgtcagagtagatattggcatggtaggcatggtagtaagaagcttcataattaagcattgccacggcattccctgattcccttgtgccattttcgttctgggagagcatgacaaatagtagctagctaatgaggtaagatcagttagaaaacacctgaataatattggttaatgtaaaatttacatgttcggagagggacggataatttgcttatacttcaatatgtactcccttcatgcgtaagctctcctatatacatgagtgct

SEQ ID NO: 24924 - DNA, 1501 bp, Oryza sativa
ttgcgcgcacggctgacccgtcggtgtaggtgatactgtgcgggagcaccgcggcgttgttgacctaccgcgtcgagaggttggccgtgggatagtcagggagctgcccggagacggacggtgctgcagttgcaagtaccactgcaaccactgccatcgtcgtcacgtctaagcaaaagagatttgctggacgcatggtgcttgaattgcagaggggactgcaagaagaatctcttcttaatttggttacatacaagaagccaggcagcaaggagctgtggacattggagaggctggcaaagatgtcctgacctgaatcctgatgatactgaatctatgaactgatgtgctctccggaaagatggcctcgtcgtcgcaggcagagggtggccggattccgaagtggtcaactactaagtcttctctctctctgtctgaatacaagccaaaagactaccagtcttcctggtgctttaatttggtttaggttctcttgggaagatggattggcttgaccacttcaaaaaggctaatacttggcattgccgacattgccatgtgatcgattttgcgtgtcaatgtcaatatcgaacaagtttcctttgtgctgtctcgtcgatttttcatcctaaaaagaaaaaaaagagaagtcgtgccgattatattcaagcattcttagtcgaaaaaagattatattcaagcattgtcagagtagatattggcatggtaggcatggtagtaagaagcttcataattaagcattgccacggcattccctgattcccttgtgccattttcgttctgggagagcatgacaaatagtagctagctaatgaggtaagatcagttagaaaacacctgaataatattggttaatgtaaaatttacatgttcggagagggacggataatttgcttatacttcaatatgtactcccttcatgcgtaagctctcctatatacatgagtgcttattattattattattattattattattattattattattattattattattattattattattattattattattattattattattattattattattattattattattattattattattattattattattattattattattattattattattattattcagattagtaaaatgtccatacgagtaaagtgaatttaattacctaaagagactagtctccgacgttcgaaatttttgctagcgtctattgagttcctctagctgtcataatttcctttgtggaggatcctgtttgcgagtaaatgcttgtatatctgaagacaatattttctcctctatcatccagccagtgaataacaagtgcattctgcaagtaagggcccttttaaatattaggaaggtaaaaaacagagaaatagaaaaaacatgggtcctcttaaatagcaggaatagaaaaaacagggaatagaaaaaacagaggagtagaaaaaacatgggattctaatagaaatgcaagtgtagg

SEQ ID NO: 24925 - DNA, 1501 bp, Oryza sativa
atctgttatacttactagttccagaccatacatttcatggaatgtattattttttttaattttaaataaactaacgaatctaaattggttacaaatgacatatcgtatttaacataaatttaatatattattttgaataaaagaactatttctatctcatcgttgattttggaagcatagtccaagggcattcatattgcaatattcttgaccatattttttttatttgctatgtatatgtatatgataatatcttttttcgtattatgggtattcgtatttgtttttagttttttttaaaaaatatgaaaatgagtataataaagctgatgtccatctgtatttgagccattttcatctgtagctatcaatgtactaaatagatatatgctctgaaatcaaccaaggaacgggagcaggttggccagcctgcagattaccatatatggacatggagggatgggagccatggattataaccaagaggtatatggtatgagagctgctacagcccgggattccgtcaaaacgggatatcacgacttcatattccgacttcctcccacactacgtacatgcacgagtcgcgagctatatctcgatcgcgttggcgcttctctcgtagtatcacactgcggccgaagaggtgcgcatcgtgccactatacgagcagcacatcgaggacgtcgagtccgctacgccactgcgctcatgcgccgtgaacaaccaattaatccatgtctctctcgctggtgctggcgccggccggcagcgtcaatggaactagcagttccgtgggcgccgccgccggccagcgtagtctcgacaacgggaaatctatacgcatccatcatctctaaagctttgcatgtgctagtgttcctctctctctctctctctctctctctctctctctctctctctctctctctctctcatatatatatatatatatatatatatatatatatatatatatatatatatatatatatatatatatatatatatatatatccatggacactttatgatatggttgtgtctatatatgtgctaatacctgataccgacatataccaggtctggtatctatatatattgggactgataactaggtactatgtatcgggtatcacacctgataggctgatacctatagatatcgggtctaatcattgttagtaccaggtaccatatatgatacctatcaatcaagttagatacctatcgatatcgggcctaatcattgttaatatcaggtaccatacatgatacctaccaatcaagtctgatacgtattagtatcagacctgatcattgttggtactaggtactagacatgatacctatcgattaagcctgaaacttgtcagtatcagatctaatatgtatcagacatgatacctaccaatcttgatacttattggtatcgggtctgatacgtatcggtaagggggctgctatataacggtatctcgttttcgaacgagatgatccc

SEQ ID NO: 24926 - DNA, 1501 bp, Oryza sativa
gagattacaaaatatgtctatatcggacacgattcttatctctaacaaactctaaaataccataagtctttgtggcagacttttgcccaaacatatctctaaggaaattacataaaatatcctaattaatagatacaattgccttcttaggactctatccatgcacgacaatcctcatgaagctcgttaacctaacccgacaacgtatatcgtgctacattgtcagattcaactcaattggctaaccctatccaactcggactctgccgatcctgatcgtagccgattcggatttcagctgactttactctgtttccgggacgatctctatctcgaactccgtttcgattccttcttcatctccgatacttagattaccaaatttggtcgttaacagcgctacacgagaaaatggacatttggtcattctcgaaacgcggtttcgctaaaatgccatccaaaaacacgattcgttaaaatgccaatatggaccacgtgaccacatctactttgccattttctccattttcgatttcattttcgctaaaatgtgccttgatgagatgatattgccccttcggttggatgttgaaaaccgttgtgcatcgagctggttgagccatttcagctagttgctggcttctctgcccgtcggtaagtgccgccaccaccgtcacctgcatcgccggtccattgttgtgtgaaatactatagtactgaaatgtgcatgcacgggtgcactagccacaagaacactaacacgcatcagagctgaagatagaagtaggagaagtttttcattgttcatctactaaaagatgtttaaatagcaagaattgaacagagcaagacgatgatgtgcgttacgagtaaatacaaagttcatggcaaagatggaacaaattagcagggaaatcacccaaaaaaaaaatgcaagggaagaacaaacaacagaaaaaaaataaatagaaagagaggaggaggaaaaacaaaatggcagcattaacatctctctgcccttgttcaatctccaagaactcaacgttacatacaccaacccatcgaagccgaagcctgcgtgattgatcttctcagcaatgtccttcttggctgcagtattgtcgatggctcttgctccagctaggtagcagctaaaccttgtccgtgcagcaatggcgacgcagccgggaagaacaagcttgggtggcagccaccgcaccggctccggcatgtcggcggcgacgaccctggccggactagccttcgtcgccccgccaccaccaccgccactgccgattcccagctggagtagtacgcctcatccgctaccgcaccgccgctgtcgcccgtcgccgcccctcttgctcgccgaactgcacgcccctgcaaacacaacggtacgcgagcgcgtcagaacaagcctggaatgcgaagaaaccaacatcgagtttctcgcaccggtgtggcgaccataccgagtgaagttgagaggagaaagacg

SEQ ID NO: 24927 - DNA, 1501 bp, Oryza sativa
taacattgaagcaatcagatccgtagtcatgcatatctaaagtagggaaaatactaaagtttttcctcaccatattgcgccacgtcatcaagtaaatactgaccatctgatgaaagaaagatttattccgagccgttggatctggatgagtctgaataaaggaggctcagtaaaatactattgtcgctcccatctctcagtcaatcaaaggagaggcttcagaaagcttcccccatctccccgtcactcccgtccttgctgctaggcgctaactcccaccggccattcctcccaatctcttctcccaccggccaccattcctagcaaaccattgccgacgcaaggagaagtggactcttctagaagcttctgaacggaaggatctagagtttttgtcaaattccacacgtaagttacgtagatacgtagtacagttcttcaataggagaactaggcaactagcagaagagaattgagaaaactgacgaaaaaaaacgcaacgcttccttgatcttcaccacaccaactcaccatctccctattgggaccaagtcagtgcaggcagcacaagatagaagccctcgatgcgctaccatgctgctggccgccgaaaactcatctttagaaaagatcgacgaaagggggctaggttgaggagatcactcctcactcctcagtgaagccagcctcatccttcagacattctcctccttttcagtgcaaatccacggcagcaaaggtcgagctacaggctacctatagcagagacgaaggggacaagatgcggtcctactcgtggagtcgtggttggtctgtgtatcccagaacccagagtcagatgcaaaagggaaacaatgaataaatgagtagggacgataatgatgaggactggacggttaaattttttttgactgtaggaaaacgtctagggctagattggtttgagatctaaattaatcttaccaatttttataatttcaataatatttagtgtttatttggtttgaaattaaattttagcatgccttaaaaaaaggccatttcaatagttaacttaggttattttgatttcgattcaaacacaattttagcttgccaaaatttggcatgacaaaaattgataaaacctcaaacagcccgtagtgcatccatcatcagcatgtcctgtacatatgtgaccctgttaaatgcagagaaaaaggctataggcaggatgtgtgttttaatatgcatatgtaaatagtgtagcaagtattcttttaaataaataatttagttaagtacttatatgcatatgtactaattactccctttattctaaaatgtacttagatacagtgttacctttttacacaatcttttaacattatactttttttagggaaattttaacattatactttaactactactaatttctttcgtttattatcgataactacgaaatcaacgttacataaaaagatttaaatagaaacctgacggcactcccttatcatat

SEQ ID NO: 24928 - DNA, 1501 bp, Oryza sativa
aaaataaaagaagaaataaaaagaaacaagaaaaacactaatcaatcaaaaggtcttaggccgataatctcgcaatgtttgttgctccacatattctccatagcttgacttcatcatgaatcttgtctagtagctgctgcagggttttttcttgattttgaaatactcttatgttccgatcacaccatatttcccatgctaccaacatgtggattgatttttttgccttagctttttccttcccaccttgagatgttctcctaatccaccagttcaacagcgattcattttcatcatgtgtcaggtcaatttcattgcagttcagcctccctaggaccctctcccaaacctgccgcacaaaaggacaatccttgaagagatgttgagttgtttctaggttcctgtatcatagttaacagaaatagttgtttggccattgtctgatctgcagccgatccgttgtccaaatcctattttgtagtaacagccaggcaaagtgtttgcatttggagggagcccattgcttccagattagttttgctgcagctgagcttatccttccgttgaattgtgctatataggctgatctcgcactatatttcccattgctcgtccatctccaagttatggtatcatcaacaccttccatttattgtaaagttatacttctgaaaccccttttaattataaaaacatgcagtagaaattttattctttacctatgaaaaaaaaccccttacatggacagatgaaagagtgaaattttgtaataaatggacatgtacatgtagttatttttaatatataaaccactagagtctgtacaagcagtcaggatcgaatggaaactttgaccaagatcccacaatcatattggtgtgatactgtgatcataccaactggaaaaatctacatatgaactgatccttacaaccaatttaagatctggaacgcgtgaattggaaattaaacaatacagttcgtcagttcccgtgtttccttaccagccttactaccgtaccaatacctgctcttgaattgccttctttatatgcaaggacaatgcctcaattgtttttactgaaagggacaacgcctgaattgaattgttaatgttgatgatatcagcaatttggtacatggaaacgactaccatttgtcggcacggctaattattgacccccccccctccccccccaaagagaaatggtcaagtcaatctgtcttcacagataaaccaaaaccataataatctagcccagcttggtgtgaagtgtgaacttactgagagatcaagaagacaagtagctgaccactgcagactccagagtccggtgaccttggcgatggtgagaccattttgccggtcaccgcatcagctccaccattgccatgctgacatcaggtgagaactgacaacatcttctctcatctctggcagaaatgccccaagtttcttgcttaattggttcttcatcgcattctcagttcacatccaagc

SEQ ID NO: 24929 - DNA, 1501 bp, Oryza sativa
gccgagcgcctttttcagtaggcatacctcttcgtcttctttttgccggtttattacaattccttgaggttgcaagtcatcatcccaccacttgaccaaaatggaagggcgcgagtcttcagccgcacgtatccggagaacttcctcttcatcaccaatcattggtcctaatgtatccatggataaagatcagatgatcaattaaagtcggttggattaacacggtttcaggcaaggtgtttacccgtgatgattcccgggcgaggacgagtcggctcttgtgtcttagcaggagatccaggcctcgggtcgttgctggcatcatgtccgcgagggctatcagcctgagcttcaacttctggaatctcttggcttggccctgtgtccgactggtttccagtcgggggctcctgattaactccggcttcagcttcggccgattggtttccagtcgggggttgatcaccggattctacattgtcgattgccggctgattgtcactcggatgatccttagcagtcggcccggtttccttggaagaactcgtctccatgttagtcggatcagagtccttcccagaaggatctatatcagatggtttcctacgagtttgagttgtactgtcagcgttgttttcatgataagtgagcatcagtacaaggaagaatgttatatgatttatacctggaagacttcctgatcttcggcataggatgactggatgttttcttctttggaatggcttgcttcgggagttttctggttgtttctctatctctagtcttttcagcatcgtcgccttcgtcgtcacttagcactaacttcctcttacaggaatctgactggccggctggattagaagtgttgggctgggcttcggaccggatctttggtcccccgctcccctgaccagtctgacggcgaggtgatcggcgctgagcgattgggggatccgacttcatcagagcaaaatcctagacataatatcgtccactgtcaattgatttaacaaaaagacgagatcatattttgaggaaggctgaagtgtttgagtacataccggtggaggagggttgaatgcattgtatggcacaactggcaacagatgtgaatagccgataacaatggcatttgagaagatcttgtatattctttccttcatgaccttaaagtcaagagagtctagatcttcacgatttggatcatgcttgccgtcaaactcaaaagccgtgtgggacctctctttgattggagctaaccgacttttgatgaagtgccgagtgatttgttctccctgcaaaccctgttccttcagctttagcattcgttccatcaattccactgcctgagcagcttcatctcccataggcaatgaattccatgtgtcctggtaaatccgaggaagacaggagtactcggggagtgcgggtttaggattttgaacgtaaaaccagtttgcgtgccagcctttgtttgaggtcttaaagggcatggagaaat

SEQ ID NO: 24930 - DNA, 1501 bp, Oryza sativa
caatctccctcctcgatgctccattcttctcggttcttgaggggttttgaagaggacctcaaggaggagttgatggcgcggtggcttgctccgggatggatgaggatggccggacgtcgacgatgccgaagcggcggtgctccggagcgcgctccaggacgacgatggcgcggcggtgttcccgttgctacaatggatcaaacgcgatggcgtcaaaagaaagtttgttcggcaagatgagttgagtatggaacgcaaaagggacaaggacgaccgtggcttggtgatgaatatgatcatcgtcttcatctccgccggcgatgggattgagaccaaagaggcagcccatgcttgttctctcgatgtggtcagcagtaggttggagagtgagatggggcgaccgagttgggagaagacaatagctgccgccgccgccgccactcaatatgccggcgaggccatggcgttttgtcccctgctcaccacgctcaccaggaagggtaatttcgtctcatcatctggtggaggagagaaaatgatttcgaaaatgcatggcagtgagtgcgcgtttcatattggcattttagtgaaacgcgttttcagaatggcattctagcgaaaccatattttgaaagtggctaaatgtccattttctcgtggcccacgtgggatcagatccagtcgagtacacataaatccgaaggttaacatatatcagtgataaaggcacggtgcagttactgcagagtatcttaatctgtccatgtgtgtgaaataattctgaaattctactgttcttttctttttcttggctgtgtaattttctacatttccactagttatcgtatatatgggggtgtttcgggagaacgtatgcacaccgactagtgaatcttacggaaaattatataaaatatcaaacacctatttcctatagtattatgcatatgtgtgaaattttatcttcaaattaagccgtaactttttttttaatttttgttacggctaaaatatgatgaatttgaatatgagactttgaatatatgtgcaatactattaagagcacatatgcagttttttttattgattttttcgtgatatttgctagttggtgtgtactgcacgggaaaattttgtaaagcttgcgtacatattcccgtgtttgagaaaaacataatattgagaagatacgcaaaatgaaatgaactattagctcatgattaattaagtattaattatattaaatttgaaaaataaattaatatggattttaaaaaaacttttttataattgttttttcaaaagacgcatcgtttagcattatcaaaaaatgtacgtgcggagaactagacaaatcttcactcttaaaatcatactactaaattcttgcatgtggtttcatcactagggttagcaaatgtgatgatgcattggagaattctaatatatatatatatatatatatatagacacacacacatagagagagatatcaagataa

SEQ ID NO: 24931 - DNA, 1501 bp, Oryza sativa
gctcatgacaattaaggaccggttcgcgagctactgttgtgaaacatttatcgtgccaaccacaagccagcgtgggcaacggctttatcttttgtatagcatgattcattatagtgcgccagactgagaagtggcgagaagtccgcgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgtggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaaattgatgattaattactctactgttttacttatcttaaatgttttgctaaatgctgcttttgcaaatgagcctatattatgccattctttggaatccttgtgcacttgcatatttgctgtgtggcttgttgagtatgtcatatgctcattcttgcaataatcatcaaacctcagttgaagataaaggatccagaaggagaagacgtttggcttatatcccagttgagctgcctgtgggagtggagctgaagccatcgctagaccgttaattccgctgttgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacatgcactgtggtgagttgtgttatgcagagggtattgtcacagcctctattcgggtactttccagtatcgcgaagcatggtagacatgatgttgaggctgtgtcttgtgggtacagtggtacacctctggccagagtaaaactattcgaatagccgtgcccgcggttatgggcgggttgagcaatgtttttcgtgattagtcccacacctctcaccataactatggatgttatactgggtaataatttgcttagctcctggtttggagttagatctgttcagccgggtatggttgttcagaatggttgggcctgtacagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgctgagtatgtcatatgctcaccttgcaataatcaatcaacctcagt

SEQ ID NO: 24932 - DNA, 1501 bp, Oryza sativa
ggctcctcaccgggagaccgcgcaggcccccctttgccagtccggccgggggcttagggtgaaatctcaagctctctctctctctctgtatatggaaagattgtctgccagccagaaaacacgagacaccgacgatctatacaggttcgggccgctcagaagcgtaataccctactcctgtgttttggtggatctatgtatgaatgagctacaagtgtgagctctcttctcccccgttctaagttcctaatcttgaaaagaatcaatcccctttaccccatgggcaaggtcctccttttatacttcaaggggataccacatgcacccttctctttccaaactggactgttctttttctctagaatgggcggagatcagcacggttgctgttcgaatgacactccgatgggactgcccatacctacctccacttccgccgggggtgagcgcgtcgtgggaacacggctgtgcgctgacgatatgattagtgtcagaccggtcacagatcggtcattcttgtccaccgcgtgtaatcttggcaacgtgcatgtttgcccttcttcacacaacatcttgcctgtaatggttaggatgaagcctggcatatatcgaccggggctaacgtgtcatctctaagagataacacgcttaactccggcttgagacgagtgcatagaggctttcgtcttgacgggacggggcaaggcgtgcgccagaccgccagttgccacctaacccgtgatctgaccggtctgtgactgatcacagaccggataaagggacgcgctgtactgcgctgcatgcagcgtgacgcgcttgaccagactgcaataaatgctgttaggtgagcacagctgtgctcacttatcctatatatatatggcgcagatttccttaaggggtcggggtgcctcggccctcggggccggggcaagcgcaacccgacccccccccccctcgggggaaatcaggaggagggcggacacctcaccctcgggcccgacgtccccgaaggtgccaggctacgtgggcgattgtgtctgcctcaagcctctggtcatgatactcccggtcccatatcaccgacagtgtccatagcattaaataagttgccacctaggattaaaaaaaatgatgtagcaagtgaataaatgagaaaaagaaggaaaccaggtcttgcatgagacatggtttctacacaacattcaagacatcatgtgagataagtaacattaaatttaaatatggaaaagtggtgtttgaattgaaagagtggtgtctagtactaatttcttgatgatgtggagtttatgaaaattatatctagtgttttgggttgggactggcctaagccttagtagacccaacttttagtgtagagcataggtatcaatctttactaacgtgggttccagctcatctttttagcggcacgcaaattgagatgggtcattaatgcatgattaattaagtgtcagctattataaacttaaaaaatatt

SEQ ID NO: 24933 - DNA, 1501 bp, Oryza sativa
gacggcggcgccctttgctctctcttcccctctttctctcacgggcggcggtgcgagagactaaatacacatagtagactaaatacacatcgctctcatagtatactaaatacacatcgctctcatctactttacttttttcttcacatcctcatttccctattgcaaatatattcaatacaataccccactaataatgacacattaacgggttaatatacatagaaatgatcgaactgtcgacaaccaacatttattgaaaatacaagtaatgtgcatatgtgctgaaaaatatctcatgcctttttttttacagttactatggataaatatattagccgaaggaacaatataagtttgtacctatggttttttgaaacatattactctccaaaacctagagtttcgatcatgaaacaaatgcttttttaaaatattttactccaaaatctagagtttcatgaaacaaatgctttttttaaacattttactccaaaacctagagttttatgaaacaaatggtaatacctcagattttgattttactttaccgatgcctcaaaacttaggatttattaaatttactctatcttttatttggtgtatggtgtgctttcatggacaatgtgtcagatcaacctcgtattgctcttgcatcaaaatcgaagaaaaggcatattattcaaaagctaattcaatcaataatccaagtggtgcttggtgtgtaattattaaatccttctagctcaggaatccattgaagatttccagatgtagttgcactatagattcgcaaaacaaaagtttcaagatcgattaatatatatatacttcctccatttcatccattttatattataagactttctagcactgcccacattcatatatatgttaatgaatctagacatatatgtgtgtctagatttattaatatctatatgaatatggacaatgttaaaaaaatcttataacctcaaatggaggtagtatagtatctttttgtgccaatgttatggtgttagtgagttcgtcttttgttccaagagagcagagagccacacatcaattatttcttgctatatagtggattatacatgcagcaaagtgttatctagcttttagatctttttcgtagcatgcacgattgcacggtgtcttttaggagatgagtggaaaaaaagagagatctcatatgacctgggattattcacgaatcattatttttctttgccctttacgaaaagtttgttctccccaatgtggttagtacttcacctcctcattttggtaaagttttaggtcggctcattaggacgaataaaacaaaaaaaaaccttaggtttaatttctttctggcatgcatgttaattgacccaattgacaaagattaagagcatcttcaacagcatatctaaatcggactctccaaacacccacatagctaactttccatctgatttggctagtcaaactagttactcgctccaacagcctcacc

SEQ ID NO: 24934 - DNA, 1501 bp, Oryza sativa
gtatgcagtgatggagtcttgtccaccaagatggattaggagaacgggagcccacaccacttccaggatgctgctattgccctgttctgtagaatcttcgttcttgtggcggttgaagagggtggccagggcataaatcgccatggcgtcgctgccaaggtaagcaagccatactataaatctgaaccggggataagtaatatgcttacgcctgttagcagtaaggaaaaggagcagttgaatgattgtgctggcaatgacgaggatgcgcagctgcgactcctgccaccattcaatggcacttgagagacccattgatctctctccctccctacctacttagctatactatctaatatctatcaataatatcgcgctctgtagctctctagctatagctacctattaatacagggccaagaagtgtgtacaggccgtcagaggtcgactgattgtgttgaccttgattcccggctaatccaatatagggtgtgtttagttcacgctaaaattagaagtttggttaaaattagaacgatgtgatggaaaagttggaagtttatgtgtgtaggaaaattttgatgtgatggaaaagttggaagtttgttgaaaaagtttggaactaatcaaggctacctattaatacagggccaagaagtgtgtacaggccgtcagaggtcgactgattgtgttgaccttgattcccggctaatccaatatagggtgtgtttagttcacgctaaaattagaagtttggttgaaattagaacgatgtgatgaaaaagttggaagtttatgtgtataggaaagttttgatgtgatgaaaaagttaaaagtttgttgaaaaagtttggaactaaacaaggccataagtaagccatagtccggagtccgagcgatagctgcagctacgttatcacatgcatcaatacttaagttgcactaatgtcaattatattgctcgattccgctcgactggggcgccctagctagctaacagaatcgttcgtatattttgcttgactgtgctcttgtggacttgtttaagtcttaacatattactatttgtttatactactagaatgggttcgcgtgctacgcgcgcggcaaaaaaaaatattagagagaacaataaatattacgtgaaatattagagaaatatagcgcatacataggtgcactttgatatgtcaatgatgatttatcggttacatggtacattatttcatagagcaccaatatacataaggcacaaagagggggaaaaataattgtaataagaacccattcagacagtacagacccactataagtccatgtgcaagcttcttatcctattccaatccacaaaagaagcacaatagcatgaatggctgcctggtcatgcaaacatgaaagggttatacctatgttggaaaatataactcacataataatttctttacaaagcagtcttgattgaacagtcataacatcaaaccaaatagaatgaacataaaag

SEQ ID NO: 24935 - DNA, 1501 bp, Oryza sativa
tcaacggattcctgaatagatgtaactttcatctcccaaatagacatgtcaaaaccattcaaaaagtggcgagaaatctcagattgtgtataattaacatcataagaagaatcaacagatctaagatcactcaaaattttgttaaacctagaaagatagtcatccaaagcttctccagatttcatctcaaatttaatgtactcctttttgaaaagatctcgacgaagttctttaatgttattagttccttaatgaaaattactcaaagcaatccaaatcttatgggcagtttgaagatgagaaacacggtcataatccgaacgagaaatcccactcaaaagaatattgcgagctttgtaattttgttcaaattcagtttttaaaggagcagtattaatttgttcaggaatcacataaggatttgacttttctccgaatatcataatcctcagtcataatgtaagattgcatcctactacaccatgagaaaaatcagttccatcgaaaacatgaggcttagttgaaaacctagcagccatggcaaaaactctagaccggttaaaatccaaagaagaaaacaaagctctgataccacttataggatcgaatcacaataactaagccaaccagaggggggtgaatggttggtatacccaaaaaccgaaaacttttagcggaaataaatgttaccctcaaattcgatggattgcggtctgaccgaagtagatgcgctggtctgaccgcctaaatacctccggtctgaccgaggtagtaactcctgtctgaccgcctggatcagctcccgtcgcctgctgccaccgccggtctgaccgttgcttgccgccgatctgaccgccagtgtgatgccggttagaccgccgaaacccgatgaaacacaaatcgaagaactcttaaaatagatgacgactttattaattctctatgtgttcacaaagtgcaccaacagcactccttacaaaaaatctcgactaaactcgaagccctaactcaactatcaactcatttgctctcgaaagcgatactgggaagcctcacgctccccctctatttatacccgaggtaggcagccaaaagccatgaaccaaactcatactagaagttctaatcaccctaggaaaccctctagtacaagaaacaaactttacataaccaatcataccaaatttggactccttccaaattcgactgcgcatcccatacgcacacaatacctccatcgtatgacatatggaatcttcaccaaccacgtgcattgaactctagccttagtatcccgcatgatctctgaccaccacgtacgtcgcttatccccaagccgactcccggtccatcacctcaaatactcttcggcatctcgagtcacctacacatagaacaaacaaagaaaccatattccaagaccaagctatccccaacttgactcattagtagcaaacgacagtattacatacgcatagtatccatctagaatccttaatca

SEQ ID NO: 24936 - DNA, 1501 bp, Oryza sativa
ttatggcccccttttcactttcgcagtcctccttggcgtcctgcaacatctgaccaagatcatccgcaacgtcgttaccatcagcatccctttcctcctcgcccgtttgatttccttcaaatccaacgtactgagcaaagtccggaatattgtcatcttccacttcatcttcttccatttcaacaccttgctctccgtgggatgtccaacaattatagcttggcatgaaccccgactcaaacaagtggaaatgaattgtcctggatgcagaatactccttctgattcttacacttgttgcatggacaacaaataaaacccttatgcctgttagctttggtcactctcaaaaaataatgcacgccgtcaataaactctttggaccgccggtcagcgtacatccattgccgatccatctacatgacatgaaaaaaaatcgtacacaaataattattcttacaataatgacaatcatataataattataaaataattacgaactctttcaacagttatacaataatgacatatctttattcatttaaaaatcataaaatattacaccaaataattcttatttactatttctaatgttttaaactaatattaatgtgttttacttcttttaattttcattttagtttgttttctattatttaagattaactttcactatattttccttctcaactattttataaaaccttctttagcaaatcaactaaatttctatatattctttctttcccacacaaattttctctcttatcaacttacaactaaattttggagacaaaaaagtgtgtaaaacatagctccaaatgtaatatgacaaaaaaaaatattggaggatgaacttgcaaaccttttaggcacctccgatttgtatgtaatcatcaaaattaattcactagaaattttggcatgaccttctatcttttttgaagaaattttgaagcttgctcgggcagctggaggaggaagaagacatatatatatataggggtgggactttagtcccggttggtgttaccaaccgggactaaagatcccgggggggcctgacaggccctgacagcatttgaaccgggtaacgggcatatttgatctttagtcccggtagccccggtttttattgcatctaggactattgtggaattcggccgaccgacgaaagatatttctccaccagtgaaagtgtgagttgtacgtatcatcatggcaatatacgatacattcgatacgcggatatgtgcaaaagtttcattcgaaatagatatatccatttgttccatatgcgcgtcattagaaaaaactcatttggaaacaagtggaaatttgtggagttacgcacatgagaaaaaaaaaacatacacacacagagcaatgggaaaaatgggaattaaatcatggggcccacactggccagtgtcacgcgagaaaatggatattttgccatcctcaaaacatggtttcgttggaatgccatctaaaaaacgcaa

SEQ ID NO: 24937 - DNA, 1501 bp, Oryza sativa
aagctcttaacaattataattagatcatttaatgattaaataattactgaactgttctttgtatcatttaggaattgagctccgaaaaatccgagaaaattctagagagtataattaaccatggagaatttaataaaaattaaatccatccatgctttatatttaggaaattttatttcccacattttacttcacttgtaaattaaagaacatttaatataaattctattaataatttattaaataatttataaatcctgaaacgaaaatcagggtgtgacagtgcaccattcctggatcataatcacccccttataaaacaaggcatggactccccagcgacccccgtgggcttatctccgccacttctcagtctggtgctccgcaatgaatcatgctatacaaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaaaccatcattaaataataatgaatcataagttatcccaatagtgtgctaatgtttctaagcatggctaagcaatcatatctaatatctagctgaaccaatatataaagctcaactagtcaaattataataacccaaggtatcaaggaataaagtaatcaatgcaaacaggccataacgaaggaataggttcacaccacccagtgacattcgaaaataaatgcacagttgaaataaatagagaatttaaatatatgatcaacatgctcaaaggattgtgtttaggatctgtgtgacttgccttgcaataattgttcttcaattaatcttcttgaacacttccggcgcactcgcgaaccttcgcaacgacggaaacgacaagctaacacgcaatataaggaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattagatcggattaaaacacttatattgattttaattgaattatgacgcaataatgaattatttttgaaaaggaaaaggaggattattgcgtcagcggctagggtttcggtggaccgggtgcacggcggcggttcacgggaacggacggccgagatcaaccctatccaaaacggacggccgagatcgatcggtccacgaccggctcacgggagacggggacga

SEQ ID NO: 24938 - DNA, 883 bp, Oryza sativa
cacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggacaaatttttcgaaaacatgatttgtgaaaattttcctttcttccttctctagaattctctataaatcattttatcatcctctcccctcctgctttcaacttgagtagttctaaaactagttgttgaaactagaagatgttaatgaggtctacttatggaggtcagtcaagtggatcgaggaagaaccgaagtgccaagtggtcaagatggaatgaagtttggatcctaccttagaacctatgccgccaaagtgtctttgaagaatagttagtaggatagaacgtttgttgcttgcttgtgtgtaggtatggttgcattcccgtcattggtgtgattcaatgatgagtgtgtaactatattaggttgcttgcttaatcaacttgaacaatatattggtctacacacatcagatcagtgttaacctggttaaggtcttatctttagtgtaacctctctcctcctatcttctctaatctgcaacaga

SEQ ID NO: 24939 - DNA, 1501 bp, Oryza sativa
tgcccgatgagatctcgcgctcgtcgccctgcgtccaaggcttgttgtcgttggtcctcggcctcctttgcagcccgttcgcgttcttgttgctctcgccgcagtcgttcttgctcttgtgcttggcgctcctcttctagtcggcgtcgctcggcttcctgctgtacgcgttgtgcctctgtttctcgggcttggcgttgttcttccgtctcgttgtcggccatgaagacgccaaagtagagagggatgtaattgtcttcaaagctttcgtcgaagtcgtcgaggtcacggttgtcgtagcggtagccgaattcgtcgtactccacgatctctgttggtcgtgagtcgacgccgggggagccgaagtagccttccagttgatctgtcgaaaccgtgccgagtggccggagtatgacgccgacttccctggagctaggcaaggtcggtgttgaagccgacttccgcctaggcctacggggagaagacgcccttgtagtgaagacggcagccaagtcgtcggggagtttcatcaggattggcgagtaggccccatcatcttgatctggtggtgttgaaatagatgggatctcgtccgagtggtttgaagccgactcgatcgagataagcttggagtaaatcttggtcgagttcggaacaccgaacggggctgagacctagtccttccctgactggattgaatccgagtcaaggagagagatcttgccgaagtcgttggtgatgaagtcgaggctgccgaaccgaaacgcctgcccgggagagaagacgaggtcgtcgatgccggagacggaacccatcgcactaatcggcgaagaacttgacgctacccctacctggcgcgccaactgtcaaaacaagatttcggcaatacttaaagggggtggctatcaagctagaaaagtggatgggtttgaagacaaggaattttatacaggttcaggccttcttattcaagaagtaataccctactcctgtccgaggatgattccgccgagtatatattgatcgtatgatctggggaaaaagaagtgtcccgagaggaacccggacccctctttatatagaggaaggggtccgtattacaaaatacagtccatatccctaacggaatttatgattacagataaaatacaatcgtaaccgactaagatcccgagtatttccttgacatacaagtttagaaactaacccgagtcctcataaagatattctatctatatttggtatcgtttacccaactaaactataactgccatgtagatataggatatccataatctccacatagatgggtcccacaataaatgacattagttgtggcagatcctatatgtttatagggatagttacagataagtgggtcccatgggtaaataaaatatttctagtcccacctaccgtcaccgggctcggatccagacaagtggacgaccaaccagagtggcaacaggagcagcgagcgcacggcagacttcaatttcaa

SEQ ID NO: 24940 - DNA, 1501 bp, Oryza sativa
aaactgcagtctatcttattccataactccgataattattctaaggctttaaagaaaactactgctgctttgaaactggtggctgagctgtaacacttgaaaacgcaactcttgaagacgcaactggcactgcatttgatctcaccaccgatgtttaactgttaagactgtccttgaccagcggaagaagattcaccaatttggagtggcttgatacgctgcctctggctactaccttgtgcctcctggaatacagtcattttccttttacggttatccatcctgttcttcttgtcttcaagtcgagttgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaattgatcccaccattctgaagcagatcattgcaactgatgtgaagcgaaaacaactttctcctgatccgtgcactggagcagttccaacttcttctcaacagcgtgcaaccaatcacctgcttccactgggttggtagtgctagaaaaggtaggtggcttcacacgaagaaaatcagttaacttgttctgcggcggtggagcattgttgttcccttggttgagctggttctgcatttgctgtatcatcatattcattaactgagtctgttgagccagaacttgagcaagagttgggttcccttcattgttattgtttccacttccactggcgcgagtgttcaccatctgttgcagattagagaagataggaggagagaggttacactaaagataagaccttaaccaggttaacactgatctgatgtgtgtagaccaatatattgttcaagttgattaagcaagcaacctaatatagttacacactcatcattgaatcacaccaatgacgggaatgcaaccatacctacacacaagcaagcaacaaacgttctatcctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacaaatcatgttttcgaaaaatttgtccttaaggtttgaccatttggcttatcctacagtcgagatggctctgataccaacttg

SEQ ID NO: 24941 - DNA, 918 bp, Oryza sativa
  unsure (1)..(918): unsure at all n locations
ttttcgcccagttttttcgcccggtttttttgctcggtttttttcgtctggtctattttttttactgcgtcacatataattcctttttctatggaatcggacaattttttttaaaaaaaatcgccctttnnnnnnnnnnnnnnnnnnnncggattagtttcgatttacttttcccttttttggccccttttttttatcggacagatttgtttttttcgcctagtttgttttgatcggactttttttgcccggttttttccgctgagttttttacggacgatggaagcacctcttacggttttttttgcccagtttttttgatcggacttttttcactaggttttttccgtcggtttttttacggacgatggaagcgcctcttatttttttaaaagtagtagactaaccctttttttgccactttcttagggaatcgaacggacctttttagatgtgaattttttaagtagggacgggagtagagaaagagatgtttacaaagtttatatattaagaaataaaaaaaccaacaaaaacaaaataaaaggaaagaaaaaactgaaagaaacgaaaaattaaaaaaaaacagaaaaaccgtgcgtgggccggaataggattttttttcccgttttaagggatcggatcatttttttggctactttttctttttttttttcgaatcggatttttttttgtttttttggctattttttctccgatttttttgtttttccttttaaggggaatcggacttcttcttttcttcgctatttttttatttgtgatggacgaaggaagcatctcttattttttttttaattagtagtagattgatatctacacagtggctctattgtttctctgatttgagcctgttttaattgccttttgttaattagttttgttttcgcgtttaga

SEQ ID NO: 24942 - DNA, 1501 bp, Oryza sativa
tttagacagtaacacggtctccaaaacacaactttgacttcttgtttctataaaaaatatttattgaaaagtgatatatttctataaaaatatttattgaaaagtgatatatgtatatttttatgaaagtatttttcaagacaaaactattcatgtaatttttatattttcaaattattaatgatttatatatctaaggtttaacttaaacattgtcctaaacgacttcttttatgagtacggagggagtatactcattgaaagggcaacatcagttctgaattccgtactctttgtgcttcagaaatactgcagtttaagaactctattctacctctgtaacgagggcaaaactaaagcaatttgatgacttctgtccagctaaaatgttttttacatgccgtagtcaaaaactagttagtacagtataaatttagtatgttgcatctcaaacttttggtatcagtctctctcagggaggcaaaatgcctgtaaatttttcttggactcttcccttcaatttcactacctttgggcaaaccttcccaggacgataaaataggacagagcaatgcagcatctcaaaattcccggataagcttatgcatggttacagactgaaggtgaacatgacttgtccaaaccaaaccagtaagcttctttgtgcataaaattatctgcataaacatttgatatatcaaaaccatcatattaagagcattcaatccagtaaatagacatactgcagaacacaggacatctagcaacatcatacacatgttgaatggtcccaaacgtaggtgcagtgaattcatgtgtattacctgttgctccaaaagatccaacacagatggccatctttttccatgcttttcatgtcagctcccttatgtccttcagcaggtaggctattcctcacgctgcctgccttccagtgtagcataatcaagcatcaccagacctacataatgcacaccatcataacacaaagcaatcagtgtaacacgattttttttcacggtgaacataattcacaaagcaatcagtgtaacacgattttttcatggtgaacattattaagaaccgttgacagcaaagcacattattttacaaacagtttgccaggactgattcacagaaatagcaaaagttcaaatcacttgacaatcatcatcaacccagggcagacaaaggcaaagctgattaaatggagcacaaggtggaaaatagaatgcctggaaaaatgtaatgaatgcacccacatcaccccagtacagtctcctaaacataacataagatcaatgcaaagttaaacaaaacatcattcaggatctggttcatgttcagaagaaacaatgaaaggtcaagtgtttctttctgctgtttgaggccttcttttaaagcaaaacgaaaaggtaaaaatctataaaaggaagaaacaagcagcctttggcatgtatttcaaggaaaatggtatatcatgtatttcaagtcacgatag

SEQ ID NO: 24943 - DNA, 1501 bp, Oryza sativa
agtaaagattgatacctatgctctacactaaaagttgggtctactaaggcttaggccagtcccaacccaaaacactagatataattttcataaactccacatcatcaagaaattagtactagacaccactctttcaattcaaacaccacttttccatatttaaatttaatgttacttatctcacatgatgtcttgaatgttgtgtagaaaccatgtctcatgcaagacctggtttccttctttttctcatttattcacttgctacatcattttttttaatcctaggtggcaacttatttaatgctatggacactgtcggtgatatgggaccgggagtatcatgaccagaggcttgaggcagacacaatcgcccacgtagcctggcaccttcggggacgtcgggcccgagggtgaggtgtccgccctcctcctgatttcccccgaggggggggggggtcgggttgcgcttgccccggccccgagggccgaggcaccccgaccccttaaggaaatctgcgccatatatatataggataagtgagcacagctgtgctcacctaacagcatttattgcagtctggtcaagcgcgtcacgctgcatgcagcgcagtacagcgcgtccctttatccggtctgtgatcagtcacagaccggtcagatcacgggttaggtggcaactggcggtctggcgcacgccttgccccgtcccgtcaagacgaaagcctctatgcactcgtctcaagccggagttaagcgtgttatctcttagagatgacacgttagccccggtcgatatatgccaggcttcatcctaaccattacaggcaagatgttgtgtgaagaagggcaaacatgcacgttgccaagattacacgcggtggacaagaatgaccgatctgtgaccggtctgacactaatcatatcgtcagcgcacagccgtgttcccacgacgcgctcacccccggcggaagtggaggtaggtatgggcagtcccatcggagtgtcattcgaacagcaaccgtgctgatctccgcccattctagagaaaaagaacagtccagtttggaaagagaagggtgcatgtggtatccccttgaagtataaaaggaggaccttgcccatggggtaaaggggattgattcttttcaagattaggaacttagaacgggggagaagagagctcacacttgtagctcattcatacatagatccaccaaaacacaggagtagggtattacgcttctgagcggcccgaacctgtatagatcgtcggtgtctcgtgttttctggctggcagacaatctttccatatacagagagagagagagagcttgagatttcaccctaagcccccggccggactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaa

SEQ ID NO: 24944 - DNA, 1501 bp, Oryza sativa
aaaatagggtgggtagatggtgaggctgttggagcgagtaactagtttgactagccaaatcagatggaaagttagctatgtgggtgtttggagagtccgatttagatatgctgttgaagatgctcttaatctttgtcaattgggtcaattaacatgcatgccagaaagaaattaaacctaaggtttttttttgttttattcgtcctaatgagccgacctaaaactttaccaaaatgaggaggtgaagtactaaccacattggggagaacaaacttttcgtaaagggcaaagaaaaataatgattcgtgaataatcccaggtcatatgagatctctctttttttccactcatctcctaaaagacaccgtgcaatcgtgcatgctacgaaaaagatctaaaagctagataacactttgctgcatgtataatccactatatagcaagaaataattgatgtgtggctctctgctctcttggaacaaaagacgaactcactaacaccataacattggcacaaaaagatactatactacctccatttgaggttataagatttttttaacattgtccatattcatatagatattaataaatctagacacacatatatgtctagattcattaacatatatatgaatgtgggcagtgctagaaagtcttataatataaaatggatgaaatggaggaagtatatatatattaatcgatcttgaaacttttgttttgcgaatctatagtgcaactacatctggaaatcttcaatggattcctgagctagaaggatttaataattacacaccaagcaccacttggattattgattgaattagcttttgaataatatgccttttcttcgattttgatgcaagagcaatacgaggttgatctgacacattgtccatgaaagcacaccatacaccaaataaaagatagagtaaatttaataaatcctaagttttgaggcatcggtaaagtaaaatcaaaatctgaggtattaccatttgtttcataaaactctaggttttggagtaaaatgtttaaaaaaagcatttgtttcatgaaactctagattttggagtaaaatattttaaaaaagcatttgtttcatgatcgaaactctaggttttggagagtaatatgtttcaaaaaaccataggtacaaacttatattgttccttcggctaatatatttatccatagtaactgtaaaaaaaaaggcatgagatatttttcagcacatatgcacattacttgtattttcaataaatgttggttgtcgacagttcgatcatttctatgtatattaacccgttaatgtgtcattattagtggggtattgtattgaatatatttgcaatagggaaatgaggatgtgaagaaaaaagtaaagtagatgagagcgatgtgtatttagtatactatgagagcgatgtgtatttagtctactatgtgtatttagtctctcgcaccgccgcccgtgagagaaagaggggaagagaga

SEQ ID NO: 24945 - DNA, 1501 bp, Oryza sativa
aaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacaccatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaaga

SEQ ID NO: 24946 - DNA, 1501 bp, Oryza sativa
aagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagccctccaggagtcgtgtcacctcaaggggccagtctgactgtgcagagaggtcggtttgaccagggtcatccagggagctcgagggcatcatcttcgtcggtcaaaattgctagaggtcactatattgcccccggaatagagccaaagctaagtggatgcccgcggacttgaccactactcaaagaggaggttgcaacatcttcgtgcttaagaattgaagaaaaaatagctgaaaagttgagaaacaagattcaataagttgtggttgtaaaatcaaggagttagagagacttgagttgagagaaagttagggtttcgagtttagtttgagattttggtgaggagtgctattggtgcactttgtaaacactagttgatgcaataaagtcgagaattctaatctacatcttcgagtttgtcatctaccggtgcttctgggttctgacagtctaaccgcaggtgtgcacctggtttgaccagtgggatagcggcggtctgaccggcgaggttttggcggtctgtccggcggtgaacatgcggttcgaccgactgtgacagggcttcgtcatctactccgttcgaggtaaatcttttatttcgcaaaagattttgggtttttggtttttcctaccattcacccccctctggtaggtttgtttggtcttgtgcgatcctacagtggccgcctccaagacaatagtagaggcctaagccaatggagattgagaaaccgatgatagatcaagacgatggtgaggacaaaaatggaggtgggttactggttattagcaatgattcgctgccaagacagaaca

SEQ ID NO: 24947 - DNA, 1501 bp, Oryza sativa
gttcatccatctttgttgatttgtatagtaaatcgtctgcctttgttgtaggagtgtgaatcatctttataggtttgtcccaataaccttccattccacccacgagataggtgtttatctctattttatctaaatgagctccgctagccggttttgatttacaaaactcatcttaatttggatttgttcagatcaaggtggttggcgactcccaaattacagcaaagcattggttgtccggtcatgattggcgatgtgatcaaaaaagtttccaataagaccatactcgtctgaacatgcccattaaaactatgacaaaaagtaagatacatatagggtggagctgatgtgaataggcgcctgatcttctcacatagatactattggtttgatttatctacgtgaagacgtgtcatgagttcttcccattgattgtttttcttctgttgttcatcgagtgatacaattaaattaagcacatttgggatgaaattacatggagaggtctagtgcgtactatataactagctaggaccccatgcattgccgcaggcatatgatgaaattagaagttatttcaatcttttgccaatcaatgaaatattctttatacatgtatcgattgttacacgggtttatatatacatgacctctaatcgtttacttatctacctaaagtgggcataactcaatcatcataacataatggaggcattgaatttgtgagagaaccatttcctccattagctaattaaagaggctaacagagcatgcatactcaattcacttcaaatccactgaaagatgtacttgcagaatatggatgaacaaattccttatacttggtagcaccaatagaaaaatctcttcatagaagcggcagcaccagcttaatgaaatacgtatttatcctactcactaattggtgagctgaaataatagacctggaggctatcaaaatataatatacccaagcaagtacattggtgtaaaatcaaaggtgtttttgattattattctgtgatgaacaattggcattggagattattggttttgatatttggaatttatttgcgaagtgattttggagatgatcgggattttacaggcgatctacaggtactgctgattgggtccggtcagaccgggcacgggttgccggtcagaccggcagtgatggagcggtcagaccagcgcagcccgcggtctgaacggccgactctgtgtcgtttttgattttgggttgtttgtttggatatccgtgattgtttcatgattaaggattctagatggatactatgcgtatgtaatactgtcgtttgctactaatgagtcaagttggggatagcttggtcttggaatatggtttctttgtttgttctatgtgtaggtgactcgagatgccgaagagtatttgaggtgatggaccgggagtcggcttggggataagcgacgtacgtggtggtcagagatcatgcgggatactaaggctagagttcaa

SEQ ID NO: 24948 - DNA, 442 bp, Oryza sativa
aaaaaataatatggttgaaaatgacattaaagtgaacaggccattggattagaataagcgtccgatattttgagctcgtccggacgtcttaaacgaagcattttcggatgtgtacgaatgcaacaaatcacaaagcatatatttataaaagtgtaaatgaagataataataattagaaaaaaatgggaagagaagaacaagagatacactttcaaaccatgacgctattttacctcacgtacctcttgtccgtatggccgcatgtgtcatccgcgtcggtctcgttcctctccttccttcgtgagccggcccagatgggggcggtgggctgaaagcccaataggccaattactaattctaatccagtttttaatccgagttcgtgtcagacataattaccgtttccaacccgactccgtggcggtctctgagccgtccgatc

SEQ ID NO: 24949 - DNA, 172 bp, Oryza sativa
acttcagactttgagaattctcatatcatttggacagtatggaatggctggcttatgttggaattggacacacacctccccttcttttcaaaacccccaaaacggttttaggctgggctcgaggtgcgtggttgggttttgttagtcgtacctcgggtactataaggattaa

SEQ ID NO: 24950 - DNA, 505 bp, Oryza sativa
ttactttgtaaagggcataatatgtaaaatgcaaaacccccctttttaattagagtaaagtgcttcttactttgtaattcaggtagcatccatcaacaacaacagaacttgaaatcatgcagttcaataaatttttgaacccgactgcttatttgcttagccaaatcacggttattggcttcaccacctctacaacaattgccacctagcagaacatatagaggattaatagcccgattagattatttcaacttgcaagcatagatacatatgacctttatgttcacttaatactcaaaattcatcataataattattcgtgtacaaaattatggcatccattgaaaaaggttttgttttgttcgatttacattttcttaggaaaatttagacagcacctatgttattttttatagtggaagaacacacatttttttcttttccccgctatacaacacacaggtcgagcatcacgatcttgcgcatgtccctgatggatgcgcca

SEQ ID NO: 24951 - DNA, 1501 bp, Oryza sativa
acaagcaactcggattcactttctttatgttcagtttactttccactattctcttcatgttgtcatcatttagcattcaacgtattcctttacaccttcgaccttgatgagttccttcccattggatcatcttccaagacatggcattgcctggtaaccggtgcctgcacttttcactccatgtagcatctgatccatagcatgttgatcccgtttaaagctattgtttctattcaactattgcatttattttcgaatgtcattgggtggaattaacctattgtttgttatagcccttttgttcttgattactttattccttgatgccttgggttattataacttgactaattgggctttatatattggttcagctagatattagatatgattgcttagccatgcttagaaacattagcacactattgggataacttatgactcactattatttaatgatggcttaatgatagctcatgatggttaatgatgattggttaattaattaatttgccaactaaaacctgataatggtgggttgtgagcacatggttttgatggtcgtgctcatgacaattaaggaccggttcacgagtttcggttgtgaaacattaaccgtgccaaccacaagccagcgtgggtaacgactttaccttttgtatagcatggttcattgcggagcaccaaactaagaagtggcggagataagcccacgggggtcgctggggagtccatgccttgtatataagggggtgattattgtcacgtcccaaaacgactttaaaatacatcctttaaatgatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccttttccctccctctccctcttgggccggctcggcccatctccctccccctccctctcctctccccgcggcccatccggcctctccccgcgcgtgcgccgctgacgggcgggcccgcctgccaccctactgacgggtggggcccacccgtcatccccttcctcccgccgctcccgccgcctcgcccacgccctagcgccaccgccgccgcgaatcccgccgcccccgtcctccccgcgtgcaatcaataggggggaattatttccagtgattccctccccctttccccccaattttccctccctctctcccttggattcgtttggaaaccctcccctaatcccgccggcgccattgatggagcccgagagcgccgcgccggtttccttcccctccggctgccctctcccccttccaaccctatataaaccctccccgcacctcctccgttcgtttccgcctctcgccgcccttcctcctcgccggaa

SEQ ID NO: 24952 - DNA, 644 bp, Oryza sativa
acctctaatattggtctgaagcatggcattgagtaagtgaaatttgaagtatcatataaagagcacatacaccaaacaaaaataaaactaaatgagtttttctgtatgactttgataattaattatgagggtagttttacctgtttggaaataactagtaagaaattggagattggagaacacaatatagtggagtactatttatcggtgtaaattaaagatgagggcgagttcgcctccccacagcgctccggaccttttcgggccgacgtgctcgcttctgctgatatccacatcgtcccgctccctccgcgcgcgcgaggctgatgcggctgtgggcccggttcctgccgtttcccgcgctaggggagcgcctccggcgcttgtgctgaagctgctgcgggcttgggtatctctaaatgggctgtcagggtggggcccaaccaagggacggtgcgctggcaggttcgccgtttcaccgctcgctcgttcatcagacccgtcgggcgttttcctccgtccattgcgctctgcgttccaaaaaccctagccgcaccgaagccgcctcctcctcctcctcagcgacgctgccagccgtccttcgccctcctccccacagactcctttgcgcgtcctccttcgcc

SEQ ID NO: 24953 - DNA, 174 bp, Oryza sativa
cagtggtttggtgggaacgcaaacctcgccgacgatgctctggagcgcgcactgggcgccgccatcgggacatcgtcttcgttgccgtcgaaccggagcaagccgagccgagccaccgcaccatcaacatctcctcggtgtcctctcttaaatccctcatgaacccctgccagt

SEQ ID NO: 24954 - DNA, 239 bp, Oryza sativa
ccaatgagcttcccatgccagaagagcatgtccccttttgtcatgattgtagagaacaaggacactatgccctgaattgtccatgggtatatgctaaagaagccccttcctttggtttagcagggcagacatcgctaagccagcctcctcgcaccaagtcaagcttgcagcctagtgtgcaaagcagagagcccaatgaagagaatccattgaatcccgggaattgctttcttcctagc

SEQ ID NO: 24955 - DNA, 788 bp, Oryza sativa
ttctcttctgattcttactcttcttgcctttggcttgcttagtgtgtgaccccacgtggtacgaaaggctaggaagaaagcaattcccgggattcaatggattctcttcattgggctctctgctttgcacactaggctgcaagcttgacttggtgcgaggaggctggcttagcgatgtctgccctgctaaaccaaaggaaggggcttctttagcatatacccatggacaattcagggcatagtgtccttgttctctacaatcatgacaaaaggggacatgctcttctggcatgggaagctcattggcctgggtggcaaatgctcgatcaaacacatacttattttggtcttgacttccaaccaatggtagctgtgaactaagccgcatgcttggaatggaccaagggtgtgccctggttaactctcttgaggccagtggtggattgagttgaaaactggagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggtcacatcacagcccaccgatgcaaaccgcacactacacacacaagcaaggaaacacacgacaaacgaaacactagagggtggcttaggttctgcgacgagttcccaagatcttcactccttcacagc

SEQ ID NO: 24956 - DNA, 225 bp, Oryza sativa
atagagtacccactagttgggttttgtttatcctagggtgagcaaggtaataataacaatagcaataataataaggtcataacaaaggtaaataggcatggctaaataaatcagtgataacgcgggaatttaaataaagcgacaatgcattaatttaaatcaaaataattttataaactaggattcaatatgctcaaggatgatgtgacttgccttgctgagaga

SEQ ID NO: 24957 - DNA, 834 bp, Oryza sativa
gctgtttggttgagcaatgtgcttccggcaattgagcatattttgttcgacattgtaatatatttttccaccgattgtaatctgaggctctgagcctattattaaaaacatgaaatagcacatgtttttcttaaagaaaatggaacactttcttccttctcttatatgcgatcaatgagaacgaaactcctgatgattacaaaaagaaaatcggagcacacacgacattatgttagaacgtagagccaggaagcatttgggttgaacgcctaggtggattataagaaaatgggttaccccataagaaaatggtttttcaatcatgttcaattgaaaaaaaaaatccgtagagatgctttttgttgcagtgagaaccaccactgctttagtgtgcacattaaaaaaagagaggaatgaactaacaaaatataggatgattgccctaaaattttttaacaatctaaccatataaaaacatattatgccatataattgatctttacatataacttaaaacttttcttgagaatagaacagtgtatcatttgaggatggaaaatacatcttgagaacacaatgaaaaggaagggagaatcagtgttccattgccattgaacttcaaaaaaccaccttgaatacaatttatcatcgatccatacatccaagaaaatatgtatctttcacaagatgaaagctagacatatatatataaacgtaaataatcttgcacaaacttaacaagcatccatcgatcatcatcaagatctcgatcatacatagcaaaaattatatatagctgctaattaattattcaccatagctgcccgccacagc

SEQ ID NO: 24958 - DNA, 679 bp, Oryza sativa
tgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagctttcgtcgttccggaggttccagaagcgtggttcgcggtcgtcgccaaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccccaactagtgggtactctattcgtggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgctagtcgtaccttgggtactataaggattaa

SEQ ID NO: 24959 - DNA, 1501 bp, Oryza sativa
tatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcatagg

SEQ ID NO: 24960 - DNA, 726 bp, Oryza sativa
ataataatccgcaaatctccatataacatcattaaacttcgggatgaccatgtcttggtcataccaactctgaatcgacccgttcaagtctcctaatgtttgtataacctaaaaaaccctgcgctttctttttaatgtaatggtattggcttctttataggcttgtagctttgcttgtgtgcttcgcgtagcttctgtcgttccggaggttctcgaagcgtgggtcgcggtcgtcgctgaaggttcggaaggccgttgtctctgaacaaggcaagtcacatcatccttgagcatattgaatcccagtttataaaattattttgatttaaattaatgcattgtcgctttatttaaattcccgcgttatcactgatttatttagccatgcctatttacctttgttatgaccttattattattgctattgtattattaccttgttcaccctaggataaacaaaaccccaactagtgggtactctattcatggttccactagtatgaatttcggtagatgcttcgctgattaattatgcaacattaggtggttttataactttagactttgagaattctcatatcatttggacagtatggaatggctggcttatgttggaattggacacacacctccccttcttttcaaaacccccaaaacggttttaggctgggctcgaggtgtgtggttgggttttgttagttgtacctcgggtactataaggattaa

SEQ ID NO: 24961 - DNA, 450 bp, Oryza sativa
aattaagattatattttatttgataataaaacaagtcgtaacaaaataaataatattatactacttttaaataaaacaaatagtcaaacgttacatgaagagttaacgatgtagtagcttaatttaccagtcctatttagagcaggtactcagattataagctagctagctataaatatattttatagaaataaaagagaagagagaagagcaacagtctatctgtagccagctgcagtacggactttaatacgtaatgtatatatgacatgtggaactaggtattaataatacagtaagcaattattatatgaattaagagtattaaattagctataaatattttagagctagtggttggttataatataatattaaacttgctctaagctggggccggtcactatctgtgtccatgcgcagacgaggatcgcgtcgctttccccgcga

SEQ ID NO: 24962 - DNA, 729 bp, Oryza sativa
tgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaa

SEQ ID NO: 24963 - DNA, 492 bp, Oryza sativa
cgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgaca

SEQ ID NO: 24964 - DNA, 283 bp, Oryza sativa
catacccctcaccccatcctagccgtgacaaaaagtaccgacccacccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacg

SEQ ID NO: 24965 - DNA, 1153 bp, Oryza sativa
aggatcgtctttataaaatggctttgggcaactaagtgacttttaaatgctgtttactgcaaaacttaacccctatattattatccccttgtactcccttgcattaattatgcatctccggtgtggcttgctgagtactgtgggtgtactcattcttgctctatcttttcccccttcagtaagagaagctttagagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgcgtcttttatatcatgtttgtatggtgtaccccggcttttcctgggacggggattaatacagtagcgttcgggaaaatgaaattttcccggtcgcgacacataactctttcgattgcttcctaacaataagaaccagccgataacaagttatatagcacaacatagattgtgtcatgtatatgataactcggcgaattacataaatagggttaaaatgtcatgaagatggaagcattaaccccgagaacgcaagccaccataacaagttttacctctagttgaagatcgaatccgatgcagctcaacccgaaagcaagaactcgtcgaaataaacgaaagtaaaaagggtggcgatgcaccgagattgtattgaattattgttgtttgattacatgggttcgggtcatatttatactcgaggtacaaaatatgtaattgccggactcgacacttatctctaacaaactctaagataccataagtctttgtgacagacttttgcctaaacatatctctaaggaaattacatgaaatatcctaattaatagatacaattccctatcatagagctttatctccatcacggcaatcctcgtgaagcaccttgatcgattctagaaacatctttgaaaccatcatcatcggaatcggctgcatcacctctatcggttgtcctctgtcagatccatctcagccgatgcagactccaaccgatgccttcgtagccgatgcatgctctgttcttcgaatcctctctttgctgaatccgattcgattccaatgtcgaacctcgtacatatcttac

SEQ ID NO: 24966 - DNA, 739 bp, Oryza sativa
aaacaccacgtctaagaaattaatatctactttagtgtgtataactcaccaaagcaatcattatgcttttgttgattatagtgaacaataatcccgtatgctatttaggaactaaccaagagataattctcataagataaatctaaattactcaggaagaatattatattgaattcagagtaataaacagaataaaagaaataggagatgattaccgacaactccggaattcttccgacttcttatactctactttcttcctattctaatatacaatatagtatagtagagcttcttataattcagctcaagcttggaagtgtgtgagtgaagtgagggagtgatgtctttatatagaggtaggtatgacggttggcgaaggggaaatgtccgaagtgccctccaaccgtcatctgggatgcatctgagacgtccacgccaaaccccacatccaacggtggagatgatggttcggccgaaccagggggttcggccgaacctgggctgggcccatcttgcctggcctttagcccatgttctcccctggtcttcctctattcattcttcggtattttgggttgatcctctgatgttttgatgaagtttacaacccttccttgtatggatacataattctcctcactttagtctagatttcctcccaacatcggggtttatcgcctgcatacaaatatacaccaacacttgtggaatatgtgagattaagcacctatcacta

SEQ ID NO: 24967 - DNA, 1501 bp, Oryza sativa
atatcattttcaatgaatttatgcttaatagtttgtgaaaagaaaatattttcttacatttcaaccttgcgggctgaggcttcatttgtcatccagatatattttgcacttttagttggattccttgattttgaaatgttcctcttacatcgattcttcaaatatcctttttggagtttcctgttttttcggttgttatcgttcgtcttacctaaatttgtctgaactttaatttctagattatataaacaaaatattcttttgcattgaagcctggccgttttattttgctccggcgttaattttgaattgagttgtagaggttggtctccctgttttttgaaaacaaataactttgttgtgcataaggcccatgcatttcgttgccccttgaagcttttatgaaaatcgcggtttccttgtatcgaatgattttaggtttctcccttgacgtttcgtgttccatcctttcgtttatactttatgcttttagttggatttctttattttcgaatattctcttgtattaacacttttgatcctcgctttggactttaaagctttagtttagttctgaattgttaatttcctaattttgtttgatcttatacttactagtttgcgaaaagaaaatatctgtttgcatttcaaccttgcggattttctgtgctctgacgttttaattttggccttataacaaagttctagagttacgtctccttgtttatcgaaaaaaaaaacttagttgtgggctagacgtctacatttggtcacatcttattgattttatggaaatcgaagtttggttgtaccaaacaatatcttggtttctccgttgaggcttcattttttcatccaagagtttatattttgtacttttagttggattctttgattttaaaacgttcgtcttgcatcaattcttcaaatatcctttttcgagtttcaaatttttttgggttgtcatggttcatctcctttaagtttgtttgaactttattttctcgtttataaaaacaaaatattcttttgcatttacacctgaccgatttattttgctcagaagttaattttgaacttatgattgagttgtataattgagttgtatagttgtgtccatgtttatcgaaaataaataaccttgtagtgagctagacccatcgattttgttgcaccttgaagcttgtatgaaaatcgcagtttccttgtatcaaacgtttctaggtttctctcttgacgcttcatattccatcctttgataactctatgctttcagttggatttctttattttcgattctaaaacattaatttgttaagttttacagggtgttggtgtttgaaactcatttaaaaaaacttcaaaaaaatttaagtaaattgcacatggggccaccccttttcaccaatgttgcagcttgggctatgggtaacccttgcttttcactttggacctaggttctttgaaaaatgtttcacattggacctgttcttcctctagc

SEQ ID NO: 24968 - DNA, 1501 bp, Oryza sativa
cggccgaagccctggttcggccgaaccacggagctcaccgacgggctacaaatttgcaggggagcctgacactattgcgaggggctgcgcccacagtgcgtttaccccttccatcgtgtagttttccaccgggatcaattgattcgctggtgttggctctccgtcgagattataggtggaattagaggaggagccaatgtatgggatcaaggacttgccagccattggtgagttgtgtgtggagaatcaaggaattgaattgggatgaagaaggagtttgcacaagaggaggagaggaggaagaataagtgctctgagctttgatccgatcgatctacctccgaaagcgcatcacaacagactacaaacgagcgagggaattggaactaatcgggcgccgtcctggtttggccgaaccagtaggttcggccgaaccctggtgggtccaactggcggccaatttttccctaggcccactaaattctaaactaagcacaaaagtgacaactatacatggttttaagcatgcattagatgagatcatcatggttcatgatcgattaattcaataacatccacttcttcatctaaagtttcatttggttcaagaaaaatctttaagcgttgaccatgtaccttgaatattttacctgagtcgtcgcggagtgtgattgccctgtgcgaagaggtgtcgatgacatcgaacggtatgttgatgatatgctgatgattttcccctagaggtatgtacttggataccatgtagttcactatgttggcataccacgggttggagtcgcgaaccgtcatcagcatatcatctctcaagaagtcatttatcggctgttcctgcatgtcaatgatctgcagtctagacaaatgatctgctacagaattttgtactccctttttatccttaatttctaagtcaaattcttggagcagcaaaatccaacttaagagacgtggtttagcatctttcttagtgagcaagtatttcagagcaacatgatcagtatagactatcaccttagctcccaccaagtaagatctaaacttatcaatagcaaaaacaaccgcaagcagctctttttcagtagtcgtataattcaactgagctccgattagggtttttctagcatagtgttgacgaccaaatttggtaagatatgtacgaggttcgacattggaatcgaatcggattcagcaaagagaggattcgaagaacagagcatgcatcggctacgaaggcatcggttggagtctgcatcggctgagatggatctgacagaggacaaccgatagaggtgatgcagccgattccgatgatgatggtttcaaagatgtttctagaatcgatcaaggtgcttcacgaggattgccgtgatggagataaagctctatgatagggaattgtatctattaattaggatatttcatgtaatttccttagagatatgtttaggcaaaagtctgtcacaaagacttatggtatcttaga

SEQ ID NO: 24969 - DNA, 449 bp, Oryza sativa
ttccgtaattttctaagaagttatgcttactagtttgtgaaaagaaattatttgcttacatttcaaccttgcggcttttttgtccctcgacgcttcattttccttcctcgtttgaactttatgtttttagttggatttatttatcttcgaacgttcttctctattaatggttttgatttgctctttggactttaaaacgttaatttggttcctcacttaccgattgttttttcgtcctctagtttcaacttgttattttcagtttgatttcttcaattacaaaatttctctttttggaacttccctttggactttatagcttattttagttctgaaatctcattttccgtaattttctatgaacttgtgcatacttccttcgtcctagaatgtatgtattttttaggtaggcacggatattaggaaagtagatagaaataattggagca

SEQ ID NO: 24970 - DNA, 974 bp, Oryza sativa
tttacgaactagtaggagagaggacaaggtagagctatataatatttggtaggtttaatttgtttgcatgaaagtatcaataactaactaattatctttggtggtgtacatccgagaatttttttgagaattaatattatttttatggaaaatcgcaaaagtagtggccaaccggggaaaattgcgaaagtagctccctgtcgaacgggtgcagttcgatagggcacctatcgaacgacgggcagtcgacaaatccctatcgaacggctggagttcgacaagctcacctgtcgaacggagggagttcgacagggcccatcacccggcgccgcgaggcctgtcgaaccgggggcgttcgacagggccctccaccgaccctgtcgaacaatgggcattcgacaggccggtttaaagccccgtccacccaggccgcgatgcttgttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtatggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcagg

SEQ ID NO: 24971 - DNA, 1501 bp, Oryza sativa
  unsure (1)..(1501): unsure at all n locations
gtcgacgtcccgtcgncggcccggcacatcgtctcgcggcgccgcctccgtcgtcggattcgcaacggcgtgttccacgccgtcctcgtctccgtccagccactgccggctgcccacatcgcctcctcgctggccccggtcgtcatcgtcgccgtcctcccgtcgttcccggtcgccgtggcgttcgtccctccgtcaagccgttctcgttcgtcgtcctcgctccgtcaagtgccgcagccccgtcatcgtcttcgtcctcggctccgcgtcgccaagccttgtgccggccgcgtctcgccttcatccaagaatggccgccgaagtcgtcttctcgccgttcgtctcagccgcgcccgttcgttgtcgtcgttcccacgcctcgtcgcgtggtggtaaggatctgtcctctcactgccccgtcctcgtcctttcggtgtcgcccatgcccgttgtgcggttgtcgaccccggtacctgtgtaccggtgtcggtagtcattcgcttgtgtgtgtggtgaccgtgttagtgtgcacgcttggtagccatgtggtttccacgtgtgcagcccgcgtggtgtctagtggagtccgtttgtcggccactcgcctcggttgacacacggggtccgcttctgtcgacccgtggaccgtctctgtgtacccggtccaccgtggtcccttaggttgacatgtggggtccgcatgtcaacggcgcagccttcctgtcttttccaggctagcgcttacacatgttttacagttgcaaaacctaattataataatccgcaaatctccatataacatcattaaacttcggatgaccatgtcttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttctcgaagcgtgggtcgcggtcgtcgccgaaggttcggaaggccgttgtctctcagcaaggcaagtcacatcatccttgagcatattgaatcctagtttataaaattattttgatttaaattaatgcattgtcgctttatttaaattcccgcgttatcactgatttatttagccatgcctatttacctttgttatgaccttattattattgctattgttattattaccttgttcaccctaggataaacaaaaccccaactagtgggtactctattcatggttccactagtatgaatttcggtagatgcttcgctgattaattatgcaacattaggtggttttataactttagactttgggaattctcatatcatttggacagtatggaatggctggcttatgttggaattggacacacacctcccgttcttttcaaaacccccaaaacggttttaggctgggctcgaggtgcgtggttgggttttgttagtcgtacctcgggtactataaggattaa

SEQ ID NO: 24972 - DNA, 194 bp, Oryza sativa
agtttcagatgtgtcttttttggatcaaaggcaacaaccgccagtctagtttttgacaaaccacatcaaggtttcactgaaaggcagcaagccaaaggacctcatcgtccccagaagcgtccgcaatccacattaaagaataccagctgttagagataagccgaaagaagattgataaaagagattggcaaaga

SEQ ID NO: 24973 - DNA, 1501 bp, Oryza sativa
aattatgacaattgcttagaaatgctattctagaatcatgcatactcacatttatcaaatgttatatgcttgggcaattacctttgggaaggtaattgagatgcggcatgtggagacatgagcgccacattgccatgatgttgatgacatgatttgtgaaaggagaaataaaattaaacaattgttttcgactggggcggacggtggatttgggtggtatctgggaaaggctagtaccatccccggtcaattaaggaccgagccatgaagttaagcatgaaacgacccccgtacaacagcacttctcgtatgagtatagacctagcggattagatagccgagcggaggcagtatccctgcatagatggttcacccctgagtgaggcaggtgcgctacggtggggcagccgttgaggtagggccgagaggcgtgccctacatcggtgtcgccatcggtaggactgccatgagtgtgtgagagagagaacttaacttgaaccataatttaatatgtgtgtgatacttctctttctcgggagcgccagaactcctctcactgctagaaacatggacgcctagagtgcatgaggatttaagttcatggagcgggtactgccaatgcgaggttatcaaaaagctttgccgtgacgcgtctcatgtgctgggacgaggctcatgtgttgggcaatcgtggagtgcgggtaaagtgtacatccactgcagtgtgagtaaaccaaatctattcgaatagccgtgctcgcggttattgagcaccgggacatgtattacacttggctagactctaaattcttaacttgggtgggatgggatgttgcatgatgatttctatgctgatggagccactttctgagaggcgggaaggtggacgtcctcagaaaaccatgacgactcaatggcgggaagctatccttgggatcataatggatggtggatagaaccgtcattgtttaatatgaacactggtaataaaaatttgatcagtctgtactaggtcttaggtttgtgaaaagaattacaaaacttgctttgcgcaaaagaaccatagccatcctttgaatacccctgtcatatgcattgttgatgtggtggcttgctgagtacggttggtactcacccttgcaatattcaaacttaatcagaggccggagatgaagcttcggaggatccctatgcctattaccaggagggtgatcaagacgatggcgctcagtaggtcttagttacggtcgttgcctgtggtaatggcgtgccgctgccttaactccgctgccttaccttcttctgtttttggaatgtattccggaccgctcggtccgatgatttaagactatgcctgcgggcttatggtgtaatgattcgtactagacactcgtgtatgtgcacttgatatttcagctaagaattcatgtgtaccagactacttgatccagggaaatggtactgtttacacgattgattcctgttataaaaacgggggtcc

SEQ ID NO: 24974 - DNA, 1501 bp, Oryza sativa
ggtactaatctagtaatctggatatgaatttgtttgtttgccattattcttaatagggattaataattactaataatacttctctttatgatgccatatttctgttagaggtctcttcctcttggttttgttttcttttgattaataattactaatactacttatctttatgatgccatatttctgtaagagatctcttccacttggttttgttttcttttctaagtgcttagatgtgattttcgtgaggtacttgtgtctccatttctctagaactttgatcttgttttatgcacatgcacacacaaaaaaaaacaacttctgcatgaactagaattacaatttgtgcaaatttgcgccttacttttcttttgaaactttcggtattgaagaggtggttgatagcatggatgaggatgatcggcaatcgctcacctctgtgaggatggaggggtatgagccactgtttgaggcagcaagctcgggaaaaattgatctctgcaagtacttggtggaggagcttgggttcgatgtcaatgccgaagctaatcatgattccggtatgtgcctttccaggttattgcattgttttattatgcttagtgcatctcccgtgagcaatgcaattgtaatgggagctgttgtatgtgaggaggttagtcttgatagggtcaggaactgtctttaccttatcatggagacattaactatagtgctgacatgctgctatctgaattggcacaccaatgtaacactgctatgtgaataaatccgtttagtactataatttgattcttaagtgttgtttcttgactagtcaccttttttaatgaaaacaaacaattctgtggcacctttgggacgtatgaatgtatgatgtcttgtgaggtagtattttctgagggagtactgcaagaatttccctgaagaaaactcaattcctgcactaatctagtaatttgttttttgtaacgggccatagataatataagaaaacatcatccaagaaagaatcacaatagcaaagtgttggtgatatgcctttttattcttatttgaaggattatctccttcagccttcctttttatattgcttttgcctactcttgattggtacagttgtgtctagacaatgcatgcagttcactttgtgaagctcatctattatgcacttgatttttcttctagttccttttgcgtggtatatacatgccatcaaattttggttctaagaacttgggaaatgggagttttgtatagttttaactatagtattatccttgttgatatgaacttattaagtggtgtttctgaatgattccattgtttaatattgcatgtcatataaatgcagtctgagctataagtatttcatgaagtgctcctttgcatatttggaattgtagcagctaatatttgtgcatttgcaaagctgttataccacaacactacctgtatcgttttgttggagttatctgattaaatttcttgtttgtaatgc

SEQ ID NO: 24975 - DNA, 1501 bp, Oryza sativa
ctaaataatgaccacctgaagataatagtgggaagtaaactgaatgtaaagaaagtgaatccgagctgcttgttcgtgggagctattcccagttatgaaccaagtgatatgatcgaagatagtctacagaggtcagattaaaatcacatctaacaacgaagcttcagatttggcaggataacgatcagacaataagaagtccagcagtaaagccatttggggagacgtcaaagcatgtcaagtgggataagttggttctgttgagaaacataattcaaaggcaaagttatcgacccttgcatcgaatagtagaagtaactagcacccggagaccaggaaagctaatatgatgcagttagtggcaagtcgtcaaacatggtatccttggtaagtgggatatcttagtctgaagcatttggtggtaagctggaaggaagcgccaagcatggtatcctagtaatgacaagctgatatcgacgcataacgtgaagtgggtaacttgtatgaggttggcgccaaagatatgaactatgagaagttctggatctgaagccccatcttcaagtgccgcaacccagtcgaagtcaactaaaggttcaaccagggacaagtcaagtgaagagaagattccatctgcaacaggagatcgagccaagcagtccagagtggagaagttgtgctaggcaagtttgttatagaagacggagcggaagaagtcaggcaagaagagaagaccgcccaacctattttcttgctagcctcctcgaatctcggggacgagattcctgtaaggggggtggatttgtcacgtcctgataaattcatcccgaaataaaaaccattttctaaaaggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcaacggaattatttattaaaaaacaacaacaattaacaaagtttattaaaaagaaaaagctaaaaataaatcctccttcctcctttgggccaagcccagcccaaagtcaccctctcctccctctctttccctcctctcccgggcctctccacctcctcccggcccacctcttccctccccctcccggcccagctccctcccctcccctctctctcccaggcctgcctctccctcctctcttcctgggccgcctccgggcccaagcagagcggcgccctcccgcccgtgccgcgcacgtgcgtgcactgacggcgcgcccgcatgggtcccacccccgggtcgtcgtcgtcctcccgcccggcctccttcctttctctctcccatgcaaaccctagtgccaatcctccccaaaatccacacgattcaaaccggggtttccgaaattgattagggggttttaatccccattccttcctcttcaattgcccctaattttccccttgaa

SEQ ID NO: 24976 - DNA, 469 bp, Oryza sativa
ggcgttaggcacggcggatcggcgggaccggcggaagaagcggatgacaggtgggccccacccgtcagcgagggcggcgggcgggcccgcctgtcagcggcgcgcgcgcgggggaggaggccgatggcccgcgggggagaggagagagagggagggagagttgggccgagccggcccaagagaggaagggggggaaaagaagacttttagggatttttctttttataaaaccttttcaactttgtttatttcttaataattattattcgtgctctgaaaattccactaaaatttgagggctccttttagaccaaggagaatttaacaaaaattctccgggccacatttgaatttttcttgtacgtattttagggttggccaatttcttttcgaatttttaattaattccattattccttttagaaaatgatttttatttcgggatgaatttatcaggacgtgacagaat

SEQ ID NO: 24977 - DNA, 891 bp, Oryza sativa
ctgacatttctccaacaggagaggatttctgcagataccacttcgtaatgtcccagaactgatttagtcatacatttattatccgtgtaaatttgcaaagcgttggccatgtcctatgcaattgattttaaaccatctatctgcacatatctaattaaagtataaaacaatttataaactctacataatggacattttagctgcatgccacttgtcaattgagcacacaatatactgactaaattcaatttaacttgatcatgattcatgtggaaggtgtttattaggaattaatttattgatatggccagagacttgtttatttttagctatttatttgtctttcccatagaaatgatcaaattttgtacttgcaccttgtgtaagtataatagaattatttagtctgttttggagcattcattaatgcaatgatgctcagccgctcagatctttgcgtagcattatccaagaaaacaagtctttttgtatcccctagataatttgaaagcacccatacatgcacaatagcatgtgaaaaagaactttagctaggttctgttgaccgattatgttgtaggataggaatcatctgcctgtagaacataatttgggcattatcttctgatgttataatcatgtttttctcagcaaactattactccgcactccattttgtgtttgcgatgtggaattattttacctgtgatccaatcccattatttgactgacgtgaaacgttaagtgaaatgacgtgtggacaaagttgctcgtggctggagtctttatgctcgtggttaacaatttggagatgaattttgctctgattgtgctcctgcaatgtgtttttaattttcatcataacggatcttgacactattttctatcaga

SEQ ID NO: 24978 - DNA, 1501 bp, Oryza sativa
ccatagtcattctgtccatcatgcgagatcatcgttaagtatgggatcataggtgttttctctcagtattgcgttgatggtgccgaggtgttgggccggcgtgaccgcttgattctccgcctatgcattagcgtgcgtggacgtgctggtcccaccaatggcaaatacgacgcgtggtgtactggaggatgatgagccatagtcttcgagcaagtataggactgatggctcgtggggatcgatgtcaatcactccaacgaatcgatccgagatcagcgtcgctccttgttccttgtctgcatccctaagagagatttttgattgctggaccttaggaagcggcgtcttcatggcacggagaaggactttgcagcttgagaagtcgtgattcttcgtcttgtgaataggacaatagacatcacgagttggagaagcacgctggattccatgctctttgcaggcatgaattttagcttgtacgttgagaaaaacccaacaagcttgcaaattgtgtttcctggtcttgtggataggacaccagggctttgtcacctcggaagttgtccttgtcggcgcatggtccttgtcggaaggataaggtttggccgcactaggatccttctcgggctcgtatgtcatcgacgttccgttctccgctacagcgggaggatctttcgacatggagtcgcccggggttatagccacggtgttctcgcttccgatcattgatggactagccgagatcggtattgtggtgtaaatagggaagacgatttcgccgacttgagtccacaccagcattgttgaagtagggactccttggatgaggccggtgttgatgctattgtcgacgaggcttgatttcatagtagtagaaccttgagcaccaaggccccctacctggcgcgccactgtcgacaggggatacccatagaccggatatagagggtactggggtacgttggtacgaggatctacatagtatgacatcaaggaaacagaagacaaagattatactggttcaggcccctttataggtaatagccctaccacaagttacaaagggaataacagaactcgagggaataacagaactcgatgatactgacgagatcgtagtcgagttggttcgactaaatcacccggcaacttggctcctataggctccggcttcgtaagctgtggtggtcttggttgtgagatttgatgcgttaggttctcccgaggggtcccttttataccgcaggtcaggtggtctccaagttggactcagagacatcggaccctacacgatacagtgacgacccagtcctatcctggtaggaatctctccatctatggactctgtgatgaatttccttagcgcatacagaggacgtccgtacacgcgcagatataccatattgatgtaaagcgtatatccaatggtagagtgtataccttatccgtaaccctgacaacaacaaactcataactataatagtcttatgcgacaaacttt

SEQ ID NO: 24979 - DNA, 620 bp, Oryza sativa
tttgggaccctaaacagttttaattcaaacacttctcaactacaaagttgtaggtcacgtcgagggctacaattttgatataaagttcatcttcattagagttcacatgaaaaagttatgaattattttttgatataaaatttttagactgtactgtttagggaccagggtgacacaactgaacaagttggaggacctaaacgagtgatttgcaagtttagggaccggaataacacagtcgaacaagtttgaggaactgaacggtcgatttgcgagtttagggaccaggatgacacaacggtacaagtttagggaccggtgattgactttactcataataatatctgaacttgatcggacattgtatagtagtactgaactcggaatgaacaacaggtaacaatctgatagaaaatagtgtcaagatccgttatgatgaaaattaaaaacacattgcaggagcacaatcagagcaaaattcatctccaaattgttaaccacgagcataaagactccagccacgagcaactttgtccacacgtcatttcacttaacgtttcacgtcagtcaaataatgggattggatcacaggtaaaataattccacatcgcaaacacaaa

SEQ ID NO: 24980 - DNA, 1501 bp, Oryza sativa
gaagacccctgaaaattaggagccctgtacagacgcgctggtcgcacgctggtagggacggccctgtactgcagtgcagcgggggtccggaggagaaggggtccaggtgccaactgcagccatccagcccacgggaaaagggcaaagatgcgccttgcaagttgtggaaaatatatattctccaaaacggcaacagctggaggaggcggcgtttagaaaactcagatgagagttgtggatcagttacgtgcaagaaacaacctccggcacaaatggggcgcagatatgctcgaggcaagatgttaaaaaagccacaaaagttggagagaacttttgcttgaggtggatggattcaatgcatatgtttagagcttgataggtccattttaaatttgatttgagctgccgaccactcgtgatcgtaaagaacaattatattttaccgtttcaactattgtacaagcgtgcacttgagaaaaagagctatcgcccgagtaaaaaaaaatcccaatagtttgctacacgtactaactgatcctgcatgcgagtagggcattctcattttagactgttccgttgggtaataaggtgggttccgatcactaggagagatattatcttcaataccggtttttaacccctattaattctggttatagcagccgagactaaatttcttgatgtttagttttattagtaccggttgaagcatcgttactaaacatatatgctaagtcaaaaaaaaacatgaaaaatccctattaattctggttgtagcaaccgaaacaaataaccggtactaaagttgttgatttttagttttagtatcggttgaagaaaccgatactaaacatttatactaagttacatatgtgtgatgtgggattcgaactcaagatatctcacctcagcccttaaacacgttaccatctgttggcggatggcatgaggcccttcaaccaagtctgccgaaacccgtggcgtaggctatggagcaagaatggcgtgaggcgaagagtcgtatgagtgccttgccgggccagaggcgtctcaagcgaagggtgcaaggcaaagactatccgccgagggaagacgacttcgccatgataagttcgcccccgcgagggccgaagaagcctttccgacccatcaagcctaggggttataaggccggcgatcgcctgacggcccatcaggggcccatgagcccctataacattatgtacccctgtaaatatccctttcgtaagggtaatcatgtaaattcccctgtacaacctaaaccctagtagtaagatcctgtaatggggctataaatagtcccctagtgccatgtaatggggggatggaaagaaaagaattcaaaagttcaatacacttcgtttccttccaaccactgttgagtaaccacgtctttcgacgtatgcagttgtcatttcgacaacagctggcgccgaccgtggggacctctgagcgaaaccactgagagcgaatgccaccg

SEQ ID NO: 24981 - DNA, 1501 bp, Oryza sativa
ataattgtatggctgaaaacgtcatcaataaacaggcccaaaattaaccgtccccatactactgcaaacgccacgccatcatccctcctgtcctaatcaattctctttttcggaccgttggaagcgtccgctggcgcagagaaagtatctgtggtggccggacagaaatatctcccctcccgtcggccgtcgcttttggccgtccgttctctcttttggccacccgtccgctatcctccccccaaatctgcaatcccccgcgcgccccccgctataaaaatatcttccgcccttgcacccctcccccccatcccgctcacgagttcctcacttcctcctccgcccgcgtcgcccctcctctcctctccctcccggctcccggctaccgccgccgccgccccgaggtgagagaacctttccttccgctctccggcattcgtttcgatcagaacgaacgggggatttgcctcgtcggaatccgtgggggatctcgcgcggccgacgggccggggttgcggttttggatgctgcttctagcggtagcatcgtaggtttctggatgcgttgtggattaggggggtaaggattttggctggtctcgctttgcttgcctgcgtctttgcgggtgtgatttccgtatgatacggttgatgcttgatagatcgtgcgcgcgtggtgaaggcctctgttgctaccgtggttatctagttctcgatcgtattggtacatggggggcctctttgattctggacgctagtttttccacatgggtatatgctctatgctcttgttcggtgcagtgcacacgggagaggggagacacaagttccacaactcctttgtaaggcatgtttcatctgagatgtagagtagtatagaaggaagtgtatttttgtccctcaaggggacatcccatcgttttgtgcatagcgttcaaaaagttatcaaaaaatttgaaaagaaattgtcaagatagatcattatacgatatatctttttcaaacatgcaagttaaaattcgacttatacaatttgaaacaaaaataacaaatttaaccgtgaattacacgttctattcatagttaaatttgttatttttgtttttacttatataagttgaatttgaatatgcatgtttgtgaagttacatatcacatattgatctatcttactaaattattttaaattttttgatgactttttaagtgacatgcaaaaatgaggggatatccccttaagggatgaatagagttctccagtatagaattgaaatatgaatcattttttcaatcaaaaccagttcatcaggcatcatgaatgaactctgaatattaaaggcatcagagctagaggggttatttcgactgctacatgcatttgtcgtcatcttcagatagcctacatggagataagattaggactgtagttttctgcaagtgcagatataaagcttttgagttgatagcgttgcactgtctttaatcattaatttttctctacc

SEQ ID NO: 24982 - DNA, 1501 bp, Oryza sativa
ggaagctgaacagctcacaaccagctgttgagtccactagttggtctattcgagggagggggaagtgatccttggggcacgcattgttgaggttggtgaagttgacacacatcgtccacttcccgttggccttccgcaccatgactgggttggctatccactctggatggagtacctctctgataaaaccagctttgagaagtttgtcgagctcttctcgtatggccaagcgaacacgtcagcattgtcgcggaggaaggtgatgagcgcgagttcctatttcttgttcagtgatgccccgatcttgactgtcttgttggggttggcgctggagagtggaacaattttgattgcgccgtctggtttcggcgtcttggttgttttgctcactttcttgggtggctcagctgtggcgggtgggctaggagtgtgctcgaccatgtcaaggctccacttgtcgaattggagcgccagctttgcgttcccttgaatagtgattgttcccttcggctcgggcatcttgagtacttgatatgcatagtgagatgcggccatgaacttcgcgagtgcagttctcccaatgatggcattgtatgctatgtcaaactcaatgacatcaaacgtgatctgctctgttcggaagttgctcgcttgtccgaaagtcacaggaagcgtgatcttgcccaatggcttggatgatgactgaggggtgaatctgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccacctaagacatcttctccgaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacc

SEQ ID NO: 24983 - DNA, 1501 bp, Oryza sativa
aaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcatgtcttccgtctgtataccgtggtggtatgtggcacgtggttgcacatgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggctcgtgcgggttcacgaccctgattaataatactgtgtagctctaggatcgtctttttaaaatggctttgggcaactaagtgacttttaaatgctgttttctgcaaaacttaacccctatatattattaccccttgtacccccttgcattaatcatgcatctgccggtgtggctcgctgagtactgtggttgtactcattcttgctcaatcttttcccccttcagtaagagaagctttggagaagaagtcttaggtagagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaatattgaatcccagtttacagaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaaattggattcacacctccccctctattcaaaatcctcaaaatggttttaggctgggctcggggtgtatggttttgatagtagcacctcggccatataaggaccggt

SEQ ID NO: 24984 - DNA, 1501 bp, Oryza sativa
cacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgagtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcgggggccttctgcttggcctcacctcgccggttgccggcgggagccgccggggccttgccctcacggcgctcctgcctcttctccttctcccacttcctcgtccgctcagccaaacttttgactgcgcggcagtccgcgaggtcgtggagggaggtgttgtgcacggtgcaccacttgcccgtcgggcgctccctgctgggagcgccggcctccttctttttgtcgctcgcaggcctcccctttcggggggcccgcgaggcgccctcgacggcgaggacatgaccctcgtcgtcgggacgggccgacctcttcttcctcctcctgtcccgccgctctgaccaagcggcggacccgggggcgaccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatagtgttgcggacttgacagaaccgttgaatgtacgagcgaagagactcatcgtcccctcgctgtaccgcatgcaagtccgcttcttcgcctgggcgcggatatgtgccctggaagttcgtggtgaactgctggcacagatcctcccaagagtggaccgacgcgggtggcaagttcattagccaaccccgcgcctgtcccttcagggccatggggaagaaattcgccatgaccctgtcatcacccccggcggcctcgatcccagtcgtgtagatctggagaaactcggcggggttgacgcttccgtcgtatttttcggtgatggtgggccggaaccttgggggccaacggacgttccgaaggctcgccacaaaggctcgacagccagcaccgccaaccggggacacggggggccggcccccgtgcccggaccgaagtggcgcttcggacgaggaagcgccctccgttgcgtgggcggcgtgacgagagtcgcgccggcgctcgatatcgaggcgggcatccggccccccacgcacatcttcttgggtcggaggcatt

SEQ ID NO: 24985 - DNA, 1501 bp, Oryza sativa
atttctttttcttttaagaattgcaaagatgcacgtgcgttgcgatgggaaatccaaattacatatgttacttcttttgtgtacggtgagagttaatgatgcatatttgggggcctttttttcacgaacctgggtgggtctcatgcgcgtcatggatgctgtgggtttcacgtagagataatcgatacctaaacgtatatttacctattggttctaggcataaagatttttttttgttgcaagggcactataaaaaatgattttttgcatttgactggaaccctgctaggtctaaagattttttttcgctgtaagggcacttatcatttaaaaattattttcagtatcttttcatatgggtagtgcaaaccgcgtgcgaaaatgttatcattcttgtgtgcatagaaaattgagctcatatctatattggaattgaatatttatcctcctatagtttttttattgatatacaattactccctatatttctgtaacagccctaaaatttgacaactttttaaaaccgatttagtttgctttgattctctaaaaatataactgtcgagttagtagtttatttaaaatattattttccatgtttgtttccggtgtttcttttctcgtttaattttgtcgcaaagtgcgtatcatccctcaaataattcctttaatccgatttaattctatcccgaatgttggaccgtctaaattccacatcaattcaaatcctatttattttaatcttccccatattttccttttccctatttccaccttaattttctttttccattttttttcctttctctttccctctttctctgtttttcttcctctctccgtttttccttttatttcttcctctactcggctaggctgagccagcgcctgtgccgccccgtgttgcctcgcggcaatcccgcgctgcgctcatgcgcgctcgcgcccagctcgtgccagcccgcgcacgccacacgcccgcacgctctcgcacgaggacgaacgacgaacgaatgccgccacgacacctccagcttcccgcctccgtatttccttcgtctctcaactagaaggctcaagaccggaggcaaaagaatccgccccaaccaccgttgactcaatcgtcggcaccggaggaaaaatccccaaaacacgccattgattgagcttcaaaattcgtcgcatacgtcgcaaatcctcagaaattgaaggtaaaattggattctccatgacgagtactcccttccccctctctttacccatccaattcatcgccggaatgtcgcaagcgtcgcctcccgccgccactgctctgttcggccgccgccggccacatggcgcgccgccgctccaggccaccctaacttcggctatcgccaccctcggactcctctagccttagtgaacttcatcaggccgcctcccttctcggagttcgccggagtcgcctccgcctcccgtttccgcccaccgccaccagcctcaccgtcggcgtttctct

SEQ ID NO: 24986 - DNA, 1501 bp, Oryza sativa
catatcacattttggtatactttgttaacctcaaagcatctgatatagcaataatgtacagcagccacaattatccaataatgtcaatccattatgacaaccccatttaatctgcagtatcctttcaccagaaaacacgttcatatttgaaaaaaaaaacagaattcatggaagaaagagtgcacaagacgaactgataatatgccatcagatgaggaaagcatcctaggatcaatcaaacaaacagaagcagctgacgtaaagatgatgttaaataggggcagtagtgcagctgtgcagcacctttcttcttggaatccttcttcttcacacaaaacagctcgagcaccttgtttagaaccatccttaaaacccgcttcacgcaaaacgcacctgaaaaacatgagacgccatcatcagaattagacagccagaaaacagaaataggcgtcgtccaccatctccaaataaatcatcttctcaccaagcgtaaccgaaaaaggaagaaaaaaagacactatcttttggagaatcccaactccccaagcaactattagtattttctcccttttatttactttttattttatttacacttcacttcattagtgaacttttgggttgggaactcttgttcatctgcctcacctgtcggcgtctaactccacactccaattccaatcagttacatacgcgaaggcttgtccaatacgattgggacacccttacccccaagaacagacaacaacaaaaaagaaagaaagaaaaaagagaaggagaagagagaacacattgaaagcaagaagccaagaaacggcaactacagcaacagaacaaacccaacaaggaaaaaacatacaaaaataaaaaggaataaacttggactgtcgccatctatgaacagagtatccatccatccatccaccccaattccacagagaaaaacgagagatcacgaaggtggtggtaatcccccgatcatcagccaccgcccatcgcccacagccgcgcctccacaaaataaaaaaggaaaaaaagaaccctttccccgcaagaacaacggctgcatcgatcaaaaaggagaagaagaaaacctcgggtttgtctgaggtggtcgcgctgtgctctgcagtggagaggggggaagggggagggttttagttgcagggctcagcaacaagataattaatgtagcagtaataaaagtaaaagtattgagacaactaaggaggttctaataggcagcaagtttcaaacaataggacatgcaaaaccaagcagatgtgatctcaaggaccgggaagagacgttagctagaactcctggcaaaactatatctgtttgaattactgccagatatatggcccaaaagtggaacacagcaatttgaaataacatcaagtgggaaatgcatatggaacagttcagaacatgggcacaggaagtgaggaacttacagcatcctagctgtaagttccagctgtcaggaacttacagtgtt

SEQ ID NO: 24987 - DNA, 613 bp, Oryza sativa
gataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtctttttccccccccttccccctcttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccaccgcctcgcccgtgacctagcgccgccgccgccgcgaatcccgccgcctcccgccgtccccgcgcgcaataaagagggggaaatcactccccgtgattccctctctctttccccccatttttccctccctctctccctcggattcggttggaaaccgctcccctaatctcgccggcgccattga

SEQ ID NO: 24988 - DNA, 519 bp, Oryza sativa
ttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggatggggattaatacactagcgttcgggaaaaggcaattttcccggtcgcgacaagctggtatcagagccatcttgactgtaggataagccaagtggataaaacccaaggacatattttataaataaaaattatttgcgaaagttcctttttctccttcccctaa

SEQ ID NO: 24989 - DNA, 1501 bp, Oryza sativa
ctgatctcggcacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggccaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctctctttccccccgtttttccctctctctctccctcggattcgtccggaatcgctcccgcaaacctcgccggcgccatcaatggcggccgagatctccgcgcccgtttcctccctctccggccgcgctctccccctcccgacgctatataagcgttccccgtgctctccccctccgtttccgccactcgccgtctctcctccccgtcggaatcgagcccgcaccgtcgcaccttctctccgccgtcgccgccgagctccggttcgccgccgtcgtcgctccggacctcctccccactcggcgtcacctccatcggctttgccgcgtccccgtcgacctcggccacccctccgcttcgctcgccgaccgccagagcaccgtcgcccacgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgcca

SEQ ID NO: 24990 - DNA, 904 bp, Oryza sativa
ccgaccccctgtggtgtcgccgccacgtgtgtgggttaggtgagcacagcggcgctcacctaaccgcatttatagcgggtcagacgcgcgcgccacgccgcattcaatgcggcgcagcgcatgcttatccggtccatgaccggtcgcagggtgtgaccggtcacagaccggtcagatcgcgggttaggtggcaacaggcggcctgtcgcacgcctcgccccgtctcgtcggaatgatgagagcttcctggctcttgtccctagccggagccagcgtgctaactcctggagttggtatgtcagtcccggtcagatccattccaggcttcagcgcaagtatagcaaggaagtcgctggccattaaatgaaggttgaaacgggcgtccaccgggagagcgaacgagcggagcagaaggcgtgtgctctgcttgtcagaggtcacttccggctgtagactagccctcattgtaaaaagcatgttcctttcttaggcagtaagaggcccatgtggtgacccctaaccagataaaaaggaggcccaggcctaagaaagagagaagaaaaagagggtgctggagcggaactctctctggctctccggctctcggtaattccttcacacacagatccaccagaacacaggagtagggtgttacgcttctcagcggcccgaacctgtctacgtcgcccgtgtcttgtgcgcttcctctctcgctgacattcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 24991 - DNA, 1501 bp, Oryza sativa
agaggagcccttggaagatgaaggctttggtgtctagctcgtgcctgccgtcaagcgcttgtggtcgtcgccctagtcttccgctgtttctcgtttgtctttgtgtgtgctgggccttcgccgcccatgtaataaattaactatttacggttccgtttgataaactctgaaatgtatcaacttttggtgtaccttgcctcctgggacaaggaataatacatgcacgtaaggaacgcccgttgggttaattccggtcgtgacaagttggtatcagagcccccttgacactaggacgagccgtagatcccaagccttagcaatattttcaaaataaaaatcctttcttatttgtgaaaatcctctagtctctctctgtcctgctgcttcatttatcgtcaaaatctaacctttaaaatgttgcttttctcttttgtttttgtttgtagatggccagcagcatcaaccgtcgtggtctggacctgactggcttcgttttggagctacggggcatgtgcgttgtcctagggtatccgcatggagtggattaccagggcaagcagctcccggagcaagagggtgacgatgcagagccccacgctgcttgggaggttactgcagtgatcctcactggctcacccgagaggacttcgttggcagtcaccgcgggtggtgattccttctccgccgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgtggcccgtatcgacttccatcagatggtgcgtcgcgggttggtcgagaacaacatgaagatcctggagctgcgtcaggagaatctgcagctgaagaaggacctagacgcagtggaggcgcagctgcatcagctcaagatcgcccagggagaggtctatcgccccaagcgtcgtcgcgtctgccgcagcctgaagatcaccgcccgcaagagtacctccaggcccgagcttgttcgtcagtccctggcgtggacctgcttcgtcgagacccctcgtgccgagcccgcccccgttgttcctcaggaggatggagcctccggcgttggcagcacagaggatgcgttgctgctcaccttccgccctggcccgtcgtagcagtagacgagcagttagtaggcttgcgcgtgtgttcttctcgtttgtttttctgctagagtcatatagggcatggttatgccggtgtgtggtataactatgtcggagcatgtctttattttatttgcttaagcaacttgaaccttaatgaaccaatttaatagcagtaataaattcaagaattatggtagtcgtgggtggttagctttaattgtcagctctctctgtttgctggttctgtgtgggttttc

SEQ ID NO: 24992 - DNA, 1501 bp, Oryza sativa
tggcggcgcgaacggagagcacctacgggtagcggacggcacggcaaactcaccggtgaccaaaacggcgacggaagatcaacggacggcgacggcgtcgaggaagaagcggcggcgaccttcggcttgacgacgacggcggtgttccggcggtcgacagcaacggcggaggggcggacgaggacggcgacgcgacggcgaccacgatggcgaccttcccgagcgacgacgacgactggagcgacggcggcgcacggctggagcggcggcgacgacggcggcgcgaggtctcacggggctagggcgctacggacgacgagagacgaaggcaagggtggcgacgggtagcggcggacttgggggtccttttaaaggggttggaaggcagcgtcggaggcccacggtgaccggcgacggcgaaggaaggtctagggttcagaggagagagatcgatctgaatcgaactcgaatccgcgaatttccaaacgaaattagccgacgattccataagagaaaagatagaggggattccgaagatcatttcccctctattgatttcaccggagaaggaaaggcgcgagcgaatttggaaggagatggcggcggcgcggcgctagggttcgggcggcgggcggccggaggaggacgacgagtccgacaggtggggcccacctgtcagcgggagagagagagaggagagcggcagctcggttgcgggccggcttgggccgaggagagagagaaaaagagaggggttttgggccgactttcggcccaaagcaaaaagagacttttaaaaacctttttcaatttaaattattcatgaaatgcaattccatttattcaaaatacttccttagctcaaataaatcccagaaaaatctaggaattatagaattaagcaaagtatttaatgaaattttatctggccccattttatattggaatttattaattaaaattagatcttctcttctaggctttttaaaataaattctaataattccaattaaacaacaatttatatattttggatttttagggtgtgacattagaacatacagtggacgtccgtacacgcgcagatgtaaagcgtatatccaagggtagagggtataccttatccgtaaccctgacagtagcccccgacttctgcttaaatgaactcatataaccgatcgcgacttccgatgtcggggttattgtcattctcgactagtcgatctcggcgtgaagatcgtagagacaaggagtaatcgacaacgctatgtgaaattcaatgggcgtgagtgaatttaaattgaagtccaaaaactgtcgtgggtaacagacccagaaattttcggcgggcatctctcttctttccttggaattcgcatcgtcggtagtgcgtctatttaagggagttttggggatccattttggagtctgcctgttgcgaaaaaactttcaagcctccaagtgctcttcgtcttctccattcccgcacaaaccctagctt

SEQ ID NO: 24993 - DNA, 1501 bp, Oryza sativa
tatggggaagattaaaataaataggatttgaattgatgtggaatttagacggtccaacattcgggatagaattaaatcggattaaaggaattatttgagggatgatacgcactttgcgacaaaattaaacgagaaaagaaacaccggaaacaaacatggaaaataatattttaaataaactactaactcgacagttatatttttagagaatcaaagcaaactaaatcggttttaaaaagttgtcaaattttagggctgttacagaaatatagggagtaattgtatatcaataaaaaaactataggaggataaatattcaattccaatatagatatgagctcaattttctatgcacacaagaatgataacattttcgcacgcggtttgcactacccatatgaaaagatactgaaaataatttttaaatgataagtgcccttacagcgaaaaaaaatctttagacctagcagggttccagtcaaatgcaaaaaatcattttttatagtgcccttgcaacaaaaaaaaatctttatgcctagaaccaataggtaaatatacgtttaggtatcgattatctctacgtgaaacccacagcatccatgacgcgcatgagacccacccaggttcgtgaaaaaaaggcccccaaatatgcatcattaactctcaccgtacacaaaagaagtaacatatgtaatttggatttcccatcgcaacgcacgtgcatctttgcaattcttaaaagaaaaagaaatgagagatgaaaggaaaaggtccacttgaggtcccttatcttgtcgtcgagtttcaaaatcgtccctgtgaagcatctaggcccccgttgttagttttggtaattaatgacaagcgctaattgtggactaaccgttctatcgagttataagttttgagttaggttcacatcatgtgtgcacatggatgactaccgatggattaaaatttgatggcgcaaagcaaagaaaagaagatggttgttggtatttcttaacgacattactagaaatataattcccaacaatggcgcagaaatacttctggtatattatggttacagagttcatccgcaagcgcacggatataccattgtagcatttcacccgagagtattccaagggtatcgtatttattttatcctgtgggaagatcttgtagagagaactcaactaataatttatatgttacttgtgataatcatattttaagcaggtgttatgataatccaagtgtagagtgacacacaagcattacctactcatcctcataataaataatctaaactaggtggaaagaaaagagaaaggaaatctattcctatacttctaatatacctagtatacatactggctaataccctctatccgatgtcatcctagtacttcgagaagccacccctgactgccgagttccttacgacagctcatcatgaccatccaatcggggctaaatatggaggaataccctccccaggaaattaacttaggat

SEQ ID NO: 24994 - DNA, 1501 bp, Oryza sativa
gcatagtagggtttcatttgcataaacagcatttaataaacatttcagaatttaataaaacagttaagtgataattaaacaatattaatccaacgctatacaacataccctgttgcataggcccaaccattctgaacaaccatcccggctgcacagttctatctccaaaccaggaatataccattccaaaccaggagctaatcaaattactatcagttatagcatcttttattatgatgagaagtgtgaaactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgatagtacccctcgcacaacacaatccaccacagcgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgaactatcattaagccatcattaaataatagtgaatcataagttatcccaatagtgtgctaatgtttctaggcatggctaagcaatcatatctaatatctagctgaaccaatatatatagcccaactagtcaagttataatcacccaaggtatcaaggagtaaagtaatcaagaacaaaaagggctataacaaacaataggttaattccacccaatgacattcaaaaataaatgcaatagttgaatagaaacagtagctttaaacgggatcaacatgctcaaagggttgtttgggatctgtgtgacttgccttgctggccttggaactcttcaaattcttctcctgcgaaaacggactctccggaaacatcggaatctaaacagaatggagcaaaatcaccaaaacagcacaataacaagcatgagcagtacatgtggatatttttaacatgtagatctcaattttagaaaaatttagagacttgaaccaactaaatccgagctaagatgaattagttatgaatttttaaagattaaatcagattaaaacacttatatggattttaattgaattatgacgcaataatgaattatttttgaacaggaaaaaggaattattgcgtcagcggctagggtttgcggtggaccgggtgcacggcggcggctcacggaaacgaacggccgagatcgatcctatccaaaacggacggccgagatcgaacggtccacggccagaccacgagagacgacgacga

SEQ ID NO: 24995 - DNA, 1501 bp, Oryza sativa
aatcgagcgacggcgtggatgcgtttggatggcgaggtcggtggatcgggcggcatgaattgaatcgtgagtgcgggaggggcagctcggctagttcaaggtggggcgcgacgagctggcggctggcatcagcggcgtcagggcactctgcctccaagagcaaggagacaaaggtgggagagagaaaccaatgtccaggagggaaaaagaaatggaggacggtggaaaggggagcttgctccttccgttttggggaggtgcggcaggcgaggcgcgtgggagcggtatggggcacgcgacgcaggcggcgcaggcgcgacatggcagcttccaatagtaccacgtgtccacgtctgatacccatgagtatcagatctgatacccagttactaggtttgaatattgggttgaataccgaggtaccgagtatgatacctatgaatagcagatgagatagcgagttatcgagtctgatacctatgaccatcggatcgacccatgtaaacctaaagaggtgtacgggtagtgtcgtattggagtattgcatagctattttgtatcgtaggagaaaagagcactgccactagtcgatgtagacctgagggtctccaatatgaaaggacagcacacaacacgttttcagagataaaaagaatccaggtctgtttagatctcctagcaaaattttacaccctctcacatcgaatgtttggacatatgcatggagtattaaatataaatatccgggcctattgagatctcctagcaacattttatactctctcacatcgaatgcttggacacatacatggagtattaaatataaacaaaaaaaaattaattacatagattgcatgtaaattgctagacgaatcttttaagtctaattgcgccatgatttgataatgtggtgttacagtaaatacttgctaatgacgaattaattaggcttaataaattcgtctagccgtttacaggcggattctataattagttttttattagtctacatttaatacttcaaattagtgtccgtatatcgatgtgaccggctaaaactttacaccccttttaaacacccccttaggctgtgttcgctcctcctggttggtaacactcccgtccggcatgaaaaacggagcggtccattagcacgtgattaatttagtatttgcatttttttttcaaaaatggattaatttgatttttaagcaactttcgtatagaaactttttgcaaaaaacacaccgtttagcagtttaaaaagcgtgcgcgtggaaaacgagagagatgagttgggaaaatgggcatccgaatacagccttagtgagtaatggataagtagaatttatacactataccgttgagacggtacaccgtcccatatatttctccaacggtaatatctgcaacggtagcatcgcgtaaaagaaagagaaatctcccgtccggttgtctcctccgctgcttgcgccgccgccaagacgagtcgcggttgagc

SEQ ID NO: 24996 - DNA, 1501 bp, Oryza sativa
attatttatgaccaaagttctacatgtgctactcatgcggaacactgcatatgactgacatataggagattacttcaggtctccaaatatgttatcatctttttcaagaaggttgttccaatcatcgtccatacggacgtccccaccatccttaacattgataagcatgtcatcatgcttttcaatctgagcttcaggctcaatggtgaagtgggactcatgttggctctttttctcattcatgctttgttggtagagctcaaccaggtgcttggggacatggcagttacgggaccaatgccctctgcctccacatctatagcagttatcctgcttttccccagatgattcacctgtaaccttcttgagttcgcctttacctctgggtttacccttgctcttgcccttgaatttgatacttcccttacctttccctttcttctcaccatggcctcttttacggccacgcgagtttccaacaacattggcgtgtgcttcaggcactgccatagacccagtgggtctagcagaatgattctttagaagaacttcattctgcctttctgcaactaacaggactgagataagatcagagtacttcgggtactttgagttcctgtattgctgttgcagcactatgttgttgggatgaaaggtagataaggttttctcgatcatctcagcgtcagtgatcttctggccacaaaaacgcaactgagaaatgatcctatggggggcagagttatacgccgccgtagacttgtagtcttggaagtgtagggtgatccagtcatgttgtacctgtgggagcacaattgacccttgctggtcaaagcgatccttcagggattgccataataccagtggatttttctcggtcatatactcagacttcaggtctgggtggagatggtggcgcaagaaatgcaatgcctttgctttctcggccttcgtagactccacagtgccaagttcgggcagcacaatagtatgatcgagaccaatggagtcgagtttaatctcaacgtccaatgcccaagtgaggtagttactaccatccaaggcaagctcggcgaattccttctttgttatgtccgacatgttctgcaacataatttggtatttacgactggtaaatacgatgtgcagggtcgacatgaattggtcatgcgtaatcttcaggattactagtgtgtgtaatctttaggattatcacacagtttcccatagaatctttcctagcaaattaacttaagtaatcttcaggattacatattgcttgattaactattatcaatcatgctaggaaatcaatttcataacaataaaataaatgttatgaaagacatgcaaacaacaaagtaagcatgtaaaacaaaacgaagagtatacatgggcacaacttcatgtatattgtgcagactgtaaaaagtaagataaaccatgtagcacttccccactatgagcccatgcttcatggtggcagagccgaccttagtgg

SEQ ID NO: 24997 - DNA, 605 bp, Oryza sativa
gcttgaaaatattagaaaagcatcaccacttctagcttagccttctatatactactagtactacactatatgagtacagattattacactagtttagagagatggtgattcgaaaacaaggagttttcatcagcaatatagctagatgatgggaccaaatatgcgggaatcgaaccaattccaatgaaatttttgtgaagttttcataagagcatttcattccaaatgagaccgaatccgaaccggtttcgacgataattttacaaggtttttcatgagaatgctgcagagtagtagtacgtcgtgtgaggcccgcgagaattcgtcagcctgcctgggcctcattgtgctgagtagtagtcctatatggaattttttttatttataattttttttattaaaagttttacaaaaataatttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcc

SEQ ID NO: 24998 - DNA, 694 bp, Oryza sativa
tggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaaca

SEQ ID NO: 24999 - DNA, 219 bp, Oryza sativa
  unsure (1)..(219): unsure at all n locations
agaagaaagacatctgaatttgagttaaaaggacaccaacntaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagc

SEQ ID NO: 25000 - DNA, 737 bp, Oryza sativa
gtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactg

SEQ ID NO: 25001 - DNA, 298 bp, Oryza sativa
agatttcatgataatgttcttaaaaaaaataatactggacattctgatggtacttgcttttgttgttggtgcctcattgcctaattcattgtgattgcttttgaggcatgcggcctggcttgccttttctcctgaaaagagacaaagcacagtgtaacatttgattgcagtagtggattgacaaggcattcctattagtggttccatcctctcatgtgaacctttctgatataatgagaatgttgatcactttgtgccaccttactagtgtcttcagcagaacttttttgatctgagg

SEQ ID NO: 25002 - DNA, 374 bp, Oryza sativa
ggagctcgccgacgccggcaaggtcttgcaggacatcaaggtgttcgtccagagcaacaggcggcgcgcgccaccgcctgaattgagattcgagagtttgatctgcttcgtaccgtacacgcgtcgtacacttcatatacttgagattttgaattgggatttctgtgattcaaggtgaaagtttaaggccgcagttaaaagtttcgtatgattttatgttgaaaactgtataatttgagtatgaaggttttaagttttcatatgaaagttttaaatttgaatttgaacggtttttaattcaaaaatgaaaaattgaggtcacagctaagtgtcatgtgaaagttgtatgaattaagatgaaagttgtatgatca

SEQ ID NO: 25003 - DNA, 1501 bp, Oryza sativa
aaatcgaaatgtttggcttgtgaaggatagaactatcactcaactgtccaacaacaatccgatggcctggaaaatgtagcttgcccacaaagctgatatagctaataacttgaggaagcagcagccaccaggatcccatggcattatcgatgcaatcttagccattaatcgtgatgaaatgagatatgcttcagcaatggtttaagagaaaattcaacttcgtcatatattatacaacggaggttacagttgtacataagatgagataagctgtgatgacaagttggatattcctgaattctctgtcagataaggaaatccaagttcagattattttgaattgactaagataatcagagggattccgaggtgtgaaatgggggagaggggatgcgttgatttaggttttgaataagatatccactacatcagcttctgtttgttctaacttctaactgcataaattccacggcaacttgatgacgactgactagttagagcatagaagtcctcgctcgactagagttgcagctctcggacaagtaaggccagttccaaattttttttccaaaaatatcacatcaatatgtagacacatgtatggagcattaaatatagattaaaaaaactaattacacagttaggggggaaatcacgagacgaatcttttgagcctaattaatccatgattagctataagtgctagtacaataataacccacatgtactaatgccggattaattaggctcaaaagatttgtctcgcggtttacaggggagttctgaaattagttttttcatttatgtctgaaaactccttccgatatctggacaaacatccgatgtgacacccagaaattttcttttagtgaactaaacaggccctaaacgagccactccttgtgcttcccatctgcttctgagaaattacctctcaatgattgttagagataagcaaagtaattaagggggtgttttaatcaggggtgtaaagttttggcgtgtcacatcaggtattatatatggtgtcgtatggggtgttcaggcactaatagaaaaactaattatagaatccgtcagcaaacagcgagacgaatttattaagcctaattactccgtcattagtaaatatttactgtagcacaacattgtcaaatcatggagcaattaggcttaaaagattcatctcgcatattagtcgcaatctgtgcaatttgttatttttttagcttatatttaatatttcatatatgtgttcaaacgtttaatgtgatagggtataaatttttgtgtgggaactaaacatagcctaactaagaaaatttccagtataaatgtgtgtttttgtgtgcgtatgcatagcatgtttgacacaacaagaacacaggctttgtgattcttgcgaagcattggcgtcatcaaattcctgctagaattttactgttctttctctgatctaagttttgcactttgacataggcttaagagtggttaggtaaga

SEQ ID NO: 25004 - DNA, 1501 bp, Oryza sativa
ttgttgttgttgccggggtggtggtggtgttggtgttggtgctgcggcgtgatgtcgcggagcttcttgtgcatggcgaggaggttgctgacgagctgagtgagctgcgtcacggccgactcgacgcggcggaggaggcggctgtcggtgccgtggaagccgtcgaggcaggtgccctggttgcccatcgccgcgctgagccaggcgtggatgtcgtcctcggcgcgcgcgccgcggcggcggcggcgcctcgtctccggctccgtctcatcctcctcctccgccgcggcgacgccgccgtcggggtcggccatggcgtcgagcgcccacccgagctcgtcgacggagtaccccaccagctcgacgcagtcgcgcacggccatctcctcccgcgcgtggttggacagcgacgcgagccccgccacggccgccacggcgcccaccgcctcgccgagcgtgtcccggaccgccgcgcggagcaccggcacggggccactccccgcgccgccgcgcgccgtgtcgagccgcgacacgcagccgccctcgcccccacctccacctccgcctccaccgaacgccgtcacgttgaagcacgcctgctgcagcagcgcggcctcgaacgcctcggcctcctcctggctctcgaacgaacacccggagaacaccgcggcggccgcgccgccattgccgccgcacgcaagcacaaacaagagcaacagaagcagcgcgccggtggacgccattgtcgcggtcgcaagcagcagtttgctggcgagcgaggagtgtgtctcgccatggccgcgaggtgtgccagtatatagagtggcaagcgtgcgtgctctggtcttggtgcaaatggaggcaaggtatagtttgctgcagaagaaaggtcgtgtgcagcatcgaagcctttatcaacaactccttttcgccttcgaggaaagggacacggatttgagcccaatgattggcttaatttaactaacttcgtgtgattgtgcagcacggctagcgttattgtcaaaggcaaagtctagtgattgcggtaacctaagtagcatcctaagatattgaattcaaatctctatataagcgaattttagattgtgttatttaagtggctatggttctaatttaaaaagagcgaattttggattgtgttgttttaggagctaagttttcaattttaaaatactgtacatatctaattagatgtagaggacgggtaaaaaatactcctgtaaataaaagcgtgactgtcaccggcttcgctgctgaagaagaagaagaagaagaagaagaaaactaaatatggatagcacaaaactcggctgaggtcgtcagaggtcaaacgaaacgaacgattttggacaaatatttgatatttgaccatgacattctagagtacaagataacaatgcgaccagtatcgatcactaactattgctgttgtgtactgacagtttgttgttaggacatgttggtagctagtgtcggtcga

SEQ ID NO: 25005 - DNA, 549 bp, Oryza sativa
ctgacagattaaaacgaggaaagataaatctaaatgttatgtgaaaaaaaaaacatctaaatcattaagaataacttgggggaggatgtaacaatgtgattatgtgataaacaggtttgcagacagcaaacgttttcgctagtaaaagtacaacagcaagctctatcttgctccagttcatgctagcagcaacaaacatatggaccatttgctctttaggtgtaatccaccgcacgagtgtaatctacaccagcatgtcgcctcaaatcaccagacattattccccaatgctgttcatagcgaaatttggagggcacagtatataatcaacctgtttggcacataagcaagtattccactaccaaaattctagctccaaatctcagcgaagcccccccaaacccaaaacaatccatgggatcaaagcaaggcaacacgtaaatacgtaatacgcccacgagaacagcgctccacgccacaatccgtaagacagagacagatcctctcaccactccccccccccccatgatccaccatcccccctcgagg

SEQ ID NO: 25006 - DNA, 1501 bp, Oryza sativa
cggtatccggagacaccgtaggggaatagccatgcctatccttcaagtcgatatccggcggcgtgtcttggcgtatgtaggcttgtatgttgtggcttctggtaggcgtgtgttgattgtcatgggtgtctttcactttcatggtggttgtctctccccctgtcctcctaggagggcttgtatttatacctataggtgtccccttgtccaagtagaactagggaaaccaatatggatacaatctgagtagtacttgtcgtttccatgtagaactctggttatctttccttatccagaactccctcgaggtcagtttccgtataagacatggtatgtagtgtatcctgccgatatttagtcaactactattaggtatatgtggtatctataaccctgacatatatatatatatatactgttatacacatacgtatacgcaggggcgaagctacagccattcataggggtcagttgaccccgacgatgtttcacgaacctctcgtacctctctttattttaccatctatgaccccagcgaacagaaaaactagaccccggtgattttgttgattgttccgtcaaagccaaactagcgactgggaacgatactaacaaacaacaaatagaaaatttgctagcacttatgatttatacgtgagcccaacatacatatacgatagagatttgggtaaaaaaaatccacaaattctcttgttgcgtcatcgtattccttcgatcactttaatttgtcctgctccggcgctgcacatcttaacatcttaattatatcatcttatttctagcagaacgaaaggcaagaaattagtggatttgataatctttggtgcatttggtgtctttaacaaattaataatgtatactccctccatactggtaaaggaagtcgtttaggacagcgacacggtctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgc

SEQ ID NO: 25007 - DNA, 1501 bp, Oryza sativa
cccgtatgcttctaataaattcgcaggtatcgggtgggatatgcccaatgataaaaataggtacccactcccatatccattggttcgagtatcatgaatacgcgaacctaattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccactctatatactggcacacctcgcggccatggcgagacacactcctcgctcgccagcaaactgctgcttgcgaccgcgacaa

SEQ ID NO: 25008 - DNA, 518 bp, Oryza sativa
aactaagggtgtgtttagttcacgctaaaattgaaaatttgattgaaattggaacgatgtgacgaaaaagttgaaagtttgtgtgtatgaaagttttgatgtgatggaaaagttggaagtatgaaaaaaaagttgagaactaaaccaggcctaagcacggcctatctggtctaagctttcacaccttctaagccttatattcctttcatcttccatctaagaaaaattttcactattgtactagaaaaccgttgctccttgtattgagattgttgctacattgaaactgttgctgattgagctaattgaggtggtttgctaatgaactggtgtcagaactacctattttgcaccaaatctaccataagtagccaagagtctatggaatccaagtgtacgcaagagaagattgattgttgtatattttggagagactaaaagaaatggaagcaaaatagggacaaattctttgaggagatcagtgcctccattaaggcaactactgttgtacgtcctca

SEQ ID NO: 25009 - DNA, 1501 bp, Oryza sativa
tgatcgacggggtgccggcgagcctcatgctgggcctcgtcaagaacgacggcgccatcaggctgagcgtcatccgcctcgtgctataggcgttgccacgcacgacggcatcgccaacgatgagcaccaaaataacaaaagcacaatggaatggagataatcggcacggcaaagaagaggacatcaatgagcacgagcaggtatctttcctcccaatcgacaaattttttggaaggagagaagaacacagccagttgcaaaaaaaaaaaaaaattgtcaattgcggttaaattaatcacaagatcgagttatttgtcttctcttttctgaagaaaagggaggagaaagccaagaaaccaacaaccgtggggaaggaggagaagaagaagagagcggcggcggcgatcacctcctgtcctctcgttgcgaggggctcctccagaagccggcgctgtagaagctcgcccacacctgcttctccatgtcgacgaggtgttcggtcatgggcgtggctgggaactcggcctctaccttcctagccttggtggccgcgacggccagcgaccttggggaggcgacgtccagggcgaggagctcgcccatctccttccgcttcgtggagcggacaccgcggcggcgcccaccacagacggcgtggcggggacgtggacggccgcgaggacgacaagctcaacgacggcgaaggggaagcagcagcaaaccgcggcgcactccgccgccgtcccgcccgccacctccccgcaccgcgactgctgctcccgcacccgccgccactcccgctccctcctcatctccaccgacgagctggaccgcgaggcggtcggagacccacgtcttgagctcgcgctgccctgagcccgcgcgccgcctgggggaagctcgcgtcgcctcgggagccaccgtcgccggccgcgcgcgccgccgtgggtgccctagcaccggcatccccatgccctgcgagagtagagagcagagagggacggcgagggcgagcggcgcggccgggactcagccgacgcgggcgagcggcctcagcttcttcccgccggccatccccgccgccactgcggagaccccgcaccaccgctgcaggcgatggtgcgcttccgcgacgctgggtgcaccctcagcctcatggaccggcgccggtgagggcgagcggcgcggccgggacttggccggcgtggtctgtctgacatgtggggcccatgtgggtcccgctgactcagcgtccacgtcggacaaaaccggggttaaaaccactgagtgaatggtttgtaagttgaggatgccacgtatctggttttgtaattaggggacgattttgtatctcgatgacaagttgagggaccttcggtgtactttttccttatatatcacagcccaaagaagagggaggtaaaatagactttttttagctatatatgtcacagcccaataggagggagaaaaattagacttatgctgaggtaaagcgcga

SEQ ID NO: 25010 - DNA, 184 bp, Oryza sativa
aacagtacatataagtaatttgttacaaaatacttcctggatacagtaatggaaacctacttgcttaactagatgtcacaagctaatgacatagaaaagtcaaatcatttttggggcaatatagttgctggcgactaatcctaacaggattaaccaaaacagatatttccagaacctaacagag

SEQ ID NO: 25011 - DNA, 1501 bp, Oryza sativa
aagaagcaacaagtcaagcatttcaattacctcgattcctaggaagatgggcgccatcctctcggcccctgtcaaccatgcgcaccagtcacctcggaacatgccgaggacgagcacctcgtgatcgtggacgccgccacggccgaacgcgtcgcaggacgggcagtagtagagcatgcccactcctgcggtcgcgtcggcgacggcgctcatgtcgtcgacgcagaccaccgatgatagcatcctcctcctcaggcatactgagcagacgcctccctcaccctcatcggccacctgccgccgacgacagacgacgcacctcgccacgagcgcctcctcctgaacgccatccgcgccatcaccatccgggcccacctcgccaccgccgccatgaccgcgcgccgccgccgcgccggcctcgcccgcctcgccgtggtcgcctgcagcgccgccgtcatgcgtgccctccgtgccatccaatccggtctccttggccgcggatgaggaacgtctgcaaaaaaccatttccaatcaagaaccattcttttggtcaagaaatctggcaagaatcgatttcttaatgaaaccatggaattcagttctcttcttacctcggggagctgtcggccaacaagaaatccgccacctcgccaccgccaccggtcgccgcgtcgccggcgccgctgctcttgccgagctgggccacgggtacccccatcctgaaagaacgcaggagagatcgaaacaggcgcgcgtcgggaggcgaactcgaggcgccggtgcggaggaggaagaagaggagagccaagaaaggggagacgaagggcgcgcgtcgggaggcgagttcgtctgagacgaagacgaagcggagacaaggaagatgggcgcttgtcagtcagtatacatggccatatgggccgcccggccgtgcctgggccgaggcttgtcgggtcggcacggcccgacggacgcaccgggccgtgccgtgccagcccacgtgccgcactcacggcccaggcacggcccaacacgcctcgggccgtgctgggccggccccaaggcactacggcccatcgcgctttacctcagcataagtctaatttttctccctcctattgggctgtgacatatatagctaaaaaaagtctattttacctccctcttctttgggctgtgatatataaggaaaaagtacaccgaaggtccctcaacttgtcatcgagatacaaaatcgtcccctaattacaaaaccagatacgtggcatcctcaacttacaaaccattcactcagtggttttaaccccggttttgtccgacgtggacgctgagtcagcgggacccacatgggccccacatgtcagacagaccacgccggccaagtcccggccgcgccgctcgccctcaccggcgccggtccatgaggctgagggtgcacccagcgtcgcggaagcgcaccatcgcctgcagcggtggtgcggggtctccgcagtggcggcgggga

SEQ ID NO: 25012 - DNA, 1501 bp, Oryza sativa
cgtgttggatagtataggaagaggggaataatgcaaatattggatacattgtattgagcctcagggggccgatatatataggagtacatggggaagagataaggaaggattacagatatggaaggaatccaaacaaaccaatcctatcctaatatgactctaactaccatatactctaacatcccccgcagtccaagcgtgagcagcgcggacacttggactggagaataaaccggcaagagtgctcaacacggatgatagccctttgtgccatggtcgacgtagccaaagcgaaggagccgagagagccgtggtcgatgaagccgtgcgcagaatagccgtggtcgatgtagccgaagtcgggaagctgatgtcgaggtagccgagccgcagggagcgcatggggcgccgtagagtggtcgtggatggactagagggcgtcgtggaccaaggtgcgtgaggacacgcaggagacgaagacggggacgcgatcacgacggtcgttgaggaagatgacgtcgaagagccgatgtagtcgaaccgtgaaggacaagacgtcacaccaggtttgccagacccggggacaactcgggacgaacatgcgcgccggtgttgccaataccgcgcgggcgagatagaggaccaccatgaatcatacaccaatgtcggagaagaccagcagagaaggcctccgggacggtcgcggcgcgagaacggcgtagagggagaattgccggagcagcacgcagttgccggagaagagcgaagtgtagtcgaggaagatacagcaacgctggcgatgagtcatgctggacgaagtagaaggcgaagtagcgggaccaacggcctggacggcgacgtcggtagccttgtagaggtagctgcaccaccggcctagagtggcgacagtggcagcttggagatgcggcggcgatgctcgaagtagaggaagaagaccctgagcggctgacgatgaccagtgcggacgacgaggttgtcgatgcgtgaacggcgatgaagacgacgaaagcggcgaagctgcggtccgagaggacaacacagctgcagctccatgtcgatgcagcgacgagaagtccaccggtgatgtagccatgcttaggagggcacctctcagcactgcaacaaccagtggaggcgtggaccacaggcggcggcactgtggcccgagggggcgacgcagcggcaatccaaagcttgatggtgtagacgcgtgctcgatgacgattggttgtagaagtcgacgaggcggtgggcgacgcaaaccgatctctgatcggaaaaggaaaataacagcagcaagcagcagcgcagtacggtagcacatcctctgttcctccatggtcccgatccatagaccaagtccagcagccttgcagcctcagccgtgccagcaggaagccatgaccaagtcaacgaggagattaaatccttcacttggccacagcctattcaccttctcccgaatatccatccacacaca

SEQ ID NO: 25013 - DNA, 1419 bp, Oryza sativa
caccacttgaggcccaaacctaaaatccatgttttccatcattttatttgtcaaatacttgatttattcatctctgtccagaatcttaataaaatcatttttcatgttaatatgagcccaagtgataagtaaaaccattctaagcttggctaagcaatatagtaaactagtgtaactcatattccaagtagtaacaggatatgattcctaaggttaggaatgagggatatggatatatgcgggattaaggtgataatgcaaataataggagtttgtctaacaagtttaacaaaattttaatgtattagtgtacaatcgacatgtaagatttgcaaacattttcaataaccttcaaaacataggttcaaagtgatcaaagagagagggaggtgggacttgccttttaactagaaaaagtcagcaccaaaatcacttcttcatcgtttaagcaatcatctatataaagtacacattatgcaattaaacattgaaatatgcgaaaaattcaaaatgctctaaaatgcatgatttgtgcacagtgaataggtaccggtctaatatgaatttaggtgcaagaatttctattttatctctttttatttgtgagttatgaattttagaagtttgctcggtataggatagtatttacctaggtagtgttataaaatatttttatgaagtgattcttactaactttgactccacagatatgtagggatgtgttttctaagactaacacttttggtttcacaatttttggagttataacgtgttctaggtgtatagtattctatatgtgcatgacgttagagttgcatgttcagaacatgttacctcttaattaagttgagtataatgaataattttgttaaatatttcacttttattttacaagtttagggctttcattatcttggttcacattttataactgtggagattatggataccccatacccacatggcatgtatatccgactgggtacagaggtaccatatgtagatagaatatctttaaagggctcgggttaaattcctaacttgtgtattaaggaaatatccgggatcctagtcggttatgattgtattctatctttacttgcctattccattaggaatatgggctgtatgctgtaatacggactccttacactatataaggaggggtccgggtgcctcttggggcataacttttctcccagatcatacgatcaataacaaactcggcggatcaatccccggacatgagtagggtattacttctcattgagagggcctaaacctatataaaattcattgtctccaaacccatccacttttcctgcttgatagccaccccttttcgtattgccgaaatcttgtttcgacagttggtgcgccaggtaggggttgcgtcaagcttctcgctgattagtgcga

SEQ ID NO: 25014 - DNA, 427 bp, Oryza sativa
cgatatcgaacgtcgacgaagagtttgtgcattactgttttttcggctcgtcaagaaaacaacgggaaaagaagagtttatgcattactatttttatagttcggctcggtgagttagtgatattttccacactcatattccattgttttcaatcctctgttttacctataaatttttttcctatttttatgatttttctatcttatgttttttctagattatttttgaaaacttatgtgccaaactaatttaatgatctggtgtgctttggtcccatattttcagctatattagatagacctatcatataacataagcatattccactcaatatggtgagctactttagtgatttggtgaaggaattttatgattcttaattgttgcaataaatgattcagtaataaatttgttttttcattgcaga

SEQ ID NO: 25015 - DNA, 1501 bp, Oryza sativa
gtagatattaactgttgtagatattaacgatatataatccttctgttgatgtatatttaaaccaattgattgggatagatcggtcgtcatgccgagacagtataaatcacttagatcgaagtatacattaacacaaagattataaacgtttatagcatagccgatcagatagatctagcatgtatcggctaatactccgataccactctatattacagatagaatatatcaaacaagaagcctaatatattttaatgcaataagatcttaatataaagggcggatttagcatatcaatcaagcatataggacgtaaagtagctaaatcaggtaagatcagctgaaaccccgatgctatctctctctcaatgatcataaagcaagccagatgttacaattatagatattacttaatagatcgaactcaaccgatgagcatcaagcataaagataagtataagatctaggcaagatgataaaaactataagagatgataaatacatgatataatctagattaatagcaaaacataacactatcggtcacttcctaacgataagaaccagccgataacaagttatatagtgcaactaacaaagattacaatgtgtatatgataactcgacgaattacttaaacaagattagagtgtcgtaaagatggaagcactaatcccgataacgcaagctgccatgacaagcttacctctagttaaagatcgaatcgatgcagctcaacccgaaagcaagaactcgtcgaaatagaacaaaaaaaaagggtggcgatgcgccgatattatattgaactgttgttaattgattacatgggttcggattctatttatacccgaaatacaaaatatgtccttgccggacacgacccctatctctaacaaactctaagatatcataagtctttgcgacagacttttgcccaaacttatctctaagaaaattacacgagacatcctaattaatagatacaattgcctatctgatagctttatctctatcgtggcaatcctcatgaagcatattgatcgattctagaaacagctctgaaaccatcgtcattggaatcggctgcatcacctctatcggctgtcctctgtccgatccatatcagccgatgcagattccagccgatgcatactctgttcttcgaattcatctctttgctgaatccgcctcgatcccaacatcaaacctggttcatatcttactaaatttggtcgtaaacacacggcccaatactactcgggccgtgccgggccggcccgaaggcacgatggtccatcgtgcttctccacataaaaagtctatttttcatccctcaactctgtggctgtgttcaaatggctggaaaataagtctattttgtattcctcttttctttgggttgccttatatggttatataagtctattttgcgtccctatatttttttatttgatcgggccatgccgggccgacccatcgtgtcgaggatgtagcccaggca

SEQ ID NO: 25016 - DNA, 1501 bp, Oryza sativa
gtccgaattaacaagcgataaaaaaaagcttccgtcgtcgtcagtaaaaaaaaaagaaaaaaatcatctcttgtccgactcatgtagaaaaaggaaaaaaaatctcccagtaaaaaaaagtccgttgtttttttggcaccagtattttttctgttgttctttgcacgcaaaagagttttttatgcgcacatgctaaggctttaggttttttttttgtcccgttttattaatctgatctgtccactgcgcgcctcctgggcgcatttagtttttttcgtcaatcttttttgtcgccagttttttcttccgtgcgctttttctttttctcatccggtttataatcccatctgttcgccgcatgccttccaaggtgaaccctagcgccgtgccgccgccatatcgatcatgtgatttctcctccaatttgattgcaaaaaccgattccccactcctctctcatcattttctccatgattttcccttcgattcgtctttaattgccggatttaatatctgctttacagttgctaatgatgacggcaatcttccccggtcatttttatctcgagttttacgctctgattttggggaaaacggaaagagtacatcgaggggatatcgatcaaaaaccctcgaccaattttggctaaccgagaaagattcggctggatttgatggggatatttgctccggcaaacgtacgggcacgggcacgagattatcttcgggaggttgaagatgatagtcatatttggaaagttgaagatggtagggtcgaagagaagcaaaccaaatggaggtatagatggccatatggcccgaggcccacagcccgacccaagcacggcacagcccgactgggtcgtgcccgtgctggcccggcccgacagccgggccatgcctgggctacatcctcgacacgatgggtcggcccggcatggcccgatcaaataaaaaaatatagggacgcaaaatagacttatataaccatataaggcaacccaaagaaaagaggaatacaaaatagacttattttccagccatttgaacacagccacagagttgagggatgaaaaatagactttttatgtggagaagcacgatggaccatcgtgccttcgggccggcccggcacggcccgagtagtattgggccgtgtgtttacgaccaaatttagtaagatatgaaccaggtttgatgttgggatcgaggcggattcagcaaagagatgaattcgaagaacagagtatgcatcggctggaatctgcatcggctgatatggatcggacagaggacagccgatagaggtgatgcagccgattccaatgacgatggtttcagagctgtttctagaatcgatcaatatgcttcatgaggattgccacgatagagataaagctatcagataggcaattgtatctattaattaggatgtctcgtgtaattttcttagagataagtttgggcaaaagtctgtcgcaaagacttatgatatcttaga

SEQ ID NO: 25017 - DNA, 1501 bp, Oryza sativa
aatccgattttttcgggagataagtttcgtaacactatctatctattacttcctccgattcatattataacttactttaattttttctaatcaaacgttgttatagatcgaattagtttcattaaatataacattgaatatattttgataatatatttgtttcatattggaaatgctaatatatttttctatagaagtgacatataatatgagaaacgaaagtagtatattattaaaaatagctttgaaagtaagcaccgcattaattctgaaggctagaaattatcacattaatcaaataaaaagaaaaaaaagatcttaagaattaaattatggtaagtccaaactacaatgatacatattgattgatataattgtatacaaaacataattaaataaatagaaatagaagctgtgagttgtatataaaatttaagcaaatccagacctaatagaaaaatagaagctaagtgtggtatataaaatcaaatatacccctacatataatggtatgaatataaaaaattagagttgtatattaagtctaactccacatgcattatatagctccgcgtaaaactgaatgaggcaatcttgtagttacctaattatgaaaaggtataaatgcgtgattagaactatatctcaaagatcgtaagaatatccaaactgggataaaaatggtcggaaacaatatcattattttattatttctatgaaaacagtcggaaaatttcatagttttgaatttaactatctagtattaacttcaatgtaacagaattgagaaaaactatttttttagaaacaataatagtcgataaaaatattattatgatattagtttacagaaagttatcggcgtggtcagaaaattttcgtaccaccctcaccccttcccaaaacgatatatatgtccaggagtttctgacttttgggtctacgagccttgaggagagaagaatatcaagtgctactgtactatcaatgttaaaaaatacatccaaaaagttgcaaaagaaatatgaaaaaattcggagatgtgtaggtatgaaaaatattaaaaaatataaaaaaaatcaaatcaaaatactatgtaggtagggaaaaaaagataaatcacagttgattggtaaagtgacatgcttgaacactgttggagcacaaatttattattatttttctcctacatcatattttaaactgatttttttgtgtgatgctacatgtcttagagctacacatctctgatttttttttacatttttttgcaactttttggatgtattttctgacgttggtagcacggtagcacccgatattctctcgagcattgagcaaagcaaccaagcaagcggcagcagagcgcgagtcatgcgacccacaccgcccaaatcctcggaacgcaaagctccccgctactactctactctcctactagtcgtctactactcggccaggtgaggtgcccaaccaccgccgtggtagcgagcgcgcgaca

SEQ ID NO: 25018 - DNA, 231 bp, Oryza sativa
ctgtagaaacacccatagaacatgtagaaaaacctaaatcaaaccccaaagcaagccaaggcaggagcttgagggtcatgaacccagatcttggtctacatatctacaccacaaaagggcattgtccttgatggtagtgacctcgttgacgatggctgcatcttggaacgtggtgagcagctccacctccgtcatgtgctcggacacctaccccacaaacaacttcgtgat

SEQ ID NO: 25019 - DNA, 1501 bp, Oryza sativa
ttggggatgagacatattctagtatgacgaatatagatatatgtttatctatatttatcgtattagaatatgcttcatgtttcatcctctaagatttctgttttttttttggacgaagcgaatatgtatttgtagccacgtccaggggatccagagccgtatgtgtaagttacagatttgcgcttcgccactttggctgtggttagttcagcgtaaagtttggattttggttgaaattagagatgatgtgactgaaaaattgtgtgtgtatgacaggttgatgcgatgaaaaatgactgaagtttggatccaaactttgatctaaacacagcctttaccatgctatgaccaagagctgtgacgcgcttggaccctgtgcaagtcaaggtcagctcaactctggttttgtctcagttttcttgtcttgatatgaaaatggaacagaattagagtgagcatcttcagaaatccgatcatctttttcacattcgtacatcttgataatgtacgtgtaactctgaacttctctttcagatgagtttttgtttaagctgtgtttcttttttttttgttgaagttccaacacatctttctcgttttccaaactattaaacggtgtatttttttaaacaaaattatacgaaagttgctttaaaaaatcatattaatcattttttaaaaagctaatacttaattaattatgtgctaatgatcattccgttttacgtgcacgatatattagttccgtcagcaaggaacgaaagcaacctacgagtgtactccctttataaaaaaaaaaaagctaacctaaagagatctctctcctactagtacaatgaaaatgaatctggacaactatgaggggttagtttttttttttttggcataggggagtatttgaaggggggagaaaaaaagaaatttgagaaatatgtaaaacgatttaaaccattagcgtataattaattaagtattaattattttatattttttaaaaaaataaatattatgattttttaaagggagaatagctaatatggtccttaaagtttcgctcctgggtcattttagtccttaatatttcatattgtccaaacaagtcctttaaatttatcatgtggactgatatagtccttggtcccaccaaaatcaccacatggacattgtcggtgatatgggaccgggagtatcatgaccagaggcttgaggcagacgcaatcgcccacatggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtca

SEQ ID NO: 25020 - DNA, 1501 bp, Oryza sativa
gtacgtactaattaaccaattggagttttggtctcgttactcactgtaaaaacatgatggtaaaaaaacagtttaatcctattggtactcttttatcccattgaacattttgtcgttgtgtcattgactactatcaaaaaggaaaaacagtggatgactctttcaggaaatataggatagccccattgatggcacattttgaaccgttcatgatccctgatttattctcttgaccatattctgcactgctatgcttgctaagtaatacaaatatatttatatccctgtagcatgtcagttactctataagacaattttttttacataactaattaacatttttactaaactcttttattttgacaatcactctaagacgtatgcaattgcgtcttacgaaagcaagtgaccctgagagcactgatctttgtaaagatgcacacagcttactgcaggagaggataacaaaatagaagtctataaaaatctatagaagggatcaaatatgcttgactgaatgatagagatggaaaaatgaagaagtgatgactgttgtttcacaatgtattcatttcatctatcctataattgtagtggtgtgtcaatgtgtgatacttctagattttcccagctccattttgccagctccgtgtgtgttaatgattcagaagtcgtggaattgcttggaacatgtaatttattctcaaccattttttgtggaagtgtggatgtgcattgtctaatatattggtattgaagtgattaaatatgattattgatcgttttgaattaatattttagataatataatatcactgtactttgccttgatatctgacctagatcaaaataaagctcaattgggtggattctaggaaacatatttttactacttcctccatttcacattatgtgtctagattcattaacatctatatgaatgtgggcaatgctagaaagttctataatatgaaacggaggaaataacgtgtaattcgttaacaaaaatgtattataacaccgtagagttagcacgggcagattactagtctacattagtgtcatatatgtactttttatactttgtatatatatcctagtgggccgtaggggtatttccttgaatgggggcatgaacctatataaaatcttctcggaaaatatagggattgatacctttctagtttgtacaattaatcacatctaggtatatgtaaaacatttattccgctactaatcattgacaaaaatctttaaaaaatcagaaaatctagagaacggagtcccgtagacacgggatactactagtaaatatccagcaccactactcacaccacctatttaatcttatcctctccttaatctcttccccttcccctccacacactctttctctctctctaccacccacatgagcacggaggcaatgacggcagctggtcatgcagggtggcgcgtcgggcgtcgaggaagttgccgtcttgatcgccgccgttgctgt

SEQ ID NO: 25021 - DNA, 1501 bp, Oryza sativa
aatgaaattttatctgaccccattttatattggaatttattaattaaaattagatcttctcttctagacttttaaaaataaattctaataattccatttaaacaacaatttatatatttaggatttttagggtgtgacagctatgcccccgccaccaacgtcggcccaccgcctgctaccgacctcgtggcgtcgtcgccgcctcgccctccacccttgttcaccacccattgtcagtccgctgcccctagccaatccctctaagtctgatcccccactttcccctccctagttccactcactccaccaccaaagttctaacgctaatcttaagttggggcttgtcgttatgtggatgggacgcgtttgtgagatggacatctcgcgagtgtttgcgaactagtgtttccacatgccaacaattcagtagaaggcagaagtaagaggcaaagtgagagtatttgctgctacccagtggtcactagctaatcgatcaatcggttgtgcctaatttctaaataatgaatatgaattcaaatgatgatggaggcttcaaataagaaaagcagtgatgcgctacccgatacgttccttcatgcttcaagcttggccagtgtttttttttcttggcaagttgtctgtgactctgtgtgctacgccgacggctatgatgattggtcatctaggtcattgttgacccccactagtagaggataactttttccatggagctattgatgggatgaaaacagatatagcaaagatagtgatgtttgattatatctagaccgtagataaaagacaatggttgatattggctcaaatccacattgtgaagttaccaactctaggagatccgcacctatagtattactctcggctgatggaaacacgtggtctgtggccccgattgcatcaattatgagtggattgtctatctagccatttgattttgtttaaaaaaattactttttgaaatttgaatggttagaaattctttaaaattttgggaaactcttataaactaagggtgcacccatactataaacctaacctaatccctcctttatcagttggccactccctttgcttgatccgtcaccgccaccgccggcctctctcccatctttgtacctctttgcctaattcatcgctacccctttctaacctcctcacttccctatgcccgatctgcttccctcctctcttcccaccatgctaatgcacaccgttgccatatgtttcgtctcctccttcccgcctccctatctcttgtcctgccctcattttccactctagcacgattctccctatcccgcatctccccattctctagcggcttctatcatcaagcttgctacgatcaccagtccaacaccctcctccctcatggttgaggtgatctctgcttcactgcggtgtgtagtcggagagacgccagaactatggagggcgacaagagcatgaatcttgtgcatggttcgatggtgagtatattcga

SEQ ID NO: 25022 - DNA, 1501 bp, Oryza sativa
tggcatagtagggtttcatttgcataaacagcatttaataaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcttttattatggtgagaagtgtgagactaatcacgaaagacattgttaggcccgcccataaccgcgggcacggctattcgaatagttttactctgatcagaggtgtaccactgtacccacaagacacagccccacatcatgtcactatgtgcctcaataccaccacggtacctcggaaaggagctgtgacaataccccttgcacaacacaatccactacagcgcacctttcctggttcataatcacccccttataaacaaggcatggactccccagcgacccctgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgccatgagcacgactctcaaaaccatgtgctcacaacccaccattatcaagttttagttggcaaataattaattaaccaatcacgattgacaatcgtgatctatcattaagccatcattaaatactagtgaatcataagttatcccaatagtgtgctaatgtttctaagcatggctaagcaatcacatctaatatctagctgaaccaatatatatagcccaactagtcaagttataatcacccaaggtatcaaggaataaagtaatcaagaacaaaagggctataacaaacaataggttaattccacccaatgacattcgaaaataaatgcaatatttgaatagaaacaatagctttaaatgggatcaacatgctcaaagggttgtttgggatctgtgtgacttgtcttgctggccttagaactcttcaaattcttctcctgcgaaaacggacactccggaaacgtcggaatctaaacagaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtggaccgggcgcacggcagcggctcacgggaacgaacggccgagatcgatccatccaaaacggacggccgagatcgatcgggtctacggcggctcacggcagacggaccctga

SEQ ID NO: 25023 - DNA, 210 bp, Oryza sativa
acagaaccgtcgttgtttgaagtgaacactggtactaaaatttgatcagtctatgctaggtttcaggcttgtgaaaagaattgtaaaattagctttatgcaaaagaacctgaagccattccttgaaataccctctatcatatgcattgttgttgtggtggcttgctgagtatggttggtactcacccttgctattcatatatcttttagg

SEQ ID NO: 25024 - DNA, 584 bp, Oryza sativa
ccaccatgtgatttattttaattaaccaacaccaaagcggtggcactaatccaacaataccattagaaccaacagtctaaacattaatagaattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatagattctacacatttttcttgatttactgagacttgaatgggcttaaacggagctcggatgaattagttatgaattttagaagattcactgtgtttattactataacaaaaagtccttaa

SEQ ID NO: 25025 - DNA, 408 bp, Oryza sativa
tacagtagttcatcactgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaattctcacctgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttcttt

SEQ ID NO: 25026 - DNA, 665 bp, Oryza sativa
ccgatggatgcagggttttgagggaacggtggagattcacaaccaatggcggttggagggtattaccgacctttccaaccgccataaccgtcattacctgcctatttaagaagctcactctcttcacttcaacacgcacctcaagcaagagctctctcattcctctcaagtttagtttagtattatctagctggtggaatagaattagaataggaatcaggagtccggaagccttcagaagagttcgggtttggctctagtagctttcctttcctcttttgtaagctttgtacttttattacaatactcttctaaatacattaatggtattggaatactttccgagtatataagtacctactttacattatgttcatgttatactgagtatactgctagcttatctgggagatgctttggtgcgggtatagtgtttgcttatgcaattactctatgtcatgacaatgatattagagtagtatctggtagtttagacgtggtgtctagattagaggatatcattatttggggttatatattgaagacgagaggtgggccactgatactgacagctcagtacgggtattcctcctcgcctatatataatcctaagttaatttcctggggagggtattcctccgtatttagccccggttggatggtca

SEQ ID NO: 25027 - DNA, 223 bp, Oryza sativa
gaacgggtcgattcgaagctcgtatgaccaagatatgatcatccgaagtttaatgctgtatatggagattggcggattattataattgagctttgcaactataaaacaggtgtaagcgctagcctggaaaagacaggaaggctgcgccgttgacatgcggaccccacatgtcaacaaaaaggaccgcggtagaccgagtacacagagacggtccaagggtcga

SEQ ID NO: 25028 - DNA, 664 bp, Oryza sativa
cccattgctccttgcaaaagcttttctcatcctcccttccccgtctttcaacttgctttagatgaatcccttcaaggagaggttggaaaagatgatggcacactttgatgaaatttggggtgatctgcagacaaagattgatcagattaatgagaggagagaagctctggaaagcaaggcattattctaaaggaagctgagaaatatgggaacgatggttttacaagtgagctttgtcgtatgacgtatgatcttggatatgaggttccaccaatgtacactaaagtatctacttatgttggagaccaattgcattgaaagacaactgttactctcgtttctgacaaggaagatcttctccaactatcatttactagtgaggccgattgtttcttctatgctcgtgaaggagttgtttacgaagctttgtgtcgtctccggcatcatctcaaggatcgtctggggaatactatatatcactaccatctaaaacatggtgatgatttttggatgatttgtgcacatagtcgaggagaagagaatcaaactatggtacctatgactacaaggttggatgcactttatgacctccacattgattacaagactcaagccttaaatcagaagcatgcccaacaggagaaaattgccaagctatagaaga

SEQ ID NO: 25029 - DNA, 567 bp, Oryza sativa
ttaattgtcatgagcccaaccatcaaaaccatatgctcacaaccccacctttaaccatgttttaattatcaattaattaactttacacgattaaccatcgtgagctaccattaaatataaccataaataataatgtagtatatatgatccatcccattaattagctaatgtttctaagcatggctaagcaactatacttatagcatttagctgaaccaatccaatatataaggtccaagctaatcaaattgtaacccataggaaaataaagtcatcttcggccattaattatctgggaaaggctcaccacccgatgacattcgaaaataatgcatggcttcacgaaaattgcgctataaagctttgaaatacaccttgttggatgatgaattgtattatcggacgattgatggggtattgcttaaatgtttgagtgcctatcaagccaaggttgcgataggcgtggtatatgtggcactcatgaatcggcttataagatgaagtggttgcttcggcgggtaggatatttttggccgacaatgttggaagattgcttccgatattaca

SEQ ID NO: 25030 - DNA, 1501 bp, Oryza sativa
gcctttagaagagtttgggtatggctctagtagcttccctttcctcttttgtaagctttgtacttttattagaaaactcttctaaatacatttatggtattggaatactttccaagtatatgagtacctactttacattatgttcatgttatactgagtatactgctagcttatctgggagatgctttggtgcgggtatagtgtttgcttatgcaattactctatgtcatgacaatgatattagagtagtatctagtagtttagacgtggtgtctagattacgggatatcattatttggggttatatattgcggatgagaggttggccgctgatggtgacagctcagtaagggtattcctccgcgcctatatataatcctaagttaatttccatgggagggtattcctccgtatttagctccggttggatggtcatgacgggctgtcgtaaggaactcggcagtcaggggtggcttcttgaagtaccaggagggcatcggatagagggtattagctagtataccagttaactagaatgtatgtatactatgtatattagaggtataggaatagattctctttctcttttctttccacctagcttagattaattattatgagcatgagtagtaatgcttgtgtgtcactctacccttggattatcttaacccctgcttataatacgattatcacaagtaatatataagttattagttgagttctctctacgtgatcttcccatgggataaaataaatacgataccctttgaatactctcggatgaagtgctacaatggtatatccgtgcgcttgcagatgaactctataaccataatataccagaagtatttctgcgtcattactggaaattatatttctagtaatgtcgttaagaaataccagcaagcatttctagcgccgttgccggggaagattcatgatagagattacttgaactaatactttatatttacctctgtataatcattttcctttgcaggcttatcttggttgttttcactctttcttgtgaaaataactggtagtgcattttcctctgtataatcattttcctttccgttggtagtgcatgactggttccaacctgccggaaaacttcaaagaaaatccataagttttcttccggagcatcaggccgcgagtcattgcttcgcagaaaactttaccgacagagaaaccagccgtaccagcgccaccaagactcttcgcgagttcgctgctccctctgctgacaatgtggccatcgggccacaagtcaacataggagatgtggatttcgatttgaagtccagcctcatcacgatggcgcaggctagcccgtcctcatcatgggatggatgactgtctgatcctacagaacttttacaatgggctcaccctgatgtcccgcgatcacctggacgcggcatctggatgagccttcttctctaaaacggttcaaggagccgttgaactcatagagaagatggtctccaatatg

SEQ ID NO: 25031 - DNA, 1501 bp, Oryza sativa; identical to SEQ ID NO: 20720

SEQ ID NO: 25032 - DNA, 389 bp, Oryza sativa
ggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataataacaataataataaggtcataacaaaggtagataggcatggctaaataaaacagtgataacgcgggaatttaaataaagcgataatgcaataatttaaatcaacataattttataaactgggattcaatatgttcaaggatgatgtgacttgccttgctcaga

SEQ ID NO: 25033 - DNA, 565 bp, Oryza sativa
cgtcgcgtggtggtaaggatcagtcctctcgcttcccccgccctcgtccttccggtgtcgccccgtacccgttgtgcggtcgtcgaccccggtacccgtgtaccggtgtcggtagtcgttcacgtgtgcgggtggtgaccgggtagtgtccgtgttagtgtgcccgctcggtagccgcgtggtttccacgggtgcaggccgtgtggtgtctagtggagtccgtttgtcggccactcgcctcggttgacacacgggttccgcttccgtcgacccgtggaccgtctctgtgtactcggtctaccgtggtcctttaggttgacatgtggggtccgcatgtcaacggcgcagccctcctgtcttttccaggctagcgcttacacctgttttatagttgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttatagg

SEQ ID NO: 25034 - DNA, 423 bp, Oryza sativa
tttgtgcatttgataccatggtgcccgggcaccatggtgccccatatgagtgtcatatatatatatatatatatatattaaatgttagatttaataaaattaatttaaagctataaactatatttttctataaacttgatcaaaattttaaaacgtttgacattagaaaagccaaatcgactttgtcgttgttttagatcacgactacggtatttgcattgtatggggatcgttggtatcaggggatatacaaggttgaggtaaaatacatagagataaagatttttatacaggttcgagccccttcatcggaaggtaacaacactactcctgttgggcgaaaccggtgttactcttattcatcataatcatacaaatacaatatttgggataacctatctagtcgtcgtcggcttggcagca

SEQ ID NO: 25035 - DNA, 1501 bp, Oryza sativa
actatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggcatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttt

SEQ ID NO: 25036 - DNA, 369 bp, Oryza sativa
ccctgttatcatcggtaatggaatatcaagtgaaggctcggttcataaaagacttgtctttcaattaatggaatggatcaggagataatgattgctagcccaatttagtaatagtcaggctcgtgaatgatggcagaagttgtaatcgatcattcgatggtttcttgttgatggcagtaatcatgacattatttctgttaatagtaaccatataatactatcagatgtgatcaacaaaagtatcatcaagaaaggtcgcgctcatgacaattaaggaccggttcgcgagctattgttgtgagacattaaccgtaccaaccacaagccagcgtgggcaatggctttatcttttgtatagcatgattcatt

SEQ ID NO: 25037 - DNA, 1501 bp, Oryza sativa
tggcataatagggtttcatttgcaaaagcagcatttagcaaacatttgagaatttaataaaacagttaagtaataattaaacaatattaaatcaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatgagtcataagttatcccaataatgtgctaatgtttctaagcagggctaagcaattatatctaatatctagttgaaccaatatacatagcccaactagtcaagttataaataacccaaggtatcaaggaataaagtattcaagaacaaaagggctataacaaagaataggttaattccacccaatgacattcgaaaataaatgcaatagttgaatagaaacaatagcttaaaataggatcaacatgctcaaagggttgtttgggatctgtgtgacttgccttactggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaagggatttattgcgtcagcgggctagggtttcggtggaccgggcgcacggcggcggttcacgcgaacggacggccgagatcgatccatccaaaacggacggccgagatcgatcggtccacgaccggctcacgggagacggggacga

SEQ ID NO: 25038 - DNA, 1501 bp, Oryza sativa
gtccgttttcgccggagaagagtttgaagagttccaaggccagtaaggcaagtcacacagatcccaaacaaccctttgagcatgttgatcctattttaagctattgtttctattcaactattgcatttattttcgaatgtcattgggtggaattaacctattctttgttatagcccttttgttcttgaatactttattccttgataccttgggttatttataacttgactagttgggctatgtatattggttcaactagatattagatataattgcttagccctgcttagaaacattagcacattattgggataacttatgactcattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtatagcgttgatttaatattgtttaattattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcagtgaagctgatggtgtggaggattaggtgtagccttggtcaagctgcctgtggtgtggagccgtctgcgccgtttatcttattttccgctgcttagatctttattgattgagttgagaggaactatctacctctgtaatgacattttattcgcttattaattagagtaataaatgtactctattatcaatttgttattgtgtgcctcggctgattcctggacgagggttcacacacatgtaagcgtttggaattttggatagaaattccgggcgtgacataggtaaagcaaatgtggtagc

SEQ ID NO: 25039 - DNA, 278 bp, Oryza sativa
cagtggcacacttctaattttacataaatttcaatggcacggttcgaaatagatgaattgtaatgatatttttctgaatatacacatttacaatggtatggatcaaattaactcaaacttttactattggtatcagacgttatttttagatctagtagtagtttttagatttttagtacatatggggtttgcactatatatttttcttcgttgattagtgcacataagattcaagtatcgtgcaagggagaccacgtcactgtcaacttatcgacaga

SEQ ID NO: 25040 - DNA, 204 bp, Oryza sativa
tgtctatattcatataaatgttaatgaatctacctgtctaagaaaatataggcaatactagaaagtcttataatatgaaactgagaaaatagtagatattactattttttctataaatctaatcaaactataaacaattttactttaactagagtcaaaacctctttacctaaaacggagggaatactttccatattcatttcg

SEQ ID NO: 25041 - DNA, 834 bp, Oryza sativa
ttctgtcatcaagtgccgcgcctaggatccttttacttgcagttgagtcactgatatatgggtcatagtaaagtgaaaccaacatgtcagtgactcagctacacgtacagttaagtcagaggatccgcttccaccgcgcctatatgcgcggcaaggccagctagattcgcatcttttcccgctcgccttcatcgaaccacccttcgtcgagcaccttgcgtgcatgcccatcgagctcgccatcgccatctgcctcgcccttcacctcgttcgccgacgagcacctcccgcctgtgcatgccatccccttgccgtgctcgccttcctctcgccctggagacctagcgcctagagtgccgagaccgccggccgaacacttggcgtgcgtacgcggcaactcatccagctgctgggcatggatcagccgctgactgggttcctatgccacgcgcgcgcgtcaaagccattgcttgcaagcaggcaacaacctcatctagttcgtcacatgctgagtcacgcacgcacgcacgctacactacgacagatccgggcgccactcgtggtgtattacctacgtgttcaggtattattcatacttcaatgcatcgagagaagcacaagaaccagaaggtcgtccaagtgcacgaggaaacacagagaagaaatcatgcatgtatgaccagagaaagtattctaaactattaaaagacctcgttcggttaatctctcccataaagaaatcgcggtggattcagagaagatttattctacatctattgtagtactgtgtaatataattattctctctcaatcccttccaatctctctctttgg

SEQ ID NO: 25042 - DNA, 1501 bp, Oryza sativa; identical to SEQ ID NO: 20681

SEQ ID NO: 25043 - DNA, 1501 bp, Oryza sativa
ggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatttggaacgcatacccgatttccattccatagggtcccgtgttcatcctctgtgaaaccagcggctttaccctgtttcatattcttgaggagtccatgcatgtccgggtcgttcttctgagcctcgcggatttgatcgagcaaggtaggtttggcttccaacgcagccaagaatccacgactaactatgccaaggttcagggcttccatctgttgattaagttcgggtggaatgccacggacgttaagagtgttgcaatggctttttcgactcagagcgtcggcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaataagatagtgccgccagatttttagagcatgaaccaccgcggctaactccaaatcatgggtagggtagttgccttcatgaggtcgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgacggtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttg

SEQ ID NO: 25044 - DNA, 305 bp, Oryza sativa
ttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattactaatactgtgtagctctaggatcgtctttataaaatggctttgggcaactaagtgacttttaaatgctgtttactgcaaaacttaaccccgatattattaccccttgtacccccttgcattaatcatgcatttgccagtg

SEQ ID NO: 25045 - DNA, 1501 bp, Oryza sativa
aaggaatcacccataatttcaacagcatcggcttcaacctctttaagcaattgcaatcctttgagaaccgcttcatactcagcctgattgttggtcgcatagggcttaataacgtaggcaaactcgaaacttgccccccgaggagaaattataaccaagccgataccacaaccatgagtgcatactgatccatcaaaaaacaatgtccaaggcataatttcaactgagccgattgagtcatcacgatgatccacaataaaatcggctatagcctgtcccttaatcgcctttggtgattcataccgaagatcaaattcggttaaagcaaatattcactcaaaccgaaagtcattacaacctactcaaacaagccgattgcacaaggacatctgaaagccgtcttatgaatgtcttcttctgccataaagatctgattgttacctgcattgacatccataaaacataatatcttatgccctgaagcagcatcaaccaattgattggcaaccggcattgggtactcgtcctttggggtagctttgtttagatcccgaaaatcaatgcacaccctgactttgccatttttcttgataactggaactatgttggaaacccactcagcatatcggcatggacgaataaaaccggcatcatacaaacgtttaacctcagccttgacagcttcaagcatatcggatttgcatctcctcggcggttgctagtatggtctaacccccggtttgatagggagccgatgttcaacgattgatcggctgagtcctggcatctcataatattcccaagcaaagcaatctctatattcctttaaaagctctatcaacttggttctaaattccggagataaattcttactgatgaacgtcggccttggtctgtcacctggacctatatcaatttcttccaaatcatcagccgacatgaaaccctgtccttgcttgtcatcgagattatctactgtgtccttggtatagacgtttgatgccctcaaaataataatttgggctctccatcttcaattggttgtatatcacaatcggacacttttagaaaatctccatcccaaacttttccagacaggcaatcaataccatccatctcccaaagagctaaatcggcactggcaacgtgccaaaagcgtgttgatgcaaaaacacgaggcctggaagatctacttaacttcagtgcaggtccaaaaatcttgcctttaggttcgtgagcacaccagttgatttgatcctgcaatcaacaagaaataaagacaaagaaaccacggttaaatccataaatgatagccgatcggccagcagccgatgacatatcatttatctttgagccgatgtcatatgtgaatcgatccgcaatcatgaataaataagaaagacttaaatctactcgatcggctgtagatattaacaatatataatctttatgtcgatatatacttaaatcaagtgattgggatagatcggtcgccatgccg

SEQ ID NO: 25046 - DNA, 1501 bp, Oryza sativa
caccgtgcacccacccgccgccacctctcccgctactccggccgcctctagccgccgctagggtcgccgccgcaccgcgccgtcaccgccgttgggtttgcgtggccgaggtccacctcgtccacccctccttcgtcgaggttagccgccggagccccattcccactgtgcgacggtgagagtcgccatgtccgccgccttcggccggcgttcccgccttctatggcccctctctccctctctaatcttttccttttcgttccttaggtcgtcccggtccccgtccgccgcgtgtcgaccttcctccgtcgctcctcgtcgccggtcgtcgccgtcccctccggtgaggactccgtcccctttcctttccttccccgattccccgtgcgccgccgccacccgcgctcgccgtcgccttcggtcgccgtcgccgccagggcgccgtcctctgccgccgcccgcgccgccgcttgccgtcgccggtggacgtgcgcgtgccgccacccttgccatggccggccggccggctttgtgccgagccgagccgagccaggccgccgccgcaccgtccaatcggccccgggccgatccgggccgtcgatcccgtggaccggcggtggaccacccgcgtggtcccggtccacggtagaccgaccacccgtgcgccgctgccgtgtgggccccgcttgccagcgccgcgcccgcccccccttgatgacgacagccctggggtttattgcgcaataaatgatttaaggactttttgttatagtaataaacacagcgaatcttctaaaattcataactaattcatccgtgctccgtttaagccctttcaagtctcagtgaatcaagaaaaatgtgtagaatccattaaaaatggttttgttccctgtttcagtagtcttatagcctgtttgcaatgttagccttgtatgtcgctagattccggttcttccgacgctccggtgtacttcgaaatagtcgccgaggttcctccagcagcagagcaaggcaagtcatgcttgtcacttgaacatgttgatcctatattgcaaatgctctattgtttttcttcaaatatcgcattgatttataatgttactatggggtgtttacctattgtcatagccatgctattgttataccatgtccctttgtcagcttggggttataacatgactagagattggactaggggttgcttagccatgcttagttcaactagtgcacagcggggaaaatccaattaatgtttagactgttggttctaatggttttgttggtttcgttccaccgctttggtgttggctaattaaaataaatcacatggtgggctgtgggtgcatggttttgctggtcgcacccatggcagttaaggaccggttcacgggatgccctggaagaacttatcgtacttaccacaagccagcgtgggcagcggctgggcttgtagtgtagctttcctctagtcgacgcatccaggcaagggtgggcgtga

SEQ ID NO: 25047 - DNA, 175 bp, Oryza sativa
tcctgcagccccccggtcgtctccttcctcccgcccggtttctctctctcccgtgcgaaccctagctcgctccctcctccaaatccgcttgattcaattggccaattccaaaattgattagggggttttaatccccattgattcctcttcaattccccccaatttcccccttgaa

SEQ ID NO: 25048 - DNA, 390 bp, Oryza sativa
caattaggcttaaaagattcctcttataaattagtcataatttgtacaattagttattttttagtctatatttaatacttcattcggtggttcaaacgtttgatgtgacatggtaaaaaattttaggtgataactaaacagcgcctttgcaaagaagaaggggaaaagtacgtaaacgaaaagagagagaaaaaacgagagaggaattaaagaggccgttcccggccagcgcgcggcatacgtgtgccttcatctagccacgcaattctcccccaaaatttcccccacaacaacgacccgccattactgcccctgtgcgcctcgcctcgccaccgaaccgccgcgagcacccggaggaagagaatcgaatcgaggcgagaggaggagcaa

SEQ ID NO: 25049 - DNA, 360 bp, Oryza sativa
aaaaattgccaacgccaatcgcggagtttcacatggaggagggaagaatggaatgagcgccaggcgtcgcgtcggcgcgcgcgtgagtgcgtgatttgtgttggttgtcttcctcttggcttcgcttcgctgctttgccgcgccttcgccgagggaggccgaccaacgcatcaatcaaacacacaagcacaccacgcggacgcagcagcaggggaggagacaatttcctattcttcctcgccccgcgtcgcctcgcctgagtctgactctccaaacgccgaccagtgacgccgcgagccttgccccttgcccgcgcagatctcaccaaaccctaccagatctgcgccccgccatggactc

SEQ ID NO: 25050 - DNA, 559 bp, Oryza sativa
ttctgggtgagtctaatatgcaagtaaacaattacagaacattatttcatttccttttataaaatatttggccgtatcatgtttgtttagctgttcttgctctttttgcttcttagtggcttggtgccacattgcctctcaggcgctttctttggcctctgtatacttgattggccatgtgttccatatttagcgcgctggatttaatgctcaataatagttaaagtaaaactagttgtccatatgaagacatctagatggatattccatctttaaattacgaaactggatgcacgtatgttacagtatttcattagttagttaaggtatatcagaaagtacttacaaaccatttcccctgggtttctttatggttgatattgtacataatatgagtcagtatataacaagtgacgttattccaatattccagtaacactactgcaataactattatgtccagttcttgctttatgccatttctagtggggataaaaaaaatcaaaccgtgaagggaatggttagcattcgcaccatgcccactgggggactcggacca

SEQ ID NO: 25051 - DNA, 278 bp, Oryza sativa
ttgatgacaattagttgctctattcctcttcctattcgattggtaacttacatcaattactcttaattgattgttggttgatggttgtgtagtagaggatggttcatggctagttgatgacaattagttgctccattcctcttcctattccatgactcttactcttcatcttccattcctcttataaaatgggaatggatttgatctcccgcgagaagaagaagacacactttcatccattttcaaaagctgttgctgctacggtaatcccatcccga

SEQ ID NO: 25052 - DNA, 512 bp, Oryza sativa
  unsure (1)..(512): unsure at all n locations
ttatgcgggtttgtttgcaggctgattaatgatagttatttatgtcaaacaaattgacgaagttaggctggtcaccaattgatatatagtagtacttgtgattgcgccctgacacgacacgacgntagtatgggagacagggtagctgtttaattagctgtccgcctatgcaaaattcatttttagataatatctacaaaattcatgaatttgccaggacagttgacgtggcctgggggcttgattgtgaatttgtgatgagtagggccgtaggggaactaatcgtgacccatgaggacaaccaaagccagaacaagggttggtcggggattaagccaggtttaaaaatttgaccggaaacgcaggtctttcagtttaaaaaaggagaggtctcgaagaaatgtttaaaatgctcagcaagagcttgggtcttggtcagaggttgagagccagagagagcctgcctcagttcaaccataccgggttggcctaccccgcgcttattatggcca

SEQ ID NO: 25053 - DNA, 906 bp, Oryza sativa
  unsure (1)..(906): unsure at all n locations
gattgctagtagtcatcctcgtcgtcgtcctcctcaacctcccgcccgccaccgcgttctccccggcgctccggcaccgttaccgcccgccgccacgttctcccggcgctccgccaccacccgcacgccgccgacgcgttctcccccgcacaccgcgccggaaccgtttgagagagagaggaagagtgagagggagaagagagaggaagagaggatggggagatgataggtaggtcccacaatttttttttataaatagagtgctgactgccatgcgtacgccacgtggatcaaaaccactgcgaattgggtcgagggggtaatttgtccgggttgcatggctgggggtgaaaaatacccggctttggggtttaggggggtaattcagacgaccgcgatagttcgagagggtaattcgnactctttcctttattatttattaaattacttaacgttgacactaatacgatgtaaaaaaaattagaaaaaataaaatttataaatagtgagaaaggtacgggtggaaacgatacctcttatacagaaacggagcttgatcgattgggaatttctgtgaccgttttcacccatatacggcccaataaccatttattggttattgggtctgcgggctgcaggcccaattaaatctcgatctcttcgcttaaaccaggttaattagcaggggattaggattgacacgagcgcagcgtggcctaactaaaccgaaccatcaactaaaccacccctggccttttctggtcaacggtcaacgctcagcatgcaaaccccgacctaaacctcgccatggattcgcctacaaaagcttcgcgcggcgcagccaccgagctgcacgacggcggccggcggcgaggagagagaaaccagcagcagttgcgacggcga

SEQ ID NO: 25054 - DNA, 252 bp, Oryza sativa
agtgagatggacgtgacactaatctggtgctggatttgggcgccatactgactgacagacaggatcgcttggagctcagatctcccaaatcttccgtaaccacgaccctgcacgatgacaagttttcatattcaagtcgatgacttaactctgtgttagagaatatggtagttagagttatattagaataggattgatttatgtggactccttccatatctgtaatcctttcttatctccttctcgtgtact

SEQ ID NO: 25055 - DNA, 1501 bp, Oryza sativa
tcaccaaatattcagtgctgactggagtactggacacgcatatatagacctctgaattgtatcctggaccttgaatgaccatcagactttactagtactcgataggaacatcagaactaatatttcagcagtaatcaactgactctgtccaggctggtaacatcagaactaataattcagcagtaagcaattgactctatccaagctgatagtacatcatactcctatctaactaaacagcagacagaatctaggtacaacacttgtatggagtggagatctaatctttttataaaaaaaatgaggagaattttttttaaaaaaaaaatgtgcttctagcttccaacatgctgagttgctgactctgtgacgccaatattttttttgagaacaatgtgacgccaattcagagaggccatgttcagtccttgtcacaaaacatatggtcaactcaggcaaaacgcggcagagaccttttgtcacagtaattcgcacataaaaaatgaaagtatacaagataaatgcagagttgacagagtcacaggccacactcctacaccacaaaggcttccagaccaagaaaccttcctctcaatttactgaaaaaaatcaggggcaatttgtgcttctgatactcacgtatatttcatacacacgtgaatgcttttaatagaattcagagaattagagaatagaaagttgtcgttgactccatctctttaacatattttaggagcatgcttatagattcacacaagtatgaacacatatagtgatttgtatatgcgttctccacatgattcagaaaaaaaaaagaacaatgacaacttgatttcattgaatttattgtggcgcatttacagatatatagtgatggaagcagtttggtgcaagacaaaagtaggcaggcgaagttacatcatgtacacttttgacttggtcaaacgcaaattatatactgacagtgacaggacctaattacagcagtatagtattaattaattgttaaaagagagtttctaatcaattctacttgcaattctccaagaagatagcctttgccatcatctattgctctgatttagaattatatgtgaaaagagtctctctctattaggggagcgagaggagatgtctactcatatatttttcttccaaattcgattcaaatagttgtaaaaaattatagaaaaaaattgataatattgagtattgttatacctatctgtgcaaaaaaaaaatcaagttcaatgctgtatcagcgttgtcaattttttttagaatttttcataatcgtttcaatgctttttaaataaacaaggaaatatcatctcttgaggataacacacaattagattagacatgcttggactgatgacttagtcaaaagagaagtccgatcacttattaatttcttgtgcatgtgcatccaacaaccttcgtcagctagccaagaacaataagcaacttcatagtgtcctagcaacggcgtcaccggcca

SEQ ID NO: 25056 - DNA, 1501 bp, Oryza sativa
tgagagaaatcatttgtttattccttattactaggtagtaagcatattacttagtattagctacttactgctctcacaatgtatacaaccgggtagtagtggtattttattccttactatccactttagatgtatattatggatgcccttagggcggtgactacagtgagttgagagagaatgaggaaggccgtggcatgcgaaaacagcaaaatatccgtacttcacccactttattcgatctataggatgggacagcccaataatcctcaagtactgactcatccagccaggcgtgcaattgcaagctggctggttcctatgcaatattaccaatggcgtccaaaaaaattaccaccagagagagagagacccattcattccaatcacgtaacgacctcatgtgttcggcaacccaggttcctaacctctctctcttgtatttcataagcacgctttttaaactactaaacggtgtgttttttataaaaagtttctatacgaaaattgcttaaaaaattatattgatccattttttaaaaaataatttgctaatacttaattaatcacgtgttaatggatcaccccatttttcgtgctggagggattcgctcctatccagaagtaacgaacacaggtgatctccatatcccagctggaacggtaacgcacggcaaacagagtagtccattagcgcgtgattaattaaatattagctaatttttttaaaaaatagattaatttgatttttttaagcaactttcgtataaaaacttttttaaaaaacataccatttaacagtttaaaaagcgtgcacgtggaaagcgatgatgaggggatgagaaaaggggcatccgaacacacccactcggtcacggtacggtacgatacacacaccaaataattaggagtatcttgccaagtgtccaactagacatggtccagcgcgtatcatcgagaactggtgcttgaccgctactagttgtcttaaaaaaaaacatgcatacatatgcactccatcccttcaattgtaatccacgactaattgggatcaaccccttcatgttcatagcaaatcaagagcgtcgccagctagccggtcatgggcatggcatcgtgacttgtatcatttgcatacgactcaaatagttatagaaaaaattaaaaaaaattagtaacatcgtttgtgatgatacaagtctatatacaaacatgcatgactaaatttaatctacaactagagaaacaaaaataataaaatcagacagtcaatagtacccgtacagtgccgataaaatttgttatttttgtttcttcatatatcgatcgaatttagacttacatatttgcatagtgtcttatattatcatggactatcttattaaattttatgtattttttatataattatttaaattatatgcatacacctaggtgccatggtacctaggtgtagaaaatactttctgatcgcggcttgtcatcctcctcctcctcgcca

SEQ ID NO: 25057 - DNA, 246 bp, Oryza sativa
ctgcagaagttatcgagatgctaagctaaagcgttctggatgccttgctgtattgtctgtgaactctgtggctttagacctccaccaaactaggcacaactcactgaagaactctcaggaggtatgtttatgaatgatgctctatcttttgctgcagcaaaacaacggtctatgtggcctcttcctttctttcttggttctacttatctgcagtgtttaaacttagctttatgtttcaataacatt

SEQ ID NO: 25058 - DNA, 861 bp, Oryza sativa
gtggagatgatcaatcaagtgccacactagctctacaaatggaagcaatgcacttgaatcttggctaattaaccctctaacacactagatggatgaacacaaagctcaagtggatgtgaggcaggtgcaagaggtgtatgcaattgaattgggtgccaagagagtccccttgctgctggcgggggagtatttatactcccacccaccaaaactagccgttgggggcgaaatcccccaatcattgtgctctgccggtcagaccggaggtatgaggccggtcagaccgtgctactctgcaacggctagaaaactagccgttgtagtgctgtcagagggccccatcggctcggccggtcagaccggcgttgagtgggcggttagactggcctcggctcggtttgaccgaatacggctccgtcggctctgtatcgaccaccccgagtagcaccatcccggcctccagggggccggtctgaccgcgcatgagccgccggtcagaccggccttatgggccagtcagaccgccgttgtgaggacggtcataccggccagggcacgccggtcagaccggccacatagtggccggtctgaccgcccctggtcaggccgagctcagtgaaagcaaaggtgagtgtgtgtgtgatgaaaaagtgagcacaagtgaaaatgcaatgacctaatgtggcaatttaatcatctctttgctaggtcataacccctcttaatagtacggcgaaactagaaaataaagtagcaaatttgatcgccctacacctcgatcaattctaaattaaagcactagttttaccgtcttctttctctttgctttgcaccgtcaattttaatccatcgatagtcatt

SEQ ID NO: 25059 - DNA, 516 bp, Oryza sativa
ttttttttgttgtttcctgttctcgttgcgacagcgtgcgtgttttttacttagggtatcgattctagttctatcattgtgcgagtcgggacgtgtgctgcgctccttgtggtatttttttgtttattttttttttttctctgtgtcgcttatgttggtcgtctatcgtatgtggtcttgtgtatatgttgtggatggtttcgttgttcgtgtcagcttgttgttctttatttgtgtattcgtgtgtctttttgcgttgtattctcggcggcgtatcgttctatgtctttgttgatgattgtgttgtgttgctctcctctctactcggttattgtctgtatttttttagtgtcttgttcgtggcagggtgtgtcacggtattgtgttgtttgtctgttttgttctcgtcagttgtgtatgcgttctttttgttatttttttgtctcgtttccgtctatcatgtgtttgctttattgttatttttttttttctgcgtcctcgacggtttttgtttcc

SEQ ID NO: 25060 - DNA, 212 bp, Oryza sativa
atggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttttaaagtataataatctgcatctgttattatgtgtatgtgcaatttcagt

SEQ ID NO: 25061 - DNA, 160 bp, Oryza sativa
ttcctgcagccccgccggcgacggtgagcgtccacgtcggcgacaggagcttcaacctgcacaaggttaggagagattgtgtgaagattaattagggattcttggttgggatgaggaggaagaagatggtgatgagtgtgtgtgatcttgtcgttgcagg

SEQ ID NO: 25062 - DNA, 254 bp, Oryza sativa
cagcccccctgtgccctgtggtggcgaggagagagcagtgcagtgcagaggagaacgcacgcgcgcccagggaataaggaaacttgcacgagggggtggagggcgatccgatttcccagccttaaaactggggttcaactccaacgtcccccattcgtgcgccctcagccattgtaccccttttccactcctcccgatgttccttcctccctcactccaccactccggttttatactcctcctatctctctagt

SEQ ID NO: 25063 - DNA, 244 bp, Oryza sativa
taaatggtttgaaatttatagtgtggtaggaagtggagaaagggggagatgtgtgcgtgttaggggagggacgggcgtgctaatcgcccaaggcgatcacccgtccattaggcttacccgttcccagttcctactcagaccttttctaaaatataaaaatagtttttttggactacaaaagttctttttttctttacaagtatggtaaatgcaaatgctaacaacttgcgcacactgttataga

SEQ ID NO: 25064 - DNA, 594 bp, Oryza sativa
ccataagtgccgaaaatacacctccagggttgataatacttatcatttggaccaagagcacagtctccaaaaattaaccattatttttcattataatatgtataaaagtgttaccaaatatatgattttattaaagtactttttaaagaaaattccctacatacccctgaaaagtttcgcgatctcttctatacccttgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttcccg

SEQ ID NO: 25065 - DNA, 1194 bp, Oryza sativa
aggaggtcgaacaccatgtccgaccagctcaccggcgaccagccggcgccggtcgataggtccatcacgcaaagcgcgcgcggcttgggctagcaagcttgacggcttagtgcgtggcaacgtaagatatgacatgaagaggttaaggttggttagtcatgattccgagtcagtaactaactgtaccgtgctataccaatcggagaggttcactatatcggttcagggttttctatcaggggtcaccgaaatcccaaaatttcaaagaaatttagttgaatttgaacaaatattatccaaatttgtgaaaaaattcaaaaattcaaaaatttcggccgaattaatatcgtatcagggtcaccaaaattaccgaaatttccaaccctcggactaggtaatcacgcagattggatcgatccatgcaagtgcagccaattttgagcccaagatcggcagatcccccggccgccgccgtcgccgccgccggtgagactgatctccaactgaatgtttgctcgattcttctgacggcagcagcattgtcctctaccgatcccgatcaagatcgatttgtccatcctatcctcaggtgtgtgttttctccttctcatgttagttaatactacctccgttccaaaatataaacatttttggactccgacacggtcttcgagatgttactttgaccaataatatctataaaattaaaatagtttaaataaaaaaattgtatattatgatagtttgttcagcgataaatctagtaacatcaattttacgtgattgatcttttttttgctattaatagtcaaagttaaaaatgtttgacttgttacagagggagcatatcctttagctacagtcttagagttctggattgtaaccaattctcttttctttttaattctctatatggtggagaagactggcagttctatcgatttttggaggtgtaacaaggtaagatgtttgttgaaattgaagttcttctgatcatctttttttttggaacgaaatataaaaatagatttcagactggagtcactggacaatattacaattacgattcaaccgtgatggatggatgctaagacgagcccttttaaatatgccctttgatgatagattttttttttggatctcagaagatgggcattagcagtcatcatgatcgttatggtgttgatcgtccca

SEQ ID NO: 25066 - DNA, 1501 bp, Oryza sativa
gacggcgacgctgggcgacggcagcgacagcctcgcgctgttcatcgggtgcaacagccgttctgggtgccggccggtggcggcgacggcgagtgcccggcgggcggtgtgctgcccaaccacatctactacacggacaacgaggaggactacgcgctgctcttcccggagtcgcccagagacatcggcgtctacagcgtcgcagacggcagcttctcgccgttccggccaactcaaccatggctgacttggccattgccgacttggcttgttcccaatttcgaatactaccatcagtgttaagttaattaacacagagcagctaatttgtttgtttgattgattgattaatgttgcgtttcattgtttaaagctaggttttcttctctgatgtttttgttgttctataattctatttattgttcaatccacaatcgggctgaacgcgtagactaaaattaacagtttttttttcataaattttgtgctgatatgattagactttttttttacctgtatggatttgaccaatttagctacattttttaaagctagaatatttcttttaagggtccatgccattgaaaatgtggctattcagaaaaatgttattacaattcgtctattcatagccgtgctactccaattttataaaattagaaccatgctactgccgtcaccttttctatatatctatcctcttcctttccgtcttcttccttccttctccatcttcttcgcggccatcgcatgccgtcggcgtcgatgctggcgtcgagcacctcctagtccctctcgggaggcacagggagcgccacccgtgccagggctgcacctgacgacgacgacgactcccacgccgccgagggaggatcgatgtcaacggactgcaggaagcggagcgcacgggggaggtccctagagaaggcggaggagggggaggcgagaggagggaagggggcggtggtcgccattggcagaggtgggagagttgccacctgtggcggatttgcgctttctcaccgacgaggtcatcgacgaggtcacgagacgacaccggcagatttgcgctttctcactgccctccctctcctccgtctcctcggcgcagcacggtcgagtcatcctcccgagacacgccagccgcagtgccagtggccgctgccgacgcccaggtgtccgccacgccttcgctcgatccgagcctcgggatgtcggccatgggggccgtggagctcgagcgcgcgaggaggcttgcggcaggggggtggtagcaaggatcgcaagcaatgaacaagaaaaatcacggtagaccttccttctacaagatacgaaggctacaatggcaacagtacttcgccagcagtgtgcacgcaccatagtaaaaagagaaattttatagtccttgaaaaaataactggaggagtacctagtacccagaggtttgctaaacggataactcattgcatggtttgacatgatcaagccctgtcttttgttc

SEQ ID NO: 25067 - DNA, 1501 bp, Oryza sativa
atcgaatatatggacacacatttaaaatattaaacgtagtctaataacaaaacaaattacatattccgtcaggaaactgtgagacaaatttattaagcctaatcaatccgtcattagcaaatatttactgtagcaccacattatcaaataatagcgcaattagtcttaaaagattcgtcttgcaatttacacgtaatctgtgtaattgtttttttgcttatatctaatacttcatacatatgtccaaacattcaatgtgacatcgtgaaaattttgctttgggaactgaagagggcatgaaccaaaacctttttgaagtgagcttggttgaacacttgaaccaatatccccccaagttgtctggacactgctacacaactattttttacaggcgggtgataaaccacttacacatgtatttattgaattgcctatgacttagggcctatagaaatcaacgatatattacatgttttgttcacaatcatatatatgagtatgctatttcttgtgaatttaaacttatccgtttttagaatgaaatattatatattgatctaaaatgtttatatagtgttctcaaaatttctaataattatttcagtaaaaaacaataactatttgcataactaagaactctaagggagaaacacccatcttgtcttgtcgcttgctcttgaggaaaaataaataaataaagcaagcctttcctacagtcataacgaagctgacaagatcaatctgattagggtatggttacgaaactgcaccaataagatcaattaacagattacagccttagactttatttaggccgtgtttagttcaccctcaactaccccaaacttccaactttccatcatatcacatcacatccaaaactttcctacacacgtaaacttctaacttttttttctaagcttccaactttttccgaactttcaactttttttcggaactaaacacagccgctgaaaaagtcgatgtacggcaggacgtacattcttcacagagaatcgattgacacggtctagacataatctcagcacaaatttaagcaacgtcagccataacaggcctgtttggttaattcattgccgtattcaaccatataccaaaaatagtaatgcaaatggaagtaaacatatgtttcgtttgttgcaatttgcaaaagaattggcattgccaaaaacgtcggcaagaaaaccaaagcacatacacttgattgcttcaaaaaaaaaatcacatactcttgccttttgactagattaatttgccaaaattttgacagtagccaaatctcgtctttaaccaaaagtttacattggtgtcgatccgaacaagctctcgatgttctgactaaatagctcttcttaaacaaatggacctggatgtacgaaggagtagcatgctgactttgaagtttgaagtctgaaccggcaaatcgcacaaagagatgatcgattggccaaggaaagaagctccttttaaagtacttgtg

SEQ ID NO: 25068 - DNA, 1501 bp, Oryza sativa
cccgagcagcgacggcgttgggcgggtgcgcggcggcgggcgacagcgtcgggcagctgcgcggtggcgggcgtcgatgactgcggcagcggcgggcggacgacttggcccgagcggcaagcagcgtccggcttccaccttcctccttcggcctccgcgcctcccccttcctcttctggcctccgcggcgatggcgtcgggcggctgcgccgcggcggcgtcgatgggcggcggcggccatgggtgggaggagagagagagatggcgacgcgagcggcggccagaaggggaggccaccgaagccgggcggagcagcggggaaggcgccgagcggagcggcagcggggcggccagatccagcttgggctcaccggatctggcgtggacggcgacggcgtgctcgtcggctgcgcacggcgatggcgggctcatcggcttctcccctccgtcccccccttctcttcgtccgtatccatggttgttgcgtcgccggcgcagccaactatccgacgagctcgctgtgatgtcttcccttgttctctctccgtttcttgatgacgcgggaatcgatgttgtgggccagacctgcaattgtgagaaagaactcggagcttactttggctccccgttcctggtgagggagtgaaaagtgcctaggtggagaggaatctccgagctggcatgtggaggctgaacgctacgtctttgcattgtaaatggcctaagggttgaagcggctatcagcttctcgccagagggcgaacatggcgtgcagggctcccctgtgtatgtccctctgtcaggagggactgttgtaacgcaggccgaagacgttaacaacaacagtgctgctgacctgattgcttccctcacaactccggtgagaccacccctcatgtcgcccccaattcgcattcgtactaaaaaaaccaaaagttgtgcttagcgctactcaacgacacagtgagagactataaaagaaaagaaggaatggttgcaaaattgagcttatagcacaagagattatttccaaaaaaattggtattatgagtgaaggtgattcttttgatgagaatgtcaaaaaaaaactcactccacgctccctcaagatgatcgctgatttggtggagaaaggcggctgcaagaagctgaagctcaaagctgccaaagcaaaggcagctgtgaccccggcttaaaggacatcaagttggagtcctggagggcgcctacataaataaaatgggtgccggttccctgcagaagttatcgagatgctaagctaaagcgggctggatgccttgctgtattgtctgtgaactctgtggctttagacctccaccaaactaggcacaactcactgaagaactctcaggaggttatgtttatgaatgatgctctatcttttgctgcagcaaaacaacggtctatgtggcctcttcctttctttcttggttctacttatctgcagtgtttaaacttagctttatgtttcaataacatt

SEQ ID NO: 25069 - DNA, 1501 bp, Oryza sativa
ccgacacctatgtaatgacataagtgttggtttaaaaggaaccggtacctatgagtcttgccaaacataggtgtcggttcctattaaaaatcgacacttatatctaagtcatcggtactagttttttataaaatgattgttataattgagtcatcagtactggttttataaaaggtgcctatcgttagatggatgttgatgaatattttcttggattcgatccgatgcaacgagctggattttttttcattcctgaaacctcagtcctcctcattggtgccgcttaagggatgctggccgggaaaagtccggtacgtacccatatgggtttcctggccagctagcaccaaatccctttttaagtagtagcataaagttgggtgtgaagggtaaatgctcattatattgtccttactctgcatttgctttgataattctgcagccgaaatgtttctgatgcgcatttttagcgcagatgatcatgtcttggccagtgaaaacagattctacaacttattgtcctctgattttaaggggctggtatggggacccatatcgtgggctcatatataaatgacacaagtactttaaaaggagcttctttccttggccaatcgatcatctctttgtgcgatttgccggttcagacttcaaacttcaaagtcagcatgctactccttcgtacatccaggtccatttgtttaagaagagctatttagtcagaacatcgagagcttgttcggatcgacaccaatgtaaacttttggttaaagacgagatttggctactgtcaaaattttggcaaattaatctagtcaaaaggcaagagtatgtgattttttttttgaagcaatcaagtgtatgtgctttggttttcttgccgacgtttttggcaatgccaattcttttgcaaattgcaacaaacgaaacatatgtttacttccatttgcattactatttttggtatatggttgaatacggcaatgaattaaccaaacaggcctgttatggctgacgttgcttaaatttgtgctgagattatgtctagaccgtgtcaatcgattctctgtgaagaatgtacgtcctgccgtacatcgactttttcagcggctgtgtttagttccgaaaaaaagttgaaagttcggaaaaagttggaagcttagaaaaaaaagttagaagtttacgtgtgtaggaaagttttggatgtgatgtgatatgatggaaagttggaagtttggggtagttgagggtgaactaaacacggcctaaataaagtctaaggctgtaatctgttaattgatcttattggtgcagtttcgtaaccataccctaatcagattgatcttgtcagcttcgttatgactgtaggaaaggcttgctttatttatttatttttcctcaagagcaagcgacaagacaagatgggtgtttctcccttagagttcttagttatgcaaatagttattgttttttactgaaataattattagaaattttgaga

SEQ ID NO: 25070 - DNA, 337 bp, Oryza sativa
  unsure (1)..(337): unsure at all n locations
atttgcgctcacattcgtgacagatccctaggttttccaaattcctcnggtttntnnttnnnnnnantccaagggggccttaggtaattccggtaggaaagtgtggggaaccccctaatattatttccaccaaggcccataatagaggtggctactaccttcaattttatccatatcactcactcataaataaattaagagacaacatatatgatgtgtcacttctaatacataaatatcgataactttaatattttcacactatttttggagtttgtgtggaggtaacatgtgtaaaagaggtatattgtaggtgtatgttaatgtgagtgtggta

SEQ ID NO: 25071 - DNA, 633 bp, Oryza sativa
tttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacagcccagcctatcgaacgggggctgttcgacagccctgcctgtcgaacgggggctgttcgagtcctgtcgaacggcagccttccgatctcctcgccagtcgcgctatggccgttcgataggtgccctatcgaactgcacccgttcgacagagacctattttcgcgattttccccggttgaccactacttttgcgattttccataaaaataatattaattctcaaaaaaattcctccccccactcccactccctcggtttttcaccgcacgcgcacctgaaagaatcaaagaaacgcctccgatgcgctgcgcca

SEQ ID NO: 25072 - DNA, 456 bp, Oryza sativa
tactagaaacaaaccctggaacagaatcatgcagatttttattagaaaccagcaacatgcatttagtttacagaaaagtagcatcagacagacggtcaaagagagagaaattgaatgagcacaaattgaaaaacacaagcagaagtgcaaacacaaatacaccaccataagacattcaaacagacacatgattgaactagttaatactatgtagatggacaaataacctgatgaaagtgtggagataataggaaagtgaatgaaataaattaacttcgaaaactcagggttcacacttaccttgcagagagtggaatgcatagaacatgacatatgtggaataaataaaggaggtgctaaaagatctatcagtaatttctccacaagccattttgttcccatcatttccttattctttttatgtaactttttgtgcattttctcaacccaaccagg

SEQ ID NO: 25073 - DNA, 1501 bp, Oryza sativa
aggggtctcatcagttgcatatccaaacatgtgtccctggtcaccagcaccaatctcctcagggcgcttggtgaagtggccggtgcacaccctgtgcaatgtcaggggactgctgctcgatgttcacaagcaccttgcagtggtcagcatcgagaccgacatcagctgacacaaaaccgatgttacggcatgtctccctgacaatcttctcatagtcaacgttagccttggtggtgatctcaccaaagaccatgaccatgtttgtcttggtgcaggtctcacaagcgaccttgctgtcagggtcctcggcgaggcaggcatcaagcacagcatctgagacttggtcgcagagcttgtcagggtggccctcgttcacagactccgaggtaaagaggaaggtatcaagtgcggccatcttctcctatctgcataaaatggtatttcacatactttagacaaagaaatatcatgaataaaatggacatggtgagcctatgagaaaaaaaggggtataagtgatagctaatgtgagggaagctgatagcgacaattgatttctggaaatgcttacataacacactgagaggacaatactgatccctagaacaaatggtttatgcaacaaaatttgtcctgagtaaacaggttaaaaaaacagtagcaaggaacaaaacattccttttaatcctctatatagcttatgtacgccaagatgctgttttgttggcacctgacaagaccacaattttgggctaaaatagttgtccctacaaagagttgactaagttcctaagttccttgggcaagtgttaggtatttgtaatattctctacaagcgcaacaagcaggtatagagcacaaggaatctaacaattttctgccggaatcagcataaacgcataatcaatcgtggtgccactatgtattgtaactatcacataaatataccacttttaggggtaaacatatcatggagacctggaaaaaaagagcgaaatcgctggctagcttttaggggttctactatactctttacatgtaatctttccacaaagacaaacatcataaatcattgaacatgcgcatcaactaatcaagagcataaaacaacagcagaaacatatcaattcgtcttggcatatttaactttgaagtggcaccaatcaatttttttttccattttccgttcatttataagaattccaactcccaagaccaaggggatgactcgaatctaccgcagaacagtcaaatgagctgacagccaaagacataatactagcactaaaaccactgctctagcatgttgtttatcagcaagccgtttgataagcatcaaggtattaaacatctaaaaggaagtcatcctactgcttctctctccatctccatccataataataagcaagcatgacaaaaataaaacttacaacacctaaatccaaccaaagaaaccccatctaaatctaccataccacaagatcgaaagaaaagcaataaa

SEQ ID NO: 25074 - DNA, 1501 bp, Oryza sativa
atgaaagttcaacacggaaaaaaacaaagaacacaaacaagaaacattcatctctacaccatgtaagcatgtattccaccaaaaagtttattgtgtatgttttgacttctacacctaccccaccaaaaagttctatgcgaatgatcgatgcaacagctgcaaaagtaaacgcgtccctgtaaattaattgtgcattcacttatcgccttacatttaatttctttctctaccatacttaattacataagaaatttaatgtttgcaaatcggtgtattttcatacctgcagcaatgcagctaactttttgcaagacatgttcatgcatggtaaattggtaaccacccaaaatacattgcctatatctatgttttgaaaggaagatatacataggttataggacaagttgtttgctaaccttagagttagaggcagaccatttctactagtacgtattgtttaaatttgacttttggagttgtatatttgtgctaagatatagtcaaaagggagcctcaaattaattcaccaacttcatcaaactgtgcaacgacaataatctgtacgtatatcacctagtgaactaactaactattgcagagagcatgcatacacactactaaaatacttttctagttgcctttggagactttcttggatgcatgacgccatgatccccatgcatctaatttattacatatatatctgcagctacttggtagactaattaagctagatgatcatgagatatcatttgaccaggtaattaacttcagggacaaaaggtaaacttaggaaaacgaaatgtacacttactaaacatatgtatatatacatcatgcgtcatcctccaaactcacacgactttgtcccggtcaccccatcgaccttgtcaaattttattatattgatctctcaaccaaaagctttctgtctttaagtgggttaagaatgttttacaagtaatctacacacacatctttgcccatttctaattccttcttacgcaaatgattgtgtgtagatcgatcgatctgttactacaaagtctgagcaacattaggtgatggtgacacacaattacaatattatttgtacttattttgtcggcctaattgatgtacagctatctattactagttcttccttcgattccaagcatatagtaatatatgacacgatgcaatttgcattcatacccatatccctttctcactttctcagtgcagccgacccaaagttggaaattttcttgatccatagacctgcatggaaatatttattggaatctaccacctcacctattttaatataatttacaaattactctttgaacttctttaatattaagaagcaaacaaatctaaatggatagccacatataaaatagaattaaggtgaacatttcccatagaaaaaaaaaagatgtgaaaaaaatattatgttaaaattttcttttatccatagcaaagcacggacattcagctaatatgaatatatgat

SEQ ID NO: 25075 - DNA, 1501 bp, Oryza sativa
ccacgctgataaagatatgaaagggggagagggcgcgagagatgagggagaagatgggatgaggtggaggccgctgacaaataggtcccacttgatgactcaacgagttaactaccacataggacgaaaccgcctagggagtcaatttgcaacagttttaagagttaggggatgggttatacccggtttaacggttgaaggatgtgattcaaccaggggcactacttgagggaggaatatagacgtattcctccaaatttcagagatgtttagcccacaatctttcctactatgggctaccgatcgttcatattatgggccgaacagattagacaatttttgggcccatagtaaggaaggttatgtgggctaaaggattttatcgtgttaaggcctcaaataaacgaagtttgtgatgggccaaaaagtattgtctcgagcccgttaggcttcaatttcgcccaattcgcaggacagcgtcttgaagccttgcggcaatattggtcaatcgctcactgcagaattgcagagctagcacaatctgatcagactcaatccaaacattttttcactttctgtcaaactactggatccatctcgatcgatcgtgccacagccatgcaatggcatggtttttttttatatataaacaataataataaattggaccagaagctaacattggatctgaattaagtcaccatgacagtgaagttgaaaaactgacgaaatcgatccaagatcactcttcaattaatttatggtgactgcatagcgtgctagatacctcttcatctgtacacacgccctgccaaattgactgaccgcatcctcgtcgtcgttttcatcagatgctgcgtcttctttcatcagcaattcagagatgatatgttcatccggtatccgaaatgtgcaagaaagttcagacatgttcagtccagatccatccatcccatcgccgccgacgacgacgacgaacactgctgcaggtcagcacccgtggcgccttgcaaattaacaagatctcaatttaccataagtccataactaacatgcacgctagctgcagcaagctgctgctaaactaatcgtcgccaattaattactcacctaaaccatgcactacacttgaacagacagtgtcagtgtgatcagcttcatcagcttagctcaagagaggcaggccggtcaacttgtgaccccatgttcttgtctcctcatgacacactggccatgttcccagttagcatcgatcaacacttgcatgcagctgctacctagcttagcttagcttaatcacccagtgcaggtcgtcactagctacgaatcactatcagattatactaatccccacttggatcgatcatggcagctgatacatataaattggatggccaccctcttcttcttcctagtcaccttcacttgatcagttagactcctcgtctagctgagctatctagaagagatagtttgtgtgtgtgtgtgtgctcgatggccg

SEQ ID NO: 25076 - DNA, 210 bp, Oryza sativa
aactatacacacccaaggtatgcatagaattgcgttgaaggtactactacaaggagagaagcgaagcatatatataaatattggtcgttgtcataaactgctatagctaccggtccatcacccgttgaatttcgagaacatatttgtatggttgaattgtgatgagaaaattgacgtcgttcttatatgtgagcgagaggcgcggtcgat

SEQ ID NO: 25077 - DNA, 1501 bp, Oryza sativa
cactaggtgatatacgtacagattattgtcgttgcacagtttgatgaagttggtgaattaatttgaggctcccttttgactatatcttagcacaaatatacaactccaaaagtcaaatttaaacaatacgtactagtagaaatggtctgcctctaactctaaggttagcaaacaacttgtcctataacctatgtatatcttcctttcaaaacatagatataggcaatgtattttgggtggttaccaatttaccatgcatgaacatgtcttgcaaaaagttagctgcattgctgcaggtatgaaaatacaccgatttgcaaacattaaatttcttatgtaattaagtatggtagagaaagaaattaaatgtaaggcgataagtgaatgcacaattaatttacagggacgcgtttacttttgcagctgttgcatcgatcattcgcatagaactttttggtggggtaggtgtagaagtcaaaacatacacaataaactttttggtggaatacatgcttacatggtgtagagatgaatgtttcttgtttgtgttctttgtttttttccgtgttgaactttcatctccatgtctcgcatggtcaagttgtcttaattcgattttcagaggcgcaaacaactgattagttagcgtgttgggccggagtagcatttagaagtccattagacctagctgatcagagttttgttttgaatgggctacagaattgaacgtgccagcccgtacacgtggatgggccacaattttggcctatacaaacgaggccctaacgggctgatgtttttattcgctcggcccaactaggcccaattaggttggatctgctcatacgccgaattttttgtatttttagattttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaaaggagaaggggaggagaagaaaagaagaggcgaagccctgccagtttcaaacttcgatttcaggtaatattcgtagattatatacgtgactaaatatatgataaatgcattgtatgaaatagagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagata

SEQ ID NO: 25078 - DNA, 512 bp, Oryza sativa
tgtttggctcataaaagctagtatacctaacaatttaaaatctcagataaacttgttgacaaattcaaatgaatcgaaagacatgagccgaatgagctagcaaaccacgagtttttatccaattttaaaagtcgggttacaaacgtctctcacacaacgaccagtgatgaacctagaacaaaatttcctaggatacaatatatagtaattatctaattattaatcgatatactaattaatatgatataatttagttaggatatggataatctatctggggtccttgtcaataaacccgttattcagaaaacccatatactctgtatcaatttaatcacgtaaaaaaaataagtcagatgatcctcttcccaccgatccaccaaactgaagcggagcatgatggcggccgcggaaagggccagtatccccccgttgaaaactccgcgcgagcgtgcggacgcggcggggcccctcacgccacacccaccccccgccggcaccgcgcgggcagg

SEQ ID NO: 25079 - DNA, 1501 bp, Oryza sativa
aaataataaattaaactaaaaatagttatcgtgcattcacaactatatttgttatttttgttacaacttatagaagttaaatttaaacttgcatgtttgtggagtgatatactccctccgtttcacaatgtaagtcattctagcatttctcacatacatgttgacgttaatgaatctagatagatatatatgtctagattcattaacatcaatattaatgtggaaaatgctagaatgacttacattgtgaaacagaaaaagtatttcatattaatttatcttgccaattttttttcatatttttttatgactatttatgtgatatgcatgaaacgagggaggaattcactttccctccatattttaaatagagagaatccactcagtaccactgagtttatcgcactagcttctacaatctaccactcactttatcaagttcaataatatactatcgtgttttctttaacctctactacaatatatattctagtgctaaaatatttatcagcaagtactagtagcaaggaaccgtagcaacttggtagcaacgggagaaccgagcgtgctcggttggctagcatcgctggtgagcgagcagcccgcgcgggttcgatccctgggatcgtcacccgcgcgtctcaccgggatttattcccaaataaatttccagctctcccgtgccagcgccacaatagtagagtgacgtcctcgtcacgcacaaggtccttaggtggctttgtgtatctcattagcacgtgtgtgtatagttgataggtggagtgtgtgtgcgtggtggagtgcgtttgcacgtatgttcagatactacagcttgtactcaaagtggagagctctcaaaaaaaaaaaaacttggtagcaacgggtgtcgccggctggccagactctcttgccatggcttcccaacatctcatcctcctcctcgcgatcttcgtctcgctctgcgtagcggcgatcggtcagggcaacaaaatcgttccgtttaacccatcctgctcaaccaccggaaactactccggcgacagccagtacaagaagaacctcgaccagctcctctccacacttgccacggccgccaccgacgatggctggttcaacaccagctcggtcggaacgggtggcgacgaccaggtgttcggcctcatcatgtgctacgccgaccgcaatccgacgcaatgcaaggaatgcctcgccggcgcacccgcggggatcacgcaggtgtgcccgggaagtcggacggtgaacgccaactacgacgcctgcctcctccgctactccgacgtctccttcttctccgtcgccgacaagaccgttgccttcaacgtgtacgccaaatcctacgtcgagaacatggccgccatgaacgagacgcggtggcagctgatgagccagctcgcggagacggccggccaaaccaagctcaggctggacaccggaagtacgcggctcggatcaacatcgatgatgtacggtctggctcagt

SEQ ID NO: 25080 - DNA, 283 bp, Oryza sativa
taaattaagcgccagaacatagtcccacacacctctttttaatcaaaacatttacttgaggtttttataagaaaaaggtgacaatttattcaattccattgtccaacaatttaccttaacatatctcgctggtaagaatcataatcccctccgcccctccgctttctccctcccctccccatcggcggtgacatccctctcccccctccccttcctgtctcgctagcatggcgtgacagctgtacatttcgtggtacggagtgacgacggtgagggtatagca

SEQ ID NO: 25081 - DNA, 1501 bp, Oryza sativa
accacgcacacacactccacctatcaactatacacacacgtgctaatgagatacacaaagccacctaaggaccttgtgcgtgacgaggacgtcactctactattgtggcgctggcacgggagagctggaaatttatttgggaataaatcccggtgagacgcgcgggtgacgatcccagggatcgaacccgcgcgggctgctcgctcaccagcgatgctagccaaccgagcacgctcggttctcccgttgctaccaagttgctacggttccttgctactagtacttgctgataaatattttagcactagaatatatattgtagtagaggttaaagaaaacacgatagtatattattgaacttgataaagtgagtggtagattgtagaagctagtgcgataaactcagtggtactgagtggattctctctatttaaaatatggagggaaagtgaattcctccctcgtttcatgcatatcacataaatagtcataaaaaaatatgaaaaaaaattggcaagataaattaatatgaaatactttttctgtttcacaatgtaagtcattctagcattttccacattaatattgatgttaatgaatctagacatatatatctatctagattcattaacgtcaacatgtatgtgagaaatgctagaatgacttacattgtgaaacggagggagtatatcactccacaaacatgcaagtttaaatttaacttctataagttgtaacaaaaataacaaatatagttgtgaatgcacgataactatttttagtttaatttattatttttgttgcaacttatagaagttaaatttaattttgcatgtttgtggaataatatatttcatattaatctatgttgttatttttttaaaaaaatttgataactatttagataacatacaaacaacgaggggatgtctccttaagagatgaaaattcacataattctcactaccatatgtacaattcagaaactagagtcagcatactgcaatttgtgtgagaattattgtgtcagagggtcttttttttccacgttttggctttcgctgaggtgtgtgataaggacggaacacgggtcctctctatgttggcgtcaaaagtcagcattctggatagagaacaacgtcatctttggcccggtttagttcccaaatttttttataggttgacacatcagatatatggacacatatttgaactattaaacatagtctaataacaaaacaaattatagatttcgccagaaaactacgagacaaatttattaaacctaattaatctgtcattagcaaatatttaatgtagcaccacattatcaaatcatgacgcaattagccttaaaagatttgtctcgtaatttacacgcaaactgtgtaatttgttttattttttatccacatttaggttgtgtttagttgagggaaaagtttggattttggttgaaattgaagatgatgtgactgaaaagttgtgtgtgtatgacagg

SEQ ID NO: 25082 - DNA, 439 bp, Oryza sativa
agcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaataggacaacattaggtggtttttataacttagactttgggaattttcatatcacttggatgctatggaatggatggcttttgttggaattggacacacacctccccctctattcaaaacccccaaaaatggttttaggctgggctcgaggtgcgtggttgggtttggttagtcgtacctcgggtactataaggattaa

SEQ ID NO: 25083 - DNA, 1501 bp, Oryza sativa
gggatgtggctccatcagcataaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttatagttatgttttagattctctcatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagcattttccggacaccacccaagtcctccagccgccccagtcgaaaacagttgttttacttttttttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatagcctttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgctcaaggaatagtgatgacttgcctgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaaacaaaatatatttgctgagatcgaacctagggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttaatttaattatgtacatatttcacttgtcaaaataaattataaaaggttaacaattaccca

SEQ ID NO: 25084 - DNA, 273 bp, Oryza sativa
atggaatggcttgggccacgaacagtcatatatgcaagttttgtgggcagatacgggccctcttgtttaggcttaggctatggcctagactttaagtcagcttatgggcttatatgatttataagccgggtggatttaatgtcctagtttagtagttgagtcatacatctacctcacataaacaaaaagcttctccacctagctttggctaaagtgtaaaaaaggggtttgggggggccctttttaatgggggctttcaaaaaaaagcccaaa

SEQ ID NO: 25085 - DNA, 198 bp, Oryza sativa
agatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtca

SEQ ID NO: 25086 - DNA, 698 bp, Oryza sativa
gcggcggtggccggcgacgacatgattgaaccgtcggcgatgaagaagaatgtggagcgtgaagactagtgagtcgtcgtcggctaggagttgacttgatctgaacaagtcagtgcgaaggcgtattattcgttgttacgtaaacgttctcagaaagcggaggcatgcttgttcgtgtcgtgtgcatgaaaagcgtgctttccgtatcaaagagtgggtatcatttactagtccgtttcatgattagtgctaataaaccatggatttttatactttgttctatcttaagcttcttgttgcaaatctttgccaacaacataatatttcatctacaatcacttatgaagtctcctaaactttttttatctccaaatatagtttggcaaaccagttttatttgttgttaataactaaaattttgttaacttaaaagacatatttaagattacttagggcccctttgaatcaaaggaattatgaaggattttcataggattgaaatcctacaggaaattttcctacgtagccctttgattcaaaggattgaagttttccaaatcctacaaaattcctatggaatggcttgttgcatataggttttggaggaaacttagggcccctttgaatcgtaggaatgaaaaaacagaggaataggaaaaacacaggattctgacatgaatacaattgtaaaccagagg

SEQ ID NO: 25087 - DNA, 1501 bp, Oryza sativa
cctcgagtgcgacgacgctggcgatgggtttgcttgggccaacggtggccgtaggatttttgtgatgacgatgtcttgtaatgctgctgctgttgatagttgtaatgcttgaatgatgttcaaatttttgttaatgtgttgatattgtgatgcttgaatgctatgttaatgtccattttcaattttttttcaactttctggatgagatggtagaaagggatttatttttttatggaaaattatttttactggcggttagcataacacaaccgccagcaaaaactattttcactggctgccttgataaggcaaccattagcgaagataactttcactggcggctgtctccagcgaaaatttgtttttgctggcggctgacttaagatgccagtgaaaatatttctttgctgaccgtcgataaccgctagcgaagatcttgatcttcactgccctttgctttgtggcggctctaaattccgctagtgaagacccaaaatggccaccgcgaaagatggttttcatagtagtgagaaggccatcggccctcgccacaccgggggggaggggggggagaccaccaccggtcaagaaccaccttcgcccgccgccgtcccgaccagcgtctacccactctatatggcgccctctgccgcgttcgctcgctgataaagagaagagaagaaaagagagctgaagcaggaagaagaacaatgtccaggggcatttcggtactttcaacgctctttctctctctatcttcatcgaaaataataaaataatgcattgggtgtccagctgctaattaccacatttttatagtgtccacgagaagatatatattttttgagtgtctcacaacaaagactaaaactttgagtgtccttaacagattttgccaaaacaaaatgaccctacaccatatagtaacttagggtgcgtttgttcctgggggattgggtaagaaagcctatcgtattccgcgcgcacgcttcccaaactactaaacggtgtattttttacaaaaattttctataggaaagttgctttaaaaaatcatattaatccatttttgaaatttaaaatagttaatactcaattaatcatacgctaatggttcacctcattttgcgtatcttcccaatccccttctccactcttatagtactccgttaaattcatgggtgcaactgagtatgtaagtcatcgctacgagcctgagcctacgatcacatgggcggtcaaattaaatgcacatgttctccgttgcagacagtaaaatgtcaactcccccgtatataggaataattatttttagttacttaggcgacttgcaagcaaattaaattgctgaagtcaagtcaattgcttgctcatctcaccctcactctagatcttcaggttataaaatgccaaatgctccaatcgatcgatcagagctccaaatcagtaagagacagctaggtaggtaccagcaaaattaccactaatataactacgagaa

SEQ ID NO: 25088 - DNA, 1501 bp, Oryza sativa
gggtggccgggcttcacttcgcagctgcgaatccaatggaggcagcggcgaagcttggcgatgaccggaggagcagcagggcttcgccggagatcaaaacgcgacggcgagcttcgggttgacggcgacgatggaactctggtggatttccgcttcggggagatggctgccgggctccctctccttcttgcgaacccaacggcggcagcggcgaccaaatgccgcggctaaggcggctgctagctgcggctggagatcggaacatgacagcaacccaatggttcatggcgaggacggcttccggcgaagtttccgcgcaaggggaacggcggccggggtggagctcgaccttgcggagccgatggaggtggcggcgcacgaaggaggcagatgaggcggcgtctagggacggctggagcggcgccggcgtttggagagagaaggagagcccggggagagcgtttccggcgacggcggcggacgggacttgaggggatgggtagaggacgactagggggtcctttatataggcacgggagctcgggatcaagcccacaacgacgggaaaaactcgggaaagtctagggttctcgccggaaaaaggaaggatttgatccgcgaaattggaaagaatttccatagaaaattttggggatttcttggggaaaaggaagaggagattgaggggattccattcccgcaactaatttggaaagaggagcaacggggggtcggattggtgggaggaggcggcggcactgtgcacgagcacggctggctcggctctgtctggaggaggaagatggagtactgtagcgacagggaggtcaaacagactttatctgggctgagaggaagggagaggggaaaggagggaatgggctggattcggcccaagctgaggaggaggacttttatttacttttccaaataaattaaccaaccagatgatctttcaattgttaaaaatacttccaatgctcaaataattccaagaaaaatcttgaacatacttggacactcaaagtatttaatataataatatccagatcatttaatgattaatttattatttaaataattgctaaactgttctttatattattaacattaggaattgagctccgaaaattccgagaaaatttcagagagtataattaatcatggagaatttaataaaaattaaatccaaccatgctttacatttaggaaattttatttcccacatttaacttcacttgtaaattaatgaacatttaatataaattctattaataatttattaaataatttataaatcctaaaacggaaattcaggctgtgacatcagaggtcacttccggctgtagactagccctcattgtaaaaagcatgtttcccttcttaggcagctagaggcccttgtggtgacccctgaccagataaaaaggaggcccaggcctaggagggagagaaaaaaaaaaggaggaaaaaaaaggaggaaaaaagggaagaaaagaaa

SEQ ID NO: 25089 - DNA, 602 bp, Oryza sativa
  unsure (1)..(602): unsure at all n locations
cgtgttncnattagaagctcnnnnnnnnnnnnnnnnnnnnnnnnnnnnnnnnnnnnnnnnnnnnnnnnnnnnnnnnnnnnnnnagcggggcaggaggcatgggctctgcttgtcagatgtcacgcccggaaattcactagtgatttccgaacttatttgtgcataaaatcctcgtccaggaatcagccgaggtacacaaactgacaatttaatatatagattcatcaaattaactaaaacgataagtacttacttaagaggctcttagtcctcaccatgaagaaaactgcagcggaaaataaaatctagcgaagctccggctccactcccacaggcagctcaactggggtataagccaaacgtcttctccttctggatccttattcttcaactgaggttgattgattattgcaaggtgagcatatgacatactcagcaagccacacagcaaatatgcaagtgcacaaggataccaaaggatggcataatataggctcatttgcaaaagcagcacttagcaaaacatttaagagatgtaaaacagtggagtaattaatcagaaattttaatcaacactgaacaacacacccatgctgcacagg

SEQ ID NO: 25090 - DNA, 233 bp, Oryza sativa
attcctgcagcccatcacacttcacataacaccgttatatgataattaatgatataataataagtttgatcaacaatatgaacagaatttaacaatatctcaacaccgataagttgagtagaccaaagttcagcaacgtccacatgccatgccctagcgttaacagcgttttcctttggtcacttcccctttctaatgtgctacaaacctgctaggcttccttcattcatagg

SEQ ID NO: 25091 - DNA, 280 bp, Oryza sativa
ttgtaattagacttagtatataattattgactagctagggtcctaatgtacgtcacttagacttggcatagttgactattacagttttaatacaatattatttgagttttcgtataagattattatagttttaatataagattattagatttgtaattagacttagcatatacgacaattagacttagaatatatgacttagcatatatgattgttagcatataagattgttaaagcaaaaatgtctcatgacttagcaactatttcttgtatgaacaga

SEQ ID NO: 25092 - DNA, 1501 bp, Oryza sativa
aacccacggccacgtacgacggcgccatccctccaccccctgtggccctgtgcaccgcagcaccgcttcattcttgggatatgatggtgtacctgctctagggaaggtcgctttgttgaaatgtgttcttgaatcgctcaattgctatactgcaaaactaattactgaatcactgatgtttagctgatgatgtataatttaatcattttcgcattagcatcaggcaaatgagctaatgccgaagctcgtttatctgcagcagaactgagacggaccaagtactgagttctagactgaactgaaataaggttaaaaaagaaagctcaacgactcgcggttgcaagcacactctcactctattagcgtcattctaatcagttatccgaatctacaatttgactgacaaaaataactacaatcagatatgagctaaaactgtgttagtgtcttcttaatcagctatttcaatctgcaatttgaccgacaaaaacaacaattgacaagaaattgatcaacatcagcatggctacgacgatcttgaacccttcatcggtttgattaccttccggccttgccttagattctgatatggatcatcccacttcaattaggtgttgctaaaccttgacgctacggttgaaacaggtgtactagcagagtccctttttttttttgcgagagtactagcagagtcctttgacaggatctcatcatcagtatcaaattgacggcactgccaaacgcgtaaagtgcggcggcctccgtcgcgcacagcagcactgcaggtctgcagcatctcgcctcgcctccgttctccctctcgcatctcatttctcgacaaaacgactctcgtcgccatccccgcgtgctgcagttgtgaaccgattgagcatattgacccgtggactagattacgaacttacccctatgccaattgcaaattcatcacaatgccatctattacatttccaacattacccctccatgaattatactacggggctgtttgttttggtgccacacattgccacaccacatgttaggcatgccacagattgttagcttagcgtttggttgcttgtttcagttgtggcaagccacactttcttgtttcatgggcctacatgtcatatactcattttctagctaaacattgccacacttgtggccaacaaattgttggccacactttgtttgccatgccacatctatggcaaattgagttatggcaatgttaggcaacaaccaaacagaccctacatctactaccaggtgtagtaggattgaatctaatccattagatcgaatcaaatggacgtctcacattcattttgaggtactttaaaaaaatcctaaattaaaattctaaaccacatatatatcacaattggactgaaagaaatatgatcaaattaaaatcctaaaagatatatcacaactggacggaaggaaatataatcacagaaataacaacatgaacctacaaataactttgtcccaa

SEQ ID NO: 25093 - DNA, 1501 bp, Oryza sativa
ctcttttttgaagaaattttgaagcttgctcgggcagctggaggaggaagaagacatatatataggggtgggactttagtcccggttggtgttaccaaccggggataaagatccccgggatctttagtcccggttcataacaccaaccgggactaaaattacgatctttagtcctggttggtgttaccaaccgggactaaagatcccgggggggcctgacaggccctgacagcatttgaaccgggactaaagatgatttttagtcccggttaaaaagggtttagccccggtttttattgcaaccgggactattgtggaattcggccgaccgacgaaagatggtttctccaccagtgaaggaaccttctagccaatttgaaatatctagcaagattgcttttacatcatcggctaaaggtgccaaagctgtgctcgtggtctcttcttcttcatccataaacatatcggctaaagtctgaaaataatatgggcagttagagtcatgtgatagccgatatgatttgagaagatgaagattgaaacttacagggatggccggagatggtgctaccacttcttcttcttcttctccttcttcttcttcttcttctatatgacgacttcccgcagcatcgattacttaaagctaaaaatggaaagttcgaagccttcggaagagttcgggtatggctctagtagcttatctcttctcttttgtaagatttgtacttttattagaatactcttctatatacatttatggtattgaaatactctccgaatatatgagtacctactttacattatgttcttgttatactgaatatacggctagattatctgggagatgctttggtgcgggtatagtgtttgcttatgcaattactctacgtcatgacgatgatattagagtagtatctggtagtttagatattgcttgaggtgtgtgttgaagtgaagagagtgaagcctttatatagaggtggttatgacggttttggaaggggaattgtccaaagtaccctccaaccgtcattgggatgcaatcttggacatccatgccaaaccctggcctcaacggtagagatggggttcggccgaaccccctggttcggctgaaccatgggctggcccaaaccagcccatcttcggctggcgacctcctctattgcttcactttgtagacttgtgaattttggcccaattcatcgtgtcaattctgagttcttggcccattcatacataagtctggttctcgacatcgtccgattgatttatcgtctatgttgatgtcaattctcctccactttagtgttattctctacaaaaaggttagtatacctaatactagtggaatattattattctagcaaacatatgcattgctagcatcactagttctctcctattttggtaatattgacggtcaaaactgatcgataacgaccgtcaacaccctccttagcgtgctccttggcaatatcaataaatttagacactt

SEQ ID NO: 25094 - DNA, 1501 bp, Oryza sativa
gcgtaggtgttctccaaaatcccggccgaccaccctagctccggcgaggtcgccaatccgagccggccacctttgatgacgtcatcatgacatcatcggtttttctttttcccgattttctaatagattaaatcttcggaaaatcataactaaataaccgtagatccgtttcaggtggttcaagttgctaaatttttctaaaatcaggatctacatgttaaaaatatccacatgtactgtttaagcttgtttttgtactgttttgttgatttttgtttaattgctttagtttccgacgttccggaggagagtgtttccgttgaggaaggttccgaagcgtttgcggaagcccaaggcaagtcacacagatcccaaacaaccctttgagcatgttgaacccatttaaagctattattttatttcaactatgcattgttttcgaatgtcatcgggtggtgaacctttcctaattaattattggccgaagatgatcttattttcctatgggttataatttgattagcatgaaccttatatattggattggttcagctaaatgctatatatatgtttgcttagccatgcttagaaacattagctaactaaaggggttaaatatagattataatatattatattattaataatgatggttatattcaatggtagctcacgatggttaatcgtgtgatgttaattaattgattgataattaaaacctggctaaggtgggttgtgagcatatggttttgatggctgtgctcatgataattaaggaccggttcgcgagctactgttgtgaaacatttatcatgccaaccacaagccagcgtgggcaacggctttatcttttgtatagcatgattcattatagtacgccagactttgaagtggcgagaagtccacgggggtcgctggggattccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtttaatctattcgaatagccgtacccgcggttatgggtgagttgagcaatgtttttcgtgattagtctcacccttctcaccatagtgaatgatgctttaattggtaataatttgattagctcctggtttggaatggtatattcctggtttggagatagaactgtgtagccgggatggttgttcagaatggttgggcctgttcaacagggtatgttgtatagcgttggattaatattgtttattacttaactgttttattaaattctcaaatgtttgctaaatgctgtttttgcaaatgaaaccctattatgccatcctttgttatcctgtgcacatgcatatttgctgtgtggcttgttgagtatgtcatatgctcattcttgcaatattcaatcatcaga

SEQ ID NO: 25095 - DNA, 1501 bp, Oryza sativa
ttttaatatatgtcatctaccaaatatgatctaatctttttccggaggatgttttaatcttctgtctcagctataaatcatttgtaaattgtttgattaatttggaatagtcttttctttaataggtttaattggaatttaatcttgtaaaatttgtaactaattcatatgaaatcagaatgaggccgttcaagtctcataattcatctaaaattatagtctacatgtttgtttactttttatgtattgtttatttggtttttattagtcttttttcctcgttttgcgtgttagcttgtcgtttccgtcgttgcgaaggttcgcgagtgcgccggaagtattcaagaagattaattgaagaccgattattgcaaggcaagtcacatagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattggaataacttatgacttactattatttaatgatggcttaatgatagttcatgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatggttcattgcagagcaccaggttgagaaatggcggagataagcccacgggggtcgctggggagtccataccttgtttataagggggtgactatgatccgggaatggtgcactgtggtgagttgtgttgtgcagagagtattgtcacagcctctattcgggtactttccagtatcgcgacgcatggtacacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttagagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctgtgtggcttgctgagtatgtcatatgctcaccttgcaataatcaatcaacctca

SEQ ID NO: 25096 - DNA, 1501 bp, Oryza sativa
cgccggatgggggggtcggcctgaccttcggaaacagtcgtgctctgaatcgcgcgtattgacatttccccctagcaactcttcagtactccacaatatcgatgcttttgagatagctactcggtgaatgagacagtccagtgatgctacctgtgagaactgagagcacaaaattcagcaacttcgttattgcgtttacgtgctaaaacgtggtgtttctgtctctctgtctcgggtttctgccctgctgatgccaccaaagacgaccgttaaggttcgcttcgactggaacttgtactggtggtccgtcggctacacggtcaccattctgagagcaggtaaaataggtaaaatagaaggctataaaccagctataaacatattttaaaataataaagaaagagagagaagagcagcagactacatatctgtagcccagctgcagcacgaactctaaaatgtaatgtgtgtatgacaagtgagaccatgtattaatagtataataagcaactattgtatgaattagctagtagtgggttatattattaaacttgctctgagcatcgtcaatgggcatcggcaattcggcatcctgcaacctgaccagaagtgcagaaaaaaacgttggtgccgttctggtcatcatcgccagcgcggacacgcggaacgcgacgtcggccgccgttcgcctcggtggtacatgcgtccagtgcacgctggcgctcagctcctccagctcgctgcactcctctcgtagacgcggcccccggcggagaacgcgcggccggcgtcgaccacgacgtcggcgccagcagcgaggaataggaggaggcggggaggcgaggcgccatcaaggaacggcccgagcccatcatcgcaggtggcgaggatggaaggatgcagaacgggaaagaaggttgtgcttggagtgtgccaggagagctggagatgaacaagtgaggagatatgccctgcaatagtgcaatttgtcagcgggagaccgaggcgtacccggagaaatgtttggttcatgcctgcatacgtgtggagctgtgggctgggacaacatgggccaaatgggatggaatgtcagatcggggtaaaaggcctagtttcgtagacttgtggccttttgggcttacgagctttgacggccttgggaaaataggccagctgttgggttggaacttggatctggatctgaagtctggaaaggaataagttcatctgaggtcccttaactcgtcaacgaatccgattttcgtcattcagccagaaaaccagatacagtaggtccctcatctatcaaaactggtaaagataaggtccctcggcggtttagagagcagttttggctgacgtggcgtccacgtggttaatttgactcggtcttcgttacgcgtggcattgatgtggcgctttcgtggcaattctatcacagaaaaaataataaaaatcgtgggcccacatgttagttacacaaaaagaaaattagaaatgt

SEQ ID NO: 25097 - DNA, 1501 bp, Oryza sativa
gatgctttgctacaacactaaaaaaaattattcacagcctattggtcatatagctgtgaacttgtagctatgaacttgtagctgctttatatagttaattgactggattaattaagagaaattaacgcgtattaagatcgagatctcgcctgccaagcttatcctatacatgtcaccatcaaactcgtgtacacgatcgatcaaatcgaacatgcatggcgatcgatcgatcatcgatggatttgcagatcgagcagattgttgttgactcgttgcaaaaaaagttgtttcaactcgagaaattaaaggcatgcaagcacgcatggactggatttttcacattttggtccttttgaaaaacttatttcgcaagtagatccctagaaaaacttatcccaaaaacggtcctttttggggcgccagagtggctggcgccgtcgttcaacaggacggcgccagcctctttggcgccgtcccaccgccgacgtggcggggcgatgctgaggtggctagggggagtgcgccagagtggctggcgcccccccccccgaaattttttatttttgttttatttgtttgatatttttttcacgcttagggacacacaagaaccaaccatagaaaaattgaactcaaatggacgtaatatgtgacatgtagaatttttcctctcctctcctctctccgaactagtgtagaggagagagatgtgcaacttttttatttttattttttttaatattttttcacacttaggaactcacaggaaccaaccacgtaaaaaataaactcaaacggacgaaatatgtggcatgtggaattttccaaagctccaccgaaaaacttctctcctcgaaaacataatcttgcaagcggaatttggaggttttaatatcgccaaacccggcaaagcgggggagaatcggatgtaactttttctgtagatgtccgttcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaaaaattgcatctctatgtactgtttaacttatatgtcatttcatgtggttatattttgaattagattaagtaatttatatagtggtagagtacattatgtttaacatgctgatcaaagggttttactaaaggagttatggtctaatttgagtgaaggtgcaaagtagactaagtggtatgctagatattttcagacttagctaagtggtagttcgagtttaattttttttttgtggttggttgtatcgtgatcctgagtgtgaaaaaacatccaaaaaaataaaataaaaatgacaccgttgcaactctatacaaagaaacaggaatggaggtggcggcaccagccatgctg

SEQ ID NO: 25098 - DNA, 1501 bp, Oryza sativa
aattcaagaacctccatactcctcaccctgaggctactgcaaccaaccaaaccaagaagaaacaattcatgagcagccaagccaccaacaaaccaagaagaaacaattcatgagcagccaagccaccaacccatctttgaaccaagaaacaacacaaggttggctcgagcacaagaaaaagaatactgacagaacaagcaccgccgcccaccgcttgcaacaccaatagctgccgccgccacctgtcacagtcgtcgcttggggccgagattggtggatccgttgtcttcgagagtcaccaccgccgccgccaccgttgccgcagcaggtcgcagccaccaccttggggagcagctgccgccactgcaggtcatagccaccgccttcgggatcaaccgccgtcgcggctgctgctgcctccttgagcagccgctgcaagcctgcaagccgccgtcgacaggagaggacggagagtgactgagtggaagatggagagagttagggtttcgttaggtgatatgggccgttcgccaatttcaggatttcagcccaccaacgagttagctgccgctacttgagagcccatttagcggctatctccagctaaaggcagctaatagcgccttagaacgtgtagctgtaaattagacatatcttagcggttgcttctactgctatagccggagatttaaatccttgctcacacgtgatctcatcaaagccgtgttgcacccttcaccatctcgaaggttcttgcatggcaacatttgtttttctttatcgttttcttttactgtttatgtgcatattggtcaattaggtttgcaattaatatttttgaatgttgcatctgattgaaatatttttcatcgagcgatgaaacatctaaaataattcttgacaagtgatggagtacaatccgatatgtttttcctagcgtatatatcagccactagttgcgtccaaattttatgggcgtgattgataaaataatctaatttatatgattctgaaatatttatacgtttgaaataataaaccctaaataggcaaaacaaattaagggtacggtgtttaggttagagaaacgagtagaatagctaaacggtttttacagctaatagtgctggccatgacaccattacatggggagtcaacgttcaacggttgactggtcggagcagctagacagacacgttgttttcttaagccgcttgaattgtttattcccgcgacacccccctcctccactttaggcttttaaaactgtctctatacaattaacagccagccagctaattgcggctctaaccacagtcattagcagcatccatccgcatcatcattagccatcgtcgtggtcgtcctcctcccaaccccacatgtcccccctcctatataaaccctgcctccctctcgacatctcctccattctcaaacacaccccacagctacagctgatcactagctagctactgagatcgatcgatggatttggaga

SEQ ID NO: 25099 - DNA, 1043 bp, Oryza sativa
cccctgttatacaagaaatagttgctaagtctataggtcatttttgctttaataatcttatatgctaacaatcatatatgctaagtcaaatatgctaagtctaactatcgtatattagagccctacacaatcttatatgctaagtcttattacaaatctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcatatattaggaccctagacaataattatatactaagtctaattacaaatctaataatcttatattaaaactcaaataatcttgtattagaactatgctaactcaaacaatcttatatgcgtcttattacaaatctaataatcttatactatgctaagtctaagtgttgtatattaggaccctaggtaatcatatatgctaagtcgtctaagtgtcgtacattacaaacctagataatcatatatgctaagtctaagtgtcgtatattaaatctaatagtcttacttgcattaaaaatctaacaatcatatatttacatcacttgcctgcgcgaattccttcgagggctagctaccactccggcttgagggacgacgacgacaacgtcttttctgcaacataagatgtattaggataaacgcaaagtaacatatattgtatttcacgttcgcattctcgttaagttcacgtttcgttcacgatcgttcacgttcgcgttctcgataagttcacgtttcgttcacctacgttcattcgttcacgtgcgttcacgttaacgtacgttaagttcatgttcgcgttcttgttaacttcacttttcgttcacgcacgttcgttcgtttacgtacgttcacatacaacgttaagttcacgttcacgttag

SEQ ID NO: 25100 - DNA, 1501 bp, Oryza sativa
cctcagctgcttcgcgtgcttttgcactctggtcctccaataattctttatttcgttatcagtcctccccggcaaatactgcgcgatcttagaccacctggcacacagaagtattcgcatttaggtccctggaaaggactgaagtgtaattaattaaggtaattaaattaattaccggttgccccagcgagagtggaggtcgaggatgaggagctgctcgtcggccgtgatgttgccgcggcggacgtcggggcggaggtagttcagccaccggagacggcagctcttgccggtgcgcctcagccctacacgtgtccacactctaagtccatcagctagtgcaaaattaaccgatcgactaatcactgaagattaattttatatctttgattttttgcatgcagagattaattgatgaggatggagagagagctcgcgcaatgaagcttaactagctaaactagataagcttctagaatattccagattaagacgtgcactagctagcttatcgtgctcagtggagcaagccaaataggcaacacaacagtattggctatttggcacacagagatcgttaactatttaattaatctcaatctctgatcgatcgatcgaatgatcaactgattaatcaattgactgaataattaattaatcacctgcacagcgagcaagcgagttccagcgaccctcgccgtggttggcgatgtagtcgacgagcagcatgtcctcctccaccgtccatggccccctcctcaggtcgccctcgtcctcgctcgccgccgccgccgtcgccgacgacatcgccgggctcatcgccatcctcatcatctccatctccaaatccatcgatcgatctcagtagctagctagtgatcagctgtagctgtggggtgtgtttgagaatggaggagatgtcgagagggaggcagggtttatataggaggggggacatgtggggttgggaggaggacgaccacgacgatggctaatgatgatgcggatggatgctgctaatgactgtggttagagccgcaattagctggctggctgttaattgtatagagacagttttaaaagcctaaagtggaggaggggggtgtcgcgggaataaacaattcaagcggcttaagaaaacaacgtgtctgtctagctgctccgaccagtcaaccgttgaacgttgactccccatgtaatggtgtcatggccagcactattagctgtaaaaaccgtttagctattctactcgtttctctaacctaaacaccgtacccttaatttgttttgcctatttagggtttattatttcaaacgtataaatatttcagaatcatataaattagattattttatcaatcacgcccataaaatttggacgcaactagtggctgatatatacgctaggaaaaacatatcggattgtactccatcacttgtcaagaattattttagatgtttcatcgctcgatgaaaaatatttcaatcagatgcaacattc

SEQ ID NO: 25101 - DNA, 241 bp, Oryza sativa
tcccttagctttgggaatgtgtcgaagttcggtgtctgccccttcaggatatatttctggtacagatctcccttgaagctctgaaactgttctgccattttctttagagtccaccttttcactttgtcctctgtacccgcgggaagggtgaatgtctcgagcattgtggtccacagcatctctttctccgaatctgggacaaagctctcatgatctctgtgtgcccttgttctgcgccagt

SEQ ID NO: 25102 - DNA, 191 bp, Oryza sativa
  unsure (1)..(191): unsure at all n locations
cacgtgcactgatagaacctcttcctnnnnnnnnnnnnnnnnnnnnnnnnnnnnnnnnnnnnnnnnnnnnnnnnnnnnnttgtctctatgtcttgggagaatcttttcgttgattgaacaaaagttctctaagggatgaggcgacgccctgggtggatagagatcatgccggatacttatgcttaagtgga

SEQ ID NO: 25103 - DNA, 598 bp, Oryza sativa
atgccaagcaatgcttttgccgtgaatcactgattcacggggccatggcatgacaaccgaggttgattcagatttcagaatagctctggaatccccagaaattccttatttcaagagagagaagggtgtaatgtgctaaaatgctgtcacacgcgacactaatccttctggtattttaagcgtttattatgggcttcttataagaccaaaagaattatttgagagattaatgacatttagctctgcggtatcctgaattcctgatgaaatgatcactttaattctgtgtcgttttactctaaaaaatatgagtcgaatttgagagattcttgtagtacacaggctacacagcaaacacacagcagcgactcaaaccttcgggcccaagaatactggcccaataaataaggcctagttctatcgtttggtggcccacctcctcctccttccaaaccaacccaccatctcattccgcttctccctctcaaaaaaaaaaaaatcccattccgcttcgagaagcagaggaatcccgcacgcacagcgcatcgtctcgcctcctctcctcgccaccggcaagccgcgcctcccgcctctccaa

SEQ ID NO: 25104 - DNA, 827 bp, Oryza sativa
aactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttacttattctatgcataattttgaggatgtattttagagtcgttttgggacgcgacatgcaactaataatcaggctgagtatgaagcagttctcaagggtttataattgctaagggaggttgaagccgatgctgttgaaattatgggagattctttgttggtgatcagtcaattggcaggggaatatgaatgcaaaaatgatgtgttgatggtctacaacgagaagtgccgggaattgatggatggatttcggttggtgactcggttggtgactctaaagcatgtgtcccgggagctaatgacttggctcaaggggcatccggatataagccgatggtaaaagatattgaggttgaagttgccacagtagcagccgatgattggaggtatgatgtgtatcaatatttgcaaaatccatcacaatcggcttctcggaaattgcgctataaggctttgaagtacaccttgttggatgacgagctatattatcgaacgattgatggggtgttgcttaaatgtttgagtgccgataaggctaaagttgtgatgggagaggtgcatgaaggtatatgtggtactcatcaatcgtcacataagatgaagtggttgcttcggcgtgcagggtatttttggccgacaatattagaggattgcttccgatattaca

SEQ ID NO: 25105 - DNA, 207 bp, Oryza sativa
gcgcgtatgatgactctctgcaagtacctcatcaggttgggaagatattgaaattctaagattattgaatttttggcctaaaggaaaaggatttaattaaaccctttttggaaaagaaaaagaaaaggaaggagggaggaaatttagactttcctcgggcggctagggtgcggcccaagggatttggggcggctcggccgagcttaa

SEQ ID NO: 25106 - DNA, 1501 bp, Oryza sativa
catttgactccgcggacttattgaattagtgcatttggcgttgcgtgataagcatcttttctctctcgtttgacattccgaaagctgcagttgcttacttgctttattcatcaaataaccccgtcagtgtggttttggttatttttatatagtcttctacaaaaatagttaattactctctccgtttcaaaatatttgacaccgttgattttttagcacatgtttgactgttcatcttattcaaataaaattgtgaaatatgtaaaactatatgtgtacatgaaaatatatttaacaatgaatcaaatgatatgaaaagaataaataatttcttaatttttttaaataagacgaatggtcaaacacgtactaaaagtcaacggtgtcaaatattttgaaacggagggagtatatatattctgttactctatgaatattgatcacttaatataagtagaggcctagagccggcttaacaggaaaacatgccaagttttgtagtgcgaaatctagcatgtctccagattctccatcgcaatgttttttgctgaatttcctcatgcttttttcccggttcaaagtttgtaaaaatcaagctatgaaaaaaatatcgtcaattcgttaaaaaaaagttttaaaaaatagcaggttaatgtacaaccaaaagttactttcaggttaatttacgagcttactataaactgaagttgaccacgttaattttttttgcactgccatgaaacacttgtggtttaatgattccgcttccttattagagcacttattaagaaaaacaagaactaaccatattggggttttgactttgccgtactattagtgagcatttttcctcggtacatatcatcagcttcggattcaacaaaatcatgagtagagcattgccgaagtgaattccacatcaatgatatgacggcaagaaaagtgccgccactgattacgtaatatatagtgatacacaataagaatataaagttcctagacaagtggtgctcagtcaaatggaaccgcgattaggatatctatagtagaacgataagatttgggaggaagcacagatagaatgcgtttgtgtgtgcatctctactgcagcaaacatttatagaagaagcaaaactagtccaacgcatgaaaagtaatccgggaatttctttgtgacaaattggacacaaaaaatcttgtacgtatatcgtagaccttttccagagctcgtgggtataaatacatgccatcgatcgcagttagcatcacccctgcatcactcgaacttgcaagctgcagagctcacgttgagcagtgagcaactgttccattggcgcactgatcgaacgagcagtgcgaacttgaggtgaagcatcctgccgtgttcatcgatcttggcccaaataatgctcgtcggaattcgacgtcgctgaagaggagataatcaattccgtgtttctttcttgtcctcgtggtgcagatcgagcagctaagcgagatc

SEQ ID NO: 25107 - DNA, 1501 bp, Oryza sativa
atcttgttgtagtttttctcttgtataaacttgcattcaagagcataaaaaggggttcactacttagtaagcctggttgtcagttttcgtgttcttatagtttagttgtttaggtttgtttgttatgagttgtttgtagttgtggttttcatccaattatttctaattaactgtgcgctataaggtttggtctcattttctccttagagtgagacatcttcttctatatataaaacgttagcaacggcattatcgttccaaaaaaaaagggggttcatggacgaaccatagcgtgtctatgtgtgaatctttttggtggtggttgattgttcacgtgtttgaacacttcaaacaaaattagtgttaaacctacaaaattttttgtaacgtggttggattttatcaaagactaagcacaatagaaaatacaccaaacgagtccgattttgctagatatttgtcatcaaatttctccccctaatatttgtcagatataattacagtacaattgtagtgtaattatactgtaacttgtatgtaattacactgtaactataatgtaacttgtatgtaactttcaagaatctctcggtaacatattatttcagtaaaatagaggtcgtgggaacaaatcctttcacatatgtgtgtgctgtgatttttttcttcctcaccagaacaaatcttgtaatagatctaacgattcaaaattacatgaaacttacatacaagttacactgtagttacttgcaatttacagtgtaattacatacaagttacagtgtaattacactacgattgtactataattatatctgtcaaatttttaatagaaaatttatcgacaaatgtataggtggtccctacgagtctcgtgggggcctgtcgagctgcgaccggggtgagtagttgttgcagttttgcatccgcggcctctcctgtcactttcagcccatttcgtttgaccccctacaaggttttcttacgatttgttctgagcccccgcgattcgagatttgtacttcaaccacctcttttattaatctgctttctttgcttcctcaagtactactcccgtacttgtccagcaagcgtggctcaaaattcttcgcctcccaggggaaaaagaacaaggaaaatacactcgaacttcctgttcacccagcacaaattggtgtcatccttccctcgtccttgcttgcgtcaaacgattctgcgtcagtttaccgactcacgcgagttcgttcgtgttcgtctccgtttgttgtcgtgtttcgtggaggccaggagaaaatagttcttgtagttgtatccgatcagcaaggagaaggaagaagaagaaggcttccgtttctatcgccgaaaggttgctccctttctcctcacgattcgagctgacgaggtgaaggccatggagaagagcaccacgagctgacccgaatccccctctctccagcttactgttcctcggagatgggctgcttcggccgcgtgagggata

SEQ ID NO: 25108 - DNA, 1501 bp, Oryza sativa
cggacagatcccgagctcacaactgcattacaaaaggaaagcggaagccaggacttggaccaatcaacacaggcgcgacttgggaactaggccgaaaccctaaaacacatcgtagccggcttgctcctagaagaactcctcatcagcaggatccgcttcatcttcttcagcaactaggggggggggattatttatatagagcaagggtgagtacgggagtactcagcaagccaggggaaataagtgtttaatgcaggcttcaaggaaaggctgttgttttcgtaaatgattttatttgaactttttttctaaaaacatctaggtgagtgcttctcaaacgacatggttgagacagtgcgtcccgtccggtcggagtatgtgcaatgtatcagtctttagaatttaaacaaggttggcacccggccaacagctttttcaacggccacccgggccaacaactcttcaaacggccacccgggccaacaacttttcaaacggccacccgggcctagctgatcccatcagctgcagatttttcaaataccgaaccccttttcacacagcaatttcacaagcagtagtcaaaccaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagctgacacaggcttaccatatgccgacgagaggggttctagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcggatgaaattccaaggaatcggtccttaagtgcgggagcgggaaaaccgtacacccggtacgttccccggtccgcggttttagaaatttatttagttcgcaagcaccgacccaggtgtcgggttttccaaatcttttgtaaaacccaagttttacccaagttgtttttcagattttaagtttgaaggcgaccgtcgatactcgcacagagtgcacgaatatcgaggcgcaactgggtggttacaaggggacatggtataacaattaacaatggaaggatcaaatgcaacaagttaggtaggtccgccaatctgccctgcaggcgggacaaacagattaagtgtgatcctatcaatgcataatatttttcaaacaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaac

SEQ ID NO: 25109 - DNA, 296 bp, Oryza sativa
ctcgtcggagccctcctattcgcagcaaattagacaagcagatgttcatctaaagcgttgggggttagaaatttcggaaactgattggtctcgtaaagcgtctccctccccagactccagagagtgatgggatttgggggggggggatgattatgctgtacaagagtagtttgatagcaatgttagtggtagaagtgaataatcttgtatggtctgatgttgtgtttgctgggatgttgcataatggtgtgtctctttttttttactgcttgtgtaggtttttgtcatattaatca

SEQ ID NO: 25110 - DNA, 1501 bp, Oryza sativa
aacgcgcatccatagtttacaaaacgctagctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttctgaatctaattcaggcactttgaagctgtagaggctcggttcctgcgagcatcgttcagcgcgttcgtcgatcttacagtactggttaccaagcttgttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggta

SEQ ID NO: 25111 - DNA, 192 bp, Oryza sativa
agatggggcccaaaacacgagttgtaggggagtgggccaacacttgtttaacagaaaaaatggctaataagatattacaccagtatggaattcaaattttaaaccggagtcaaaatgaaccttcagggggaagttggaggcgagtacaagccacttaccacacaaagttaggggctcagccaacatcccaga

SEQ ID NO: 25112 - DNA, 809 bp, Oryza sativa
  unsure (1)..(809): unsure at all n locations
ggggcgtcnntttgcncttgctcctcatagatggtacagtagttcattaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttataattagacttagcacgtaaggttgtgtagggttctaatgtacgacatttacacttagcatacatgacttagattgttaaaacataaatgtctcgtgacttagtagatgtttttgtatcaacaga

SEQ ID NO: 25113 - DNA, 1501 bp, Oryza sativa
atcagaaacaagcaatgggtcaaatttatagaaatggcatgccaaaacttttagaaattttcccaattttctagcttttttttttcactattttccacatttttagtaaacaatttttttttgaaatttcacattggtttcttgacaaaatcaatcggttttcgatacaaacagattgatgttttcacttccaactgtcgataagaatttcaacgtttccattcgaaattttggtaaagccaatcgatttttgacacaaagaccgaccgatatgaatttgttggttttcaatcggatttcgtgaaaaccaacgtgctgccagcgtttggcatggaaggtggtatcggaattgtgaaccctggtggtggccatgctggtgatagcctgctgtgctgttttctcttgcaaatctgatccttgcatcaggctccaaaccgattaccattcatattacagctagatactccatgtgttggttcgttttgtggcaagattcttcaaatagaagtattactggtacatgcatgtatactgatacagcaatggtgctagcaatgtgaacaaatcttacctactagaatatgtagatgaaaaagaggtctgttcattttgcctagatacctaatagcacaggtaaaagccttctacttcgaacccataaaacacataagttcctcatttgaagtcacatctgcaccggatagttaattggttacaacatgtatgtttttcggatcatgcaaaacagtttcgtcctttgaatcattagaaaaagaagagtacgaagcagagaacactagaaactgtaaaaacaaacttgtataaaatgacatgttcacttcttcagccgattttccatgctttgacatgtgctctttcttcccatctgtttttctcgttccgttcattgttgtggcctcaccagaacggccaccattattagaagtagactcattgctactgctcacagccttcactttagctggtaggcctttcttcttgccatctaatctctgctccttggtccctattgttgcaacaggtgggcatgattttcttcttatcctgccattttctattttctcacctacatccaatgctggcgcacggcatgtaaatatagatcttgttgtggtcagattcttcggtgcattgtaagggagttcaggtttcgtcacattcttgagtccacttgtggtactgccttggcttgcgtacgtagcatctgtcagagtgtttcttgtttgcattcctacttgctgtagaaactgtaggtgcagttgcagcaacaggtttgcctgctcattatgcctgcgtaagttgatctcttttcaattgtgcaaggttggttattctcagtggagatggatggtgcagcccgtctgaacaagttctttgatgatgagtcaggtgtgggtaaccgatttttttttgttgcctttgtcctcccagaaagctctcatggataaagtcaagatcaagataagctcttcgatgaaga

SEQ ID NO: 25114 - DNA, 330 bp, Oryza sativa
ttaatttgttatactgagataacatcgtcatcatgcaccggtttgagctacctgtgcaagaagtaaagctttcttgatagcactagctgctttaagataagttatatgggggttactcaagttacctagtagtaaatgatctgtcctgtgctatttgttcttttgcaattactattgttgataccactggatttatttttcctgtgacattatttattcctggactatgtacatgatgtaaaaagttgagtattagtaacaggtgagatggttatttgtccaatgtggtcatcatcttttgaagcacagattggtggatgaaggcgagga

SEQ ID NO: 25115 - DNA, 440 bp, Oryza sativa
ggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaagg

SEQ ID NO: 25116 - DNA, 1138 bp, Oryza sativa
tttttttcaggtcatgaacaaaatgcagttgcacttttacttgttttattactaattcactaagtttaagtcacttttgttctggtagatatatttccttaatctgtactcatttgttgtttgatgactctaatcgatgatcatttatgcacattgtgactttctagcttaccatttgatgttatggtttaaggcacagaggagtagcgaaacatgatcccctttatctagaagtcactaagtcagtgagccccacctttatttgtgaagactacttgttagctgttactttgtattcaggattggcagtttcagtaacagctttaggcttagttcgtttcccctcgttcccaactgcccactctcgtttttcgtgcgcatgcttttcaaactgctaaacggtgcgttttttacaaaaagtttctatacaaaagttgcttaaaaaaatcatatagatccagcgtcatatatacaaagatggtggtagtataaatttagttagttttatttcgataataaaacgaacgagcgatatcgtagcgaacactcttcgtttaacttatgatattctatcaagcccatttaaacaatgatattataacgaaacacttctctatctctgctattataaaaattgaagatgtttttatcggtattttggtacgtcatccgtgtttgagttgttttttaagttcgtacgcttttagaaatacagatatgtgtttgagttagattttaagctcgttttcttttgaaaatacaaaaggagtcgtataagaaatcttttttttaaagaacactcacatgctaacttgagataaaagttggacttgtaattgtagcttgtgattttcttaaaaaaaaaatccaagcgaattcctatagtgaattttatcctatctaaaccgtataacaataataatgttaaaatagtattcacccattgcaacacgagtatttttatagtatatgtaaatttatcaatgttcacaccacaactcatcattcatgattagccagagacaaacatccatcaggtgccccatgaggccatatgtgagtcgaacacgggacacgggaggatccgagccatcataaatcaacacggattgaaactgcctaatttaatagaagcttc

SEQ ID NO: 25117 - DNA, 747 bp, Oryza sativa
tcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcaca

SEQ ID NO: 25118 - DNA, 1501 bp, Oryza sativa
catacattttcttctgtgcatgtacgtatcatgcacgtgtgtggaagcctcgtagatgtattgttgaatcgtatagggatacatacaagattactagtatgtaactagacgattgtattaagctttaggggatatataaggcttggttttcaaacaagtctaggatatagatggaaatgcatcctaatctactagtataatatataaccgggtacaatacaatcctcattctgtacttgacagaaggaccatgcggtttgtatatgtggatgaattggtaatttgaagatgaatagttagtatatatgcgcagcaatgataggagcatgcagaaaacagcttgttcatcagatgagcatgtctagctgccactgataatataagccacagtatgtgttcaggccttcagggcacccggccctgccgacgggcgccagactgccggccggccagctgatcctgctcttcttcctctgtgccaatctgtgcaactgagtggacaaaaaaaaaaaaagaagatgcgcatgtgatgccagccttccggtatactagtagacttcgagccttatcggttgccctagtaagccaaacaacttaggtggtgtttggatcagagactaaactttaatccctattatatcagatgttttgacactaatttagagtattaaatataaactatttacggaactaattacactggtggagaaaccatctttcgtcggtcggccgatttccacaatagtcccggatgcaataaaaacaggggctaaagatgatctttagtcccggttcaaaagggtaacgggcatatttgatctttagtcccggtttgtgttaccaaccgagactaaagatcatctttagtcccggttcgaatgctgtcagggcctgtcaggcccccccgggatctttagtcccggttggtagcaccaaccggggctaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctctaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 25119 - DNA, 1501 bp, Oryza sativa
ctcagcaagccaggggaaataagtgtttaatgcaggcttcaagggaaggctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccacacgatattactaacccggatcacccagcccgtggggatcagccacgtcgggagacctccaagctttcatgacaaggcatttccaaagccgacacaggcttaccatatgccgacgagaggggtcccagaccaacaacaggttaggtcctagaccatactgtgccaggaagcccaggggtcctctctgacaccaccccggcgaatccacatgtctctcggcatcatggctcccctgataagctagttactcagccaggggtgtcccattccacccatgtggtcgcacttgtcctatgttcggatgtaattccaaggaatcggtccttaagtgcgggagcgggaaaaccgtacacccggtatgttccccggtccgcggttttagaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacggaacaacagattaagtgtgatcctatcaatgcataatattttgcaagcaatataattaaatttcaagtataggctcaagatgttcaaaggtggcttgccttgctcgagatccagagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggttagggcgcggcccgagaga

SEQ ID NO: 25120 - DNA, 1501 bp, Oryza sativa
tagcaccatcaactttgtatttctgcatgtttaacctgtctaggacctgtaattattgaaattgactgggcttgaaattactatgaaagcctgctactgcaatagtggccgctatttagtactatgcttcggattattttgagtgttactgttgccttccactaatttccatttttttgtcatatgggacatgctcttatccagtctgtttcattctgtgtttatcttgtgttgtcttcaatatttgatatgccatttttatatactttgcaatagacttccatttggtgccttactagcgtatttctgcattggcaggagaaccatggttgttgaggagatcctaacaatcgacataaaacctggatggaagaaagggacaaaaattacttttcctgaaaagggtaacgagtctccgcatgtgattcctgcggatattgtattcgtgattgatgagaaaccacatgatctgtttacacgagaggggaatgatctcgtcatgacacagaagatttccttggctgaggccttgacaggatgtacagttcaggtaacagcactagatggtcggaacctaacagtaccaatcaataatgtcgtctaccctggctacgaggaggttgttctccgagagggcatgccaattccgaaggatccatcaaagaagggaaatcttaggatcaagttcaacatcaaattcccctcaaggctgacgtctgagcagaaatcagaaattaagaggctactagcttcttgaggaacacaatataccgttaggttgtctggttttttgggtgcactggggagaccaatcagatgttaagctgggaaatgtgaataccatccaaagactcattttttgtgggttctggttattccacctttgtaacttaaaattgtcaattttggcagaataattcatcaaaatagataattctgtgtcaacatgccgtgcttatgtgtgccatctcctactgagcagaggctatcaaaatgaagccgcagttccaaactctgtttttttttcttttttgtactggactgcagagggtacccctggttatattttgagtatttctcgtcctagctgggccaatcttaaaccatgttgacaatgggctaatctcaaggcatgttgacgacggaacagttggtggaggagctagaatattgtttgaaatacatacgatatgtatgtatttcccctattatatgaaaccaaaggctttctgtcatcagtctacacctgtacggctgtacatgcacattttcggttgttgcggtgttgctgcctgaacgtctgcacgaagagcctgtcattttcaccgcgccctgcttacccggttaccgcaaataccagtccacagtttgcgcctggcatcttatcacatctgtatgcactagatatatttaccctgcatacggggccaacatttacgccggcactaaacagcagtggtaataacacatacggcaaatcgggcagtgatcaggcgatagt

SEQ ID NO: 25121 - DNA, 300 bp, Oryza sativa
  unsure (1)..(300): unsure at all n locations
aggggngttcnnattgcgcttcgctcctcattacatggtacagtagttcatcaaccgcatccagttcaagctctacgtcctcgacgacgaggtgcacctcggcaacaaggcaagtcgatcgaacaatcttttagcgagtatctttgctgtttaaggattaattaactgtgattgattcttgattgcttacaggtgatcaaggacaagctgatggacgccatcgaggggcatgtgctgggagaagccaagctcatggccgtcttctaagacacgaactctctgcattttgacatccccagc

SEQ ID NO: 25122 - DNA, 820 bp, Oryza sativa
ggttagggttaagaccaagactaaagattatagcactgcatatgattttcgcttacatatgtgtttataaaatagaagttaatgcattaacattatttaaagtacaaagattaatgacaattacttcgaaaaattatttttgtctgtaataaattaagtggataaattgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 25123 - DNA, 693 bp, Oryza sativa
  unsure (1)..(693): unsure at all n locations
ctgggttgantttgaaaactanatatcattcgnnnnnnnnnnnnnnnnnnnnnnnnnnnnnnnnnnnnnnnnnnnnnnnnnatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaaga

SEQ ID NO: 25124 - DNA, 762 bp, Oryza sativa
cccagatgaaaaagtatggccgcaagctctgaatgggcggccaaaattacaattagccccttgccgccctctgtatgggcggcaagggcctaatcgcaattttggccgacggcggcagacggcgcggtcgacccaccgtctgctacgtcagcttgccgcccaccatttgggcggcaggggctatttctgcaatttttttggtcgatagattatttctgtaaatattaaaaaaaaatctaaaaacgaaaaaattccttctggaagcgggtggagatgacggcttggtttggaagaagagggtgggtgggccagcatgcgatcagactgggcctcatttatagggctagctttcttgggccccaagcccccaagtgcatcttccccgtgaggaagattaatgggctcaaatgtagaaagacattttaccttcggaaaaaaatccactttaacttccttaactgttcatcaaatctaattcgtgacccttaactaaaatatcgggtaagaccgaactattgaaaccagtgtaatttgaattctctagcaattttgaagggtggttttgttgtcgtgggggtgttgatctggtcttcatgccacgtgacgcttatatagcattaaaattttaaaaaaatatatgtgagacctactgacatgtggggcccacatatcatcctttattcctccccctctctctctctctcccttctctcacttttctcttccccaccggatcggcggcggcggcgtgcaggcaatccc

SEQ ID NO: 25125 - DNA, 1501 bp, Oryza sativa
cggacggccgggaagatcatgtgtacgggaagagtatggcaaaagttaggtcaagccctgcaacaattttgctgctatttaaccttcggttggtgatggtcccgtttcttcgacgacgtgttcaacaccgaatgatttccgctgattatttgctacacgctttcagaaatatgtcttcttaaatgaaaactctcttctaatacttcctccgtactcgtaaaggaaattgtttagaataatatttaagtcaattcctaggaatataaatcataaataactctcaagttgttaagtttgaaaatgtaaaaattatatgaatagatttgtcttgaaaaatattttcataaaagtaaacatatatcacttttcaataaatatttttatagaaacaagaagtcaaagttgtgtttcagagaccgtatcgctgtccaaaacgacttactttacgagtacggagggagtacattgtttagaccacttgctctaaatagttttcttttttcacaactaacaatttttgctattcttatggacacagatgtaaggtggagctatttcttcattacagataattaacaattattgctattcttatgaggaaattgttctctatctgtcatatggtgatgtatggtatggacatgcacactccttccgtacggtaggtgcaaagccataagattgttttttttttttacggagggtgtactatacttgccatggaagaatacgctataaacctgtagaagtagacaatgaacacatatataaggtggagctcttttttcattatagatcaaatctggagtacaagtcaatcatatatatctcaccctgcgcccttttatatatagcggtcttaggaggagataaattttatctctactctggttaagattggcacacaagaaacttatctcctagagattgattttcacaacaaaattgaagtttgttgtgtatgtaaaatgccacatactcttccatgggatcttcagtactcctagatgggaacggtcttgctctcctgcccagccttgtgcacagataaaataaaaccgctgggtcaggacaaagcccatccgggaagcccacaatacaggctaaatcctacccttctacaggcccattgaaggctgaaagatctggccggtacccgggccacggtggcctctagcaagtcgccatgttttggaccattgagttggtcacgattttgacagggaataagatcattttgactccctcaactgaccaccgaatctaaatcatatccctcaactgcaataccagaaatcttaacccctgaacttataaaaccggtgcaatttgacttctttgatggttttggagagcagtttcactgacgtggcgcacatgtgacagtgttgacttagtctttgtccaacgtggcattgacatgatgtttatgtggcattaaaataaaaaaaatatacgggcccacttgtcattaaaacaatatgtgggatccattgacatg

SEQ ID NO: 25126 - DNA, 200 bp, Oryza sativa
cccagatgaaaaagtatggccgcaagctctgaatgggcggccaaaattacaattagccccttgccgccctctgtatgggcggcaagggcctaatcgcaattttggccgacggcggcagacggcgcggtcgacccaccgtctgctacgtcagcttgccgcccaccatttgggcggcaggggctatttctgcaatttttttg

SEQ ID NO: 25127 - DNA, 1501 bp, Oryza sativa
ccaggtaacgaacagcgaagcctccgccgtaatctcgcccaccacgcgagaagcggcgaacctccttggccggtatctccagattgccgtcgtcgtcttcgtggaagcccggtaccgaaaaaacatggaggttttcttctttcgtgaggaaatggaaggctttcttgtggtgtatgacatcctccagaactgacgtggtgacggactcaacagcagtcgccttctcctcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtccagggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaggtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 25128 - DNA, 1501 bp, Oryza sativa
aggctatgaacttatcatggcatcttgtgactggtatgcagataacttgagagtatatgatctgaaaacttacatggcatacacctatatcataattcataacttacaagctcaaattgtcaagtgctgatctacagctagactctgaaatgctactgctcattatgtagtttcagtggcctggcttgctgaagtctgtgtacaatacactgactggtgtcagcccagagttaatttgcactatggacactcttctcctttgctggactagaactctggaagataataaccaagtcactgtgagctcatgttttgtgaacatcaagtgctatgggttgccaagattgggtcggatttcccagaaggacggaatattgattatgttgatcatttggtggccataatcgaaggtcagcagttcttctagttctattttcgtaaccaatgagttaagtcgttaagatattgatcgatactaagggcatgtttggttggttccccgtaattagccaaactttcaagccacatgttttgtatgatgcaattttggtggtggcaaaagagctcagtgccattgtggcaaagtttggctaagagatgagcctgttgtggctgtgtacatccttcgggatgtagaagtcgggttttatttaacccattatctaaaaacgagatgaacctgtggcatgtaaggattggggataggaaaaggtggcaagtattgggtgcaaccaaatgcttccaactgtacgtcaaacttgcctaaattgtgcgtgacaagtttggcaataaaccacaaacatgccctaaaattcatgtttactagctaaaaatgtttttctgccatcatgttccgttatgcactttacgatgttgcacggtggtaatttctaagtattcggtgtgctttgtgattagtgtttagtacatagtgttctcttctcaaaaaaaaaaaaggaagaagaagaagaaggaagtacgtagtgttctgtttttttccatgtgggcagagatccttttccaagccagtcaaaagaaatatatactacagcatagtaaggttgtgtttagttcacactaaaatttggaagtttggttgaaattggaactatgtgactgaaaagttgtgtgtatatgaaagatttgatgtgatggaaagttgaaagtttggaaaaaaactttggaactaaacagggcctaagcttaaaaaagagacacatgaaaattcttaatcctaactattcataattggaagcaaaattatgactcacatgttagattctcccatgagaaagggaactgttacagtcaaccaaatcacttattcatcactaataaagaaaatattaaaggggaaaaaggacaatttgttgaagaaaacacaggagatcagtttaagttttaccttacaaattacaagaaatcaagaatagagtgcaacatcatatttcatactaatggtagcaggcaacattatttcatactaactgcaagattttta

SEQ ID NO: 25129 - DNA, 1501 bp, Oryza sativa
tggttacttattttgggtcagaggaagtatttaacagaaccattttcagcactctgttttgtcggatgtactgtggattatttatgtttggccaaccagatgcatgaaacggtcctcatttctttttcatagtaaggagattctgtacagccagaaatggtgaaaattaatttcaggtaagcattaaatgctctataaccagaaacggatctagtagattatagctgttatactgaaacataagtactggggtacataagaatctcaactcgttagtcatcatcagtgctggtacaagtatctttggaatcaaggattcaaacttactgggaagttcttggagaagtacactaagttctccaaggagatgaagcctccacctctgtaatgacaatacatttcttcttatctattttagccacgaaatactgacaaaagggtggaatgaaggagaaaagccaatacctaaaatctgtagatggatctttcccttgccagcccatctctttccattgttctgatattagtccccgaagctcagctccaggaaaagaagcacgccagaggtccttcaatgcttcctgattgaagaaatgtgaggtgtcacatcgagtagctattccaacatttttcaagtgtcatctccaagaagaaatgaacaatactggagaatcacacatgatctggagttctgtattgccatgcataacttcacaaaagagttaaggatttagttctccagggataagccacactgagaataagaggcctaaataaaaaatacaaaataaacgaccaaagttgttgcattgtaacctcaaaagactgtctacatcctgaaaatctattgcctctacaaatatctgaaatcaaatatattcagttactaacatctaatatttcctcataaattccacatatgtacggaccttttttttaatcatactttttcagttgaatcaattctggttattcaactttagagaatgtttccaactcatatcttgttctggacgttaatataaagttgtggcacccccgcttcatcaaaagagaaaaatatggaacatcaaaagtcctatgtaccaacagttaggtgtcgtgtatcagccaaaaacaagtacctgatgatcactgtttgaactatcatactgaacttctaaccggttctgtaacctctgtaggcactcttcctgggacagaaaatgaaaattgttacttccactgttccactttttttttcaactaacacatgcaaaaactcattatcttgtggcgcacatgtatggtacggaacagtaaactaatatttggaatacttatgttaaaaatagaattgaagccatttaagcgagcatggaaaatgtaggcaggacatgcctgataaaacgcgagaatcagagtaaggatagtaattcggagatgaattcggcgatgaccaaaagcaactttcaaaatttgtgaacagaacccagaactcaacacagtattattagcacca

SEQ ID NO: 25130 - DNA, 1501 bp, Oryza sativa
  unsure (1)..(1501): unsure at all n locations
gcctttccgatgaagaaaaggtggatggggttggaggacagtgggcagcgcgcgggcgcgacacagcgagcatatgattcgcgttttcgttcggtgcagatccactgaaccaaatattgaataatggaattcgaaaccaaactgtaacctcaaagctagcatgatgcaatggcgacagctgagtaagctgaagaggtacacacgtaggaaaaaaaagatctttattagcagattcagaaaatgacagctcaaatcgatcgaatggtaccgtctttttcccgccgatttaattacaaggagatccttgggtggttgaagtagacgacctatgaattggggacaatacattaataacgacacactagccatttgtatctttaatatatcaatccatgaacagggaaaaggtacaagatgcctgggtaaaccttcgactgtgctcgaatctatttgtcacattgagcttaaaaaccggttattttcaccttcaactttaaaaaccggaaaaaatagcaccctaaaccatcttacatggtagtttctgaacttgtgatgatgatagtggaactatgaacttcaatcatgtactaaatgacatctacatcatcaacaaaagcatgtataacaaaattagagtataacctagaaaaagaacaccttaatttcaaacaaaacattaaagaaaatggtgcaagatgctacctatccagttacgaagnnnnnnnnnnnnnnnnnnnnnnnngtacttcaggttggaaaatggacttcaggtaaaatttaagtgcaaaaatagacttaaactagcaataaaaatagcccatgttgagaaaacttgtacttgccctttccaagatgcagtcgacaatatattagtagtacttgtattgtctatgcacagcctccacacctaacagctcaaaagtacccgcccttaatctgccacatcaggacgaaatcatgcagatctgcatctctgtacagaaattccatcctctcaattaaaacgcatatgccccaaatcgaacaaaagaaaaaaaaaaaaagaaaagaagaggggagaggagagggagcggcgaatcgaagcgaagcaagcagcagcagcagcaactcgcgctgttcatttattcgcaccaaaccgaaaggcgagacgaggcgaggcgaggcgcggtggcagaggcagccaaaccaactgacggacgcgagcgaagcgaagaagttcttgaagttgaagcagccgcctcgctcgcctcgcggccctcgcttgcctaatcaggaggggggctatctctttctctctcttttttcctttcctttcctgcgtccttgggatccgcccgtgcgatctcgccgtgggtggagcgccgccgtccatccgtccccatggatccccgcagtcgcgcggatcgcggcgagtagggagggaggaggggaggggagggggaagcggtttccgggaggagaggcgtcctgctcgagcaaggagcttgtggggggaggtaga

SEQ ID NO: 25131 - DNA, 1501 bp, Oryza sativa
cccaccccacgtgcacacaatgtcatcgtctcgaccacgctggtgccgaaagtcatcaatgtgctagcatgaccctggctagccggcctcatccccccctcccccaccccgaacctttgcctgctgctgaccccgccttatccattgcccaccgctggtccgccacctcataggtcatccctctaaccccaactccccactctccctccccatagccaccccccacacccgaccctcgaaaccctaacccagcgcgtacgatttcgtctgctagtgtgtatacgtgaattagcattcctggtttgttcaattcgatggcatttagttcctgcttttgagtggtacaatgggccactcgaatccctccaaaatggtggtctttgcgcccttgcttctccacgcacacaaccggcctagtgatcagagacatcatgactctcaagtctcaacaccactgatctctttctctctgtcatgagaataatgatgataatttggcccttcggcccagattactacctttttcgatcatgcatgaagccaggttgggatcaagctgagaacgcgaccgcgatgtgttgtttcggcaaacgcgtgcgctgatcagcacgagcttcagtatacgcatgcatgtgtgttctcctgtacacatcgatgattcgattctgcgcgcgggctcgtgtcgttgtgacacgatacaatacatcaatacggctggatgcgttgcacgatcgatcgagtcgccgcgcggttcgccatgtacaggtccccggcaacaaggcacgcggcgatcgatggttgaaacccctgccgaacccgtaaactttttctcccgtggaggaccagcacgcggttaagcacaaaccctgaactgacgcggtgccgcgcgcggcatgcagtgcagagtggcaacaggctttcggcgcgcgcgctcacaccccggcccttagccccgtatcgctgccgcctgatcagaccgacgcggagagaggaaaaccgcatcatttccgcgaggaaacgagcccgtgcggtgcgcatgtgcccgcgcgcgtggatgtgtgtcatctcggcacctgcacctgcttctcgtttcgtttcgatccgattccgagtcaaattaaatgacatggacgatcgaatctgctgctcgatcggccagataccaggtctctctctcggaggtgtgtacctgtgattctcttttgacgtgcacgcaccgaccgggaatacgggttggaaattaatgttgcttgtactactacgtagcagacacgtgagcagttgcacacatacgcacacacaagtagtaggtcgctctgctggggcagattcatttggtgatgtgtacattgggcctattcttcgtagacaggatagatatccttatttctttgacataaaaaatgagaagatggattaatatatgatatattattttataaccaacaatttagagtttactttcacatgttgtaagaaaaataaactctaactcctacac

SEQ ID NO: 25132 - DNA, 814 bp, Oryza sativa
cattggtggcccgagcgtgtccgggcggcttggctacacggtggcggaaacaacgcggcacggtccggctggatggaagggcaccccgctctacgcggtgtccgcgtggacgtggtgctccccgcctcacgcgcgtgcttaatcgaagctagttttaatcccttttgattagcacaaagtacatggtgattaagcactaagctaatcacccgtgcgtgccaaagccagactggtctcttgcaagtgggcccacgtaggaatagtcacatatgcaatgtattgtactactactactgtggctcctgggccaactcgtcagttgccagctcgggtatatttatccttatatatgcttgtatccacaattctacatcaagtatacaatttttttactgcactgagtataatatagtgcatctaaagaagaatgtttacactacactccctccgtctctaaatacaagatattttgtccgtctctaaatacaagatattttggttatgtgacatatcctagtacaatgaatgtggacaactttcttatactaagatgtgtcacatccaatcaaaatctcttatatttagggaagaagagagtactatttatcactttgtagtactacttatcatatcaatcacttccaattcaaattcccccatactctactgccaatcatcatcccgaatcaaactatccattagtatttaataaaaaccattagtctttttttaacctctaattgcagccccaagaaatgaagaacggcctgagttggatagttgcatcaaagacttcaggaaataagatgagcta

SEQ ID NO: 25133 - DNA, 425 bp, Oryza sativa
ttgccgccctcccgccgggcggcaggcctcgctgcctataaaaggcctgctgcccagcccccagccctcattcttctctcctcaattccagtgaaaaaaaaaaagagaggggagaaaaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 25134 - DNA, 569 bp, Oryza sativa
agatcttcttgcagcttcctgcgcgattagaagatgagtttagaaaataacaagggaatggggcgctaagaataacgcagaaatgttggaattctattggccttttttgccattctatttgccttcaaatatcggcatgatgttaacttatatcctacacatgaaattaaaatataagccgcttttgttgtttgtacttcctccgtttcatattataagactttctagcattgtccacattcatatatatgttaatgaatctagacatgtatgtgtgcctagattcattaacatctatatgaatgtgggcaatgctagaaagtcttataacttgaaacggaggtagtaatttatatctattctctccagtattggaagatttgatctgatttcctatttctttcttactatactactctaagtgatcatgatggtataatatgggtttctatgctttttaatttttgttatatactaaaaagtaaaaacattagaaaagtatagttaatagttaaatgtaaatgtgtacatttttatctacctgtgccatatagcttttttggcattta

SEQ ID NO: 25135 - DNA, 1501 bp, Oryza sativa
gttttattattttttcggattgaattgccgccacgtcagatgaagaccgagtcaaattagccacgtagacgctatgtcagccaaaaccgctatcaaaactgtcaagagatctcgtttgccccgtaagttgggggacgggtcgtatctggttttgcggtcaagggacgaaaatcggactggttgacaaatagagggaccagagtgaacttattcctttttctagtgattaaaaaaaagtaaagccttcatacattttagcccatttatctgccacacgaggaagctacggagtactcttggggcccgagagagtggaccttttaaatgaagcccagtcggatcgcacggtagcccacccacttcttccatgtcctcctgtgccgagaagcagaggaaccaatcccggcgagggcgcgcacacagcggaatagcgcatcgcctcctcgccttgccaccggcaagccgcgcctccgcctctccaatggacgacgcgccatggcgcgacctcgacgccgacgtcctccgcctcgtcgaccgcagccgcatggcacgagtctgccacaactggcgcctcgccgtcgcgccgcagcagccgctgccggagacgaggccgctcccatcgatcctcgtcccgcgcgccgacggcccttccttcgcgtcttgatttgatatggtggttgttgatttgcccagttagggcagttgatgatgcgttctcgagatccatgtgtgcttgcaattgcttgatccataataacatctcttcagtactctctgctatttttcaccatgttagactaatgcagaaattgttggtgttcatgactcagattgcagggaagacgaaactgcttctgcagcagtgcagcttgctttcggtttgcttcaaatctcttctgaggatctaatcagaaattcagaaattctgcattcattgtttacttttctcaactttgtggcatcctgtccaatggtgcagttaaaaccagttcattgcttaattacttactgggaacgccaagccgtgattttgaggaaaatgcattcatattcaagcatgcggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaagg

SEQ ID NO: 25136 - DNA, 1501 bp, Oryza sativa
tgccatttcaatcgctggcatcaacgtctgcctcgtcttcccttgtcgccatcgtctccgccgagccgagcggacagcgccgctggccacccctccaaccggcgcccgacctcctcctttgcccggcgccgctccggctcctccagcctgacggcctccatcaccgccgcgctggccttcccccatcctccttgccgccctgacctccttccccgatgccgcagggccaccttcaggccacggtgttcatcagtgtcagcgctactaccggagacggacgccggcgcgtcgttgtcttccgcggggaggcggtggaacatgggactggtgaacgcgatggccatgatgacgatggtggtggcggcaacgagcgggcccgccacggcgcctctgacgatctggccgtgtggcccccgcgagagatatcgagaggtcaccgccacgcagggccgaccggcgcctgggcgccgcgccgccgtcgccttggcccgatcgccggccttcccccatcctcctcattgtcccggccttcttccccgatgctgcagggccaccttcaggccgccgccgccgtgcagggctcgccgccgcccgccgtcacccagccgggacaccgcgccgccgtcgccacggctcacgccatcgttgccttggcccggtcgctggccgcgccgccgcacctagcctcgccgctgcaccggccgcgtagggctgactgccgcccagccgccgcccagccgggacaccgggccgcccgtcgcctcggcccgatcgccggccgcgccgttgcacctagcctcgccgcgccaagcaacgcaaggcgcgagggagagaaacgaagaaagcaaagagagaaagagagagcaggtttttccctgtgtgccgtctcaagtctaaggacaactaagtcatttggctgtgcagttacccaccgttacgaccaaaaacagacggaatggtgtgaagagcgcaataaagtttgacgatggcatagagggaggctcgaactttttagtggcacagaagcaggcaccatctttcttaatggcacagagggaaaaacctccaaaataagtgtacttaagtaaggatgtaacatatgaactacgaatctgaatagcctgtacagattcataggtctagtgtatcacatccttacctaggtgtaagggtgcaagcgggcaggcttgcaaacccgcttatataccttttacctaggtgcacttattttgaggtgaacgatccattttataataatataattattgtatttttttattataaacccaaaaggttacaattgtattggccgaaatgtcctaatacattataatttaatatgattatttaatagttgataaggatgagttaattccaaaaaggaatattccaaggtttggatgagcttcacacctcaaaatttggcagaccagtccaacataatttctctctcactgacaagtggactacatcctcccatctataagaaaagacgagacca

SEQ ID NO: 25137 - DNA, 352 bp, Oryza sativa
ctcgttttgggtgaccggtgccggacccatcattccggggcacggttgggcttatcggtccggggccgccacgtggcgctttcgtcccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctagg

SEQ ID NO: 25138 - DNA, 1501 bp, Oryza sativa
tatactaacgtggaggaatacccgtactaagttgtcaccatcagcggcccacctctactgtcctgcagcatatatgcccaattaatgatatctaataatctaagcaccatgcttacattatcaaatattactctatatcctctagaataacatagatcaatcatttccatgaacattaaacccacaccactgcacctctctggtaggctagtcatacaactatgtcggcacaaatataaagtaaatccagtactcagacagagtaaagtaccgaaggtatataaagaagaatattctattaattccgagagtcttacgaaagaagaaagaaaagctactagagccatactgaaatcttctgaatactcgaggacttcgagaactatcctattctactccacttagcactagagcattaactaaacttgagagagagagagagagagagagagagagagagatatcaaagcttcttgcttgagtgtgtgttggaatgaagaaagtgacccctttatatagcctcccaatgatggttatggcagttggaattgtcagaaatgccctgcaaccgtcattaggagtgcatctggagcgtccatgtggagggctgagctgagccggtgctaccagggttcgaccgaacctgggccggcccagcaggcctctagatttggtcagggggttgacagatgggtcctcatggcagttgtggcagttatgacggtttccaggacggttacacctgacatgtgggcccttgtattcttaagcttgcttaggagtgaagttttcattaatttcttctttattcatgtgctaatctctgcaaacaaataatactccaagtacaagtggaaatatattattctaaaataaatatgtattgcaagcatagctagttctcctttattttagttatattgacggtcaaaattggtctgtaacgaccgtcaacatctactccagaaacaagagtgtacggcgtggatttggtagctggacatgccaaagtccaagttgacatggtcaaagacaattgctgaattggcaactaccaatcccaccaaaggacgagatacttacactcgctcatgcacgtggaatgtttatccaatggccaaaagacctcatcaccacaaagattattccaaggtcaaatgttgcagcaggcccaactcatctagctcggtcagctaaagctcatgcacctcagatggccattgaagctccttttgggtcccacgtcttggattttggtggaatggccatagatcgtcctccttcaaagaaaagaaaaggccaattcatctccaccgatggtgtctagcaggccaaatcatggaaggggaaaattgaaaggaaaaggaaaggtaggagggtcgtccttacctcccaaacggctagatctagataaggaggtgtacgttgctctcaagatcctagatcacgacacattctggccagggatgccgttggatcaagacaatgaattagccagaat

SEQ ID NO: 25139 - DNA, 1501 bp, Oryza sativa
tgctacgcgacgcatctatattctgtagctgctgctgctgccgatcgatcgagctgtgtgatgtcgccggcgcttggagtcttggagcttcatcgatcagtttcctccgggaccaaactccatccggcgacagtgctgttgcttggttccttccgtgtacaagtacacacggccggtcccctcctcttccatgtccagggaccagtgggatggagacttgtgaatttggaggtttaattttccgagtcgtttccgatgacctttgacctgaccagggtctcaaagatactcctatgacggtaagtaatcggtcgcggttatcaatcttatcaagtcggttcgaattgagaaaccgtgcagtaagccggctaaatacgggaaaggttcagtgtatatatctgcaaaatttgttcggatttcaccggtttttgtcgattgatttcgagctaatcaggtaggactgttgggtatcgacaagttttctttgtctccagaaacgcggggagcacggcttgaaaacgggggctcctcgccgtggaacaattctgctcgtacaggctagtaattacttagccgagaagcacaaagatgacgagcaacaggaagaaaacgcggtacaaattctggacgaaacacgactggagatgacaccagcccatgaccaggattcgtcacatgaaacagcgatgtgcgatttgattggaatcagttcttggtagcccgttactttcagagccatgaacacaaacaacaatgccatcagcatgtgcgagcatagcacagcacggcacggcaactcagggactaaaatttgattaatactggtatctgtatactacaggcttcgaccctactactagggaccatatggctttcttttctgcctcatattcagaaacttctctgcattattgttattattattattcctgttcagagtttgatccgatcattcaccggtaaggctaggcatttcgcagcggggaagccgtcgtcgtgaacggcacttcacgctctcctttgactcggctgctattattgaacggcgacagctcaacgtgccatttctgaacctctatgggatatggactcgtttcgtgattaacttaacctttgtgtcaataacgagacagagcaaccgtctctgtcaaaagaaaaagagaagatgttttctgtttaatcgttcgaaagctataaaactattacacacactcatatatatatcgtccttggcgattaaaagatcaatgtaaaaaataaatcataattgaaaactctaaaattaaattcaatattaagttttatttgtagataagttaaaaggtaagcgatgggtgttgttattactgcacgtggcgagttctaactggccagcgcatcgcgtcaagctagaaagaactcttgtcttgtcagctgttctgttcgacgatttgtttacaaaaaaaccaagttaggcagtggaatttcttaatggaattcttgattacgtgagcttgattag

SEQ ID NO: 25140 - DNA, 156 bp, Oryza sativa
gtgtgttcaccttcttggcggcgattaaacgttgccaaaaacacgtatattgcatgacctctgccggggcttttgcttccgcctttccaatggaagagggggggcagagggaattttaagggcgaaagccgtccgcttggccacaaccacttcagg

SEQ ID NO: 25141 - DNA, 808 bp, Oryza sativa
ggggcccaattaataggcccgggtttccttgggcctaaagtttggatcgctgctttttgctaagcgtttttttggggccttaaatgttttttttttttgagaacgtaaagttcggatgtacatatggtgcaaaatcgtgtctagcagacaggagaaccaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccaga

SEQ ID NO: 25142 - DNA, 1501 bp, Oryza sativa
cctgagatttcccgtgttgagtttgatcgtcgtggtacaggtttgctttgctgttgatttgtctgagatgtgcttagtctccgatctgatggattacattagtgcagaaattatctgtttccatggctttgattgcattaatgctgcattatattgaagtcgattataatgtaatgtgaaaattatatgctcaattattcgtgcttttgttttcctgataaaatcgtgtgcattgcctgaaatggatttgcaatgaagctgaattgcttctggggactgatttcagttaatcagtttcaggcttttcagctagatgtgaaagatgcagatcgtttgtgttttatttgttcttctataggtactactgtagtactgtaccagtactacttttgatgctaccaattctactttctgtgccacgatttattcttatattatatgcatgatgtaatgttgagtacaatttagtagctgtggaattggctaaacagttaagagttggtatttatctgatgatatctgaagctttcagtaacacctgaatggcaaatttgagaatcatggagaggatgcttatctctgcattccccacgcatttttcttaacgtgtagcatctgtctaacagtacattttgtgattttgtcagactgcacattctcttgaaaagagagagaaccttttcgatgttccaaaactatgaatcaaccagatgtcggaaggggttttcagaaacgaataaaaaaactaatttcataactcgcctaaaaaccgcgagacgaatcttttgagcctaattaatccatcattagcacatgtgggttactgtagcacttatggctaatcatggactaattaggctcaaaagatttgtctcgcgatttcccccctaactgtgcaattagttttttaatttatctatatttaatactccatatatgtgtcaaagattcgatgtgatgtttttggaactaaacaggccctagttaactcgtatgggtgcatattcatgtattttcctcagcacggcctggcgttccaaataagtaattaagcagcgaacactccaatgaactgtttttactgcaccattggccaggatgcctcaaagttaagaaatgtaaacgaggaaattcagagaaagcatcctttcctctatgtgtatcagcttttctccttgtgtcgaagcagagcaggacattctctgttcagtagtagtgagatgatcacagtggaacaataacccatctcaaacgttaacccatccctatgtgttagtgcttactgacgtactcaacattctgcatcatgtatatgaatgaatcatagaacggacaaaaacaaattcagtgactaattacttgctacgaccgagtaacttgtgtatccatgaaatcgatcagaaatagtatcatcaagacagcaaagattttgggattttcatatatatttcataacatgggatatacgggtggatgcaactcttctcatatcctaactcat

SEQ ID NO: 25143 - DNA, 508 bp, Oryza sativa
  unsure (1)..(508): unsure at all n locations
gtaaaaaaaaactgttgctgacantcnnnnnnnnnnnnnnnnnnnnnnnncacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgata

SEQ ID NO: 25144 - DNA, 311 bp, Oryza sativa
aatgtgtcaaataaagatgcaaagcaagaagatcaatgattcagatccaaatgcagaagacaatttgacctcacatgaccaggccatcaccatctgaggaaatacagaggaaatattgttggatccagatattgcaaaatccaaaggcaggccagctcaaagatcagagccaattagggaagaaatccagcaaaaagacctatattcatgccagttctttcagctccaaaaagttacacccaaataacatgtttttttttttaaaagaaaattttttttataatgacttcttttgtgtattgttctaaagg

SEQ ID NO: 25145 - DNA, 1501 bp, Oryza sativa
ggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccctcttccttttctttccaaaagggtttaattaaatcctttttcctttagaccaaaaatccaataatcttagaaattcaatatcttcccaaccgtaaatccgtttgactccgttcaacttccaaaattcctcaaatctcgagatctatctaatggcacgcttagggggtcattaatagggctttatttttgccgtttgttgagtcgtcccgttttgcgtgtagtttcggagcccgaagacccgcagtgcgaggatttcgaggatcaagctcaagatctcgagcaaggcaagccacctttgaacatcttgagcctatatttaaacttaattatgttgcttaaaaaatattatgcattgataggatcgcacttaattttcttgtcccgtctgcaaggcagattggcagacctacctagtttgctgcatttgatccctcatttgttaattgttataccatgttcccttgtaaccacccagttgcgcctcgaaaatcgtgcactctgcacgagtatcgacggacgccttcaaacttaaaatctgaaaaacatcttgggtaaaacgtgggttttacaaaagacttggaaaacccgacacctgggtcggtgcttgcgaactaaatgaatttccaaaaccgcggaccggggaacgtaccgggggtacggtttcccgctcttgcacttaaggaccgtttccttggaatttcatccgatcataagtcaagtacgaccacatggatggaatgggacacccctggctgagtaactagcttatcaggggagccttgatgccgagagacatgtggattcgctagggtggtgtcggggaggacccctgggcttcctggcacagtatggtctgggacctaacgtgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaataaactgtttgaacagccgtgcccacggtcatgggcggatgtgaggtgattcctagcgtagttttgtttgactactgccttgtgaaattgctgttgtgaaaaggggatcgatgtttggaaaaatctgcagctgatgggatcagctaggcccgggtggccgtttgaaagttgttggcccgggtggccgtttgaaagttgttggccgggtgccaatcttgaacaattctaaagactgatacattacacatactccgaccggacgagacgcactgtctcatccgtgtcgtttgagaagcactcacttagttgttttc

SEQ ID NO: 25146 - DNA, 288 bp, Oryza sativa
  unsure (1)..(288): unsure at all n locations
cgcgccttgattgcctatcagtatggnacagnacntcatcaattgatgttaatgaatctagtctagattcattaacatcaatatgaatgtgggaaatgttagaatgacttatattgtgaaatggaggaagtatataggaggacaccatgaatataatctcttgttttgcggagcttctgatctgttggagatcagaactacaaacaggcatttttgtgtgatttggatgtacacatgccaaaactgatcgacgatatatatatgaatgcgcatatgcatgcatgcagg

SEQ ID NO: 25147 - DNA, 1501 bp, Oryza sativa
ctacacttattttaggacagaggtagtagatcatactgtacacctttattttttttttccactttggtgtactaagtttgatcatatactacgtactgatgagcgcaggcctgacagaacacacaacacaggaactaaaaggaggagaaaaaacaacacaggctcatcagcgcggcgctcctttgcgtacttgtatgtactcctacgtatatgtgcatcgatgcacatatatgcttcgatcgatgcgcgctaatgattgttgcaacagagaacctgcagttccggcgaaaacgaacaggggctcgcaaacaaaaccgccatcaacactcgcgtgctcgcatctcctcggcgtctttcagctggtgtgtgtattcagaagctagccatgcatagggagggcatgcaggcatgcagctgcacgcgaatcgatcggtctggtattgtggtcatccatcggggagggcctcaaaatgtggtcgctgaagaaaaaattaacactgtgagatcgatcgagcttgccatgaaatcgaggtgagtgggtgtgtcaccttcgaatctttgatcatgagctccacctacacgcgctggcccatcatgatggcctaggaaacacggcccggtcactgcgtgcgcagggatcccgtcccggcccaacttgaggaggcaggacgcacgttcgcgggcatcctggttgggcccagaggagaagagggtgacacggtccaatgcgccccaaattgcgttgatttcctccagcgccgtgcggagcacccgtcccggcggatgcggcgagcccgctatttttatctccgcggtcgcgactcctcacctgctgtctgctgcggtggtgcctgcgtggctgcgtcccatgtatcgcctctgtttgaagggagcatatctatgcacacatgtcctcgcgtgtacacaccatgtacaccaactaaaaatttttacaaaaaattctagaaaaatttatacatgtacttttaatagtattatatctacgtgcaaagtcgcatattcaaattcattctacatagagaataacaaaaaagataaaattctgacaaaattgcaaccttaaaactgtcagattttttgttttttggtatggctaaaatataatgaatttgacgttaagattttaaccctaggtgtaatacaattgatagtatgtgtatgattttttttagattttttggtgatattttttagttggtgtgaacgtgtgtatacgtgagggcctgtgtgcataggatatgttgccgtgtttgaagactattttttgctgaaatgtcatgcaaagaccttaacagaaccggcggcacatctcggggatatcattttccctcttgcttccgttccatataacggattccgtgctctctcccgaacttcagctgctccccaccagctctgaggccgggtcagcacatcacgtgcgccgccaacgcgtgcctgcggagcgaggcaagggaagccatggcccagggcgcatagc

SEQ ID NO: 25148 - DNA, 652 bp, Oryza sativa
  unsure (1)..(652): unsure at all n locations
gtggcacnngtgcgacaaccgatggtacagnagttcatcattttctgtttcagtagtcttatagcctgtttgtattgtttgctttgtatgtcgcttagattccggctctcccgacgctctggtgtactttgaaatagtcgccgaggttcctccagcagcagagcaaggtaagtcatgcttgtcacttgaacatgttaatcctatattgcaaatgctctactattttcccttaaatactgcattgttttataatgttactacgggatgtttacctactgttacagccatgctattttgtaccatgctcctttgttagcttgggatataacatgactagagattggactagggattgcttagccttgcttagttcaactagcacacaatgggggaaatcacattaatgcttagacttcaggttctagtgttggtggtggagtaaagccaccgtcttggtgttagtcaattaaaatatactaattgctgggctgtgggtgcatggttttgatggtcgcgcccatggcacttaaggaccggtttgtgggaaaccctggaagaattcctcgtacttgccacaagccagcgtgggcaacggctgggcttgtagtgtagctttcctctagctgacgcatccaggcaagggtgggcgtga

SEQ ID NO: 25149 - DNA, 1501 bp, Oryza sativa
ctagcatctttaggcattgtatggatctttttactaagtctgataataaaaataccatataatatatgttcttatatgtcattaatgaaatgcactattaacttactgtttgttaaacttttgcagattagtaaacagataacgatggtagatgatgtatatcgattacatgggcttcctgaattctataaggtaatatattctttagcaatgtttgtgctggtgttctgcatattttacttgatgggtaccacatcacacatattttatggtttaatttcaaaacatgcgagcaacataattgcaacctaaaacagaaatctaatacactgctgcaatataaggggagggcggtagtgtactataattttgtttggtttggaacatctgtctgacagaatcagtcactggctgattagaatgattatagtgtcccacccagagtatcactaattcattatcatctgtagcatcaccacatttgtgcaaaattatttaactagtgtcttgaacttatggcagaatccacggccacatatatcactggcgtgggcattgggtgatgttagctgcaaactgaaacaagcaattaaggagatcgaaaaatctcagagcagtctgggcacatctcaaatatctaatctgagatgcaagtttagtcatgtagtgtgtaaaataggcaagaaggtgtatgatatctgtaaacttgcagactgagagataaatttcttgtgcacttgaccgttgagttctggggttgcaacagagatatacaaatgagcatgaaaacagagtggaagtaacttggaaaaactacaatattattcatttggttgagagttaaaacttcttgccagcatgcttctgatcaatggttgtatatcttttgatgtacagcaagatagtgtgcaggctttccattccaagaaaggaatgatggccaaaatgatcacaaattcacaatgattaaatgactgcatgaggtaaaacaaaatctagaacaaaaaggaagtctctctaagagcaactttaatagtatagcccactactagctccaattcatctatagccaatctaatagccagttcatacaatagtcgtcccccctgtactattaacacacggccccactctttcatatgcacatttcatcttgttctccgccctttctctccttccccactctatcgccgcacctcattctcatcactcttacccattctcacgtctttatcctacctacccctccccccctcgctactcactcgggcctcccatgtcttctacacaaccctccctcgaccccgctacccccattcattccccccttctccccccttcttcctacgacactcccatctaatccctccttctcgcgttatcgactacccttcctactactcgtactcccgactacctgcaattaatagtcactgcgtttatacttcaacggaagcccacactcccaaatctggggatcaacccaacactcctatctccc

SEQ ID NO: 25150 - DNA, 1501 bp, Oryza sativa
gaaatctacgaggcagatggtgtgaggtggcgatgcgaccacacaggggagagtgcccgaggcattaggctaccagcagaatgcaggcgcaagtcactggcatgggcaagtcaactggttctagtctattattgctactctgctcatctcgttcgctccttagctaataaccttgtgctaattagctaatggccttgtgctaaccaatgaggattctgtatttttctctagtatcttgctaatcaagaatgcacttttatgttggcaatgcactcctccgttttcttttctatttgattatgttaacattgaattcgatgtaggtaaaggtacgtactttactttgcttttattgacttagggcctgttcactttggcatagttgccgaaattttgacaacttgtcaaaattttgacagcatttcttatataattaccaaaatttaaaaatttgacagtaaactaaatgtagccaattttttagcaactttaccaaaacttggtaaggttgaaaataacatcaaatcaaagtgaacaggctcttagacttaaactttgagcctatcctcactatagtttgactagatgtccaccctagcaatctgcttgagagatactccatccgtttcataatgtaagattttctagcattacccatattcatatagatgttaatgaatctagacacacatatatgtctagatttattgatatctatatgaatatgtacaatgctagaaagacttacattatgaaacggagaaaatagaatcataaggcttcttccaccaatttggactatagtttgtaaggttgcacatagattttataatatttaattagattccttggtacgaaatgaaagtggttaggacattgtaataccaatttgttgcaggagctagcctgaccaccgttcaactgcgtctgcagttttattccttacctcgttgctcggaggcaaagatgccacgtgggataaaaccaccttcgaaactgctcggggagtcgatttgcaatgggttatacccgattttactgttgagggatgcgattcaatgaggggcatgagttgagggagtcaatataaacttatttctccaactttccgtcagttccccgtcccttagcacccacccccaccgtacgcacaccaggccaccaccaagaaacgatggagaaggcctcggtccatcaaagtagcccatctaccgatcacacctgaatttttttcatttttaaatttttatttttaatatttacagaaatattataccggcaaaaatatttacaaaaatagacccagggtgacgtgagagacagccgagatgcaaaagaaaaattagcaaaatgcatttttaacatggcgaaaattgcatttagccccttgtacgagggcggcaagagacctcaatgaaaaatgtgcacaccttgccgctctccactttggcggcaggggggccatttctgtaaatattttaaatggtataatatttctgta

SEQ ID NO: 25151 - DNA, 1501 bp, Oryza sativa
gtactcagcaagccatgggaaataagtgtttaatgcaggcttcaaggaaaggctgatgtttttgcaattaatttttatttgaactcttttctgaaacaactaagtgagtgcttctcaaacgacacggatgagacagtgcgtctcgtccggtcggagtatgtgcaatgtatcagtctttagaatttaaacaaggttagcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcatgacattactaacccggatcacccagcccgtggggatcagccacgtcgggagacctccaagctttcatgacaaggcatttccaaagccgacacaggtttaccatacgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatagtatagcaattaacaatggaaggatcaaatgcaacaagttaggtaggtctgccaatctgccttgcagacggaacaacagattaagtgcaatcctatcaatgcataatattttacaagcaatataattagatttcaaatataggctcaagatgttcaaaggtggcttgccttgctcgagatctggagcttgatcctcgaaatcctcgcaatgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtcaaaaagaaaaggatttaattaaatccttttttggaaaagaaaagaaaagaaaagagggagggattatagacttttcctcgggcggctaaggcgcggcccaagggaat

SEQ ID NO: 25152 - DNA, 1501 bp, Oryza sativa
ttcttctaatgactcagcttttgtgtatggtggcttctctcttgccgctttacactcagtcactgaggagcaattagagaagatccctgaagatgatcttgctctttttgctagaaaattctcaagagcttacaaaaatgtgagagataaaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctaggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaataatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctataacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcac

SEQ ID NO: 25153 - DNA, 1501 bp, Oryza sativa
aacatttctcgatccgtaggaacgggcggtgaggtgaccagtgtacgtaacatgttcgattgttcatcgatcccaagcgtatactacctctatcccaaaataaatgtagccgtgaaaatccgtgtccaatgtttaacttttcattttatttaaaaaatttatgaaaaattttaaaaaaattagtcatacataaaatattattcatgtttttatcatctaataataataaaaatagtaattataaaaaaattttaaataagacgaaataggatgaatagtgtaaaactagtacgagcgagtcgatatcaagcaaattaaaagcgagcacatgcacatgcagaggccaggcttgtttaattgtgttacaagcttggccaaccggacattccactccactgcaacacccttctcttgctcagcgcgctcacgtcgaatcgtaacagttctacttaaaaaaatatgttgtcatataggagtattttttttcttgatttgagttattttgtgattactatctctccgttcatgtttctatctctctgctacctcttctttcaaatgggaaatttattgttgtaggctgtgttcttccctcttttttcccaactcacctttcttgttttccgcgcacacgcatttattctcaaactcctaaataacactggtaggaaaacaatctttctgtacgaggacccctttagattgcagatgaaccgtaactaacggcgtctgcaaaaatcgacctccattttaacgtacgactccctaagagacccgcatgtaaaattctatttttacagacgggtctcttaaggggtcgcatgtaaaaataagtctattcacatgcgggcctcttaaagatctgcatgcggatctcttaaagattcgcatgcaaaattatcttctctttattacagtttttccctcctcaccacttcaaaattttcacctcttatcctctcctctttctcctctctaatatttccccctctctcttccttcacctctatctttctctcattttctcctctccctctctttctcttcggctcctctctctctctttctctcaccgagcgggaggcactgggcaacgggcggtgcggccgacgagcaggcgctgggagcaggcaccaccccacgacacagactacggcggcggcactggggggcatgggcgacggcggcggccctctcccgcctggatccgccggtggttgccctcccctgctccgatccgctggcggcggccctcccccgcctggatccgcaggccggtgccctcccccaccctgatccgtcggctgtggccctcccggtgcctcctcaccgtgacaggaggaggacgacgtcgacagtggctgcgaaggcttaaggacgacggcgaaccggtagtgggtgtatttttcgacttttggaatttttatttttttcacgatttttccttttcgcttgcagttgcacgggccgcatatctcgtcctaagcttcataatccgttt

SEQ ID NO: 25154 - DNA, 615 bp, Oryza sativa
tgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggc

SEQ ID NO: 25155 - DNA, 1394 bp, Oryza sativa
cccttgtttagattcaaactttggccgagtttagttctaaactttttcttcaaacttccaacttttccatcacatcaaaactttcctacacacataaacttccaacttttccgtcacatcgttccaatttcaaccaaacttccaattttggcgtgaactaaatacacatttttcttcaaactttcaacttttccgtcacatcaaatgtttagatacatgtatggagtattaaatgtggacaaaaaaaaaccaattgcagagtctgtatgtgaatcacgagacgaatcttttgagcctaattacgccataatttgacaatgtggtgctatagtaaacatttgctaatgacagattaattaggcttaatagattcgtctcgcattttacaggtgaaatctgtaatttgttttgttattagtctacgttttcaaatgtgtgtccgtatactttaaaaaattttggcacacgaactaaacacgccacaggccgtgtttagattcaaacttttttccttcaagcttccaacttttcagcacataaaatgtttggacacatgcatggagcattaaatgtggaccaaaaaaacaattgcaagtttgcatgtaaatcacgagacgaatcttttgagcctaattacaccatgatttggtaatgtggtgctacagtaaacatttgccaatgacggattaattaggcttaatagattcgtctcacagtttacccgtggaatctgtaatttgttttgttattagtctatgtttaatacatcaaatgtgtgtccgtatacttaaaaaaattttagcacaaaaactaaacacagcccttataggaaagttagatgtgatgaaaaagcaaaaagtttaaagaaaaaaattggattctaaacaggcccaaaccaaatatcctaccatgaacacagcgtcaaattttgaaaagggaggaaagttaatatgcaacttttgcatggctgcatgtcaaacccgtaacagtccccttccttatttaaaataaaagagaaaaaagaaaaagaaaatgtgaataaatctgcaacgttcacctgtggagtccgatccaatccaagccgtaaatacgaacgagtcttccatcggaaggaaacccgccagagagagagagagagagagagagagagcgcaacggcctcctcgcaccaaatccgccgtctctgcggctcctctccttctcctcctgcaatccaaccgccctcaaaaatacttgcaacccccactcatcgtctcccctccccgtctccacgccatgtcgtcgtcgtggttccactcctcctcctcctcctcctcctgctacttcacccaccaccaccaccgccacgtcgtccaccacgcgtcgacctacttcgacggcgacgacgacgaggg

SEQ ID NO: 25156 - DNA, 700 bp, Oryza sativa
aagaaagagctgccgaacgcgcccgaagaggtggcgaacgcccctgcgaagctcgcgaaagcgccggtcgtgcctgcgaacgcgctcgaaggcagacgaggtcctgcgataaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaa

SEQ ID NO: 25157 - DNA, 1501 bp, Oryza sativa
agcagcgcctgcacgggcgacggcggcttgtcgacctcgatcggcgacgcgctcaccagcctcagcccctccagggcctccttgctcaggttgttgggcttctccaccccgccggaccgaaccctctgtgtcacggaagcaaaaaggatttttagaccatttttctccagtcgagaaagcgcagcgcaggtggatgaggagggaggggattacgagctccttggcgcggcggacgcggcggcggatggagcggaagaggaagacggagatggcgccggtgaggaggacgctggtggcggtctgcagcggggtggggttctcgtcgatggagaagagcgtcggggtgcggagctccacggggccatctccctcgccgtcgtcgcccgggggaggctcggctgccgaggtggacagctccggctcggcgcggacggcgacggagcggcggaggcggagggcggaggcggaggcggcggggaggaggtcgcgggacggggggaggaggaggcggtggcggaggaggaggcgcggagaggagtggagcagcagcatggtgggagtggagagctgcttggcggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatatttttgccggtataatatttctgtaaatattaaaaataaaaatttaaaaatgaaaaaaattcaggtgtgatcggtagatgggctactttgatggaccgaggccttctccatcgtttcttggtggtggcctggtgtgcgtacggtgggggtgggtgctaagggacggggaactgacggaaagttggagaaataagtttatattgactccctcaactcatgcccctcattgaatcgcatccctcaacagtaaaatcgggtataacccattgcaaatcgactccccgagcagtttcgaaggtggttttatcccacgtggcatctttgcctccgagcaacgaggtaaggaataaaactgcagacgcagttgaacggtggtcaggctagctcctgcaacaaattggtattacaatgtcctaaccactttcatttcgtaccaaggaatctaattaaatattataaaatctatgtgcaaccttacaaactatagtccaaattggtggaagaagccttatgattctattttctccgtttcataatgtaagtctttctagcattgtacatattcatatagatatcaataaatctagacatatatgtgtgtctagattcatta

SEQ ID NO: 25158 - DNA, 1501 bp, Oryza sativa
tcaaacgttgaacatgaatgtgcaaaactgcacttattttgggatggagggagtagattcgacccgttacattccaaccagaggcctctgccgctcgatcttgctacactgatactgacatggatttggatgcttgacgcgttctccgcctaatcttccccccggcagattgatgaggcggtaggcatcactgatgctgtgctccctgttggaagtgaaagcggaccggagaaccaattccacaggggcagctgctgctggaccactcgaggtagaggtttcatctcgttctaacagtagagtgatggacaggaggaggcagggacagctcgacaaatcattgctctttcctctctcccgagaaacgatagaatttatagttataccctggttgcataattggaagctcgccgttgatgaggaagaaagggacgccgacgatggggacgccgcagcccggcggctcagttcggtcggcttatcaactgggccgcctggtccgtgtcggggacggcgcgatgggcttcctcaacggcccaagtcacccagatgggcctatgaaagtagcccatttgggtcacttcgatcgtcagatcggatcgagactactcatcttttcgcttatacttatacgagcaaagttttaaaattttaattttagatttagagttaattttaaagttttttgtcgttgtttgttttccagtatttgcttttagatcgctaaaaacacatactgtgttcattttttaatagatgacgccgttaactttttctcacatatttgactatttgtcttattcaaaaaatttacgtaattataatttattttgttatgagttgttttatcacttatagtattttaaatgtgatttatatcttatacatttgcataaaaattttgaataagacgaatggtcaaacatgtgagaaaaagtcaataacgtcatctataaaaaaaaaacggaggcagtatatttttcgtttgtaaaatatgtagtttgagtcctaccgctcttccctgattctggcggcacgcagcgccgcctccgccgtctctattttcttttctagttgaatctctagtcgacgtagaagaattcttctatactttctggttgaatgtctagttgacgcagaagaatccttgtattccaaaattttcatggagctttctcgcagagaagagagtacattgacccctccaagaaaatggcgggagcgtccgagaatggcggccattgttgcatgccaaagcttctaaacatagcttccacaatcgtctccgggcccttcttttttcccgggaagcgtcagcgcggccacatgaatgaaccctcgttctccaatgcctccggccttcttcctcctccgtcctctctgccaatggtgatgtcaggcagagagtgtgagagagaaagaagaagcagtcaataaggaggaggagaaagaggagtgggggaagaagagaagagctagggatagattccggccatgtcgt

SEQ ID NO: 25159 - DNA, 1501 bp, Oryza sativa
tgccaccatggcgcgtttctttcgccttcgtttgtcatccccgccatcgtgctcgaaggccggagctgcactccatgccattgcgctcgggtgagcataccagcgagtgatgatggcggtggccaagttcgagtactgcacgggtgcaacgacaatggcgtggtcggggatggcttcacgccgctgcatctcccctcctcctcgctcctctcccctctctcctctagcacgtgtgggtcctaccacttgagacgaagaactcatagccaaaacttgcttcgcgttcttgaggaggccatgtggatggatgacgtggcaacgaatatttggtttggggaggaggctgaacgccacatcggcgcaatgtgaatgccctaagggtgttcttagcttttcatgtcagcttttgccatcttctatttttgtcctcacatgtttttaaactacataacgtataaaatttagcactaaacaccctaaaattcagaaacaaggatacaatttctccccttccatcattctctctattccccaactaccacaactcaacagcggctggcagcacagcgagctccaacagaggacagcggctccccaacctcctcccaaacagcggctcgaagggcgacagcggcggcgcgagagctcgctgggacccctcctctcctggccggcaacgagcgctcagcgagcgacggcagcagcgtgggagctcgccggggcccctcctctcctggttggcaacgagggctcggagggcaacggcatcaacgtgagagcttccggggcccctccattcccggccagcgacgagggctcagaggacgacggtggcagcgaggatccgaagcggcgtgagagctcgtcggtgccctccacttcctgccggtgatgaggagacagagcgccgagggtgacagtggcggcgcagatccagagcgacagtgactccgacggtggagagagaggtttgtttcgatggtggggaggtggggatgatggtctacagcctggattccatgcttttatctgctttttccgttgagcttctcgtgtctcaagttaggatgtgtttagttccaggggtgtaacgtttttgaagtatacggacacacatttgaagtattaaacgtagactaataacaaaacaaattacagattccgcatgtacattgcgagacgaatttattaagcctaattaatccgtcattagccaatgtttattgtagcatcacattatcaaatcatgtcgcaattaggctcaaaagattcgtctcgtaatttacatgcaaactgtgtaattggttttctttttccacatttaatgcgccgtgcatgtgtccaaacatccgatgtgacgttttggcccaaaatttttgggatctcaacaaggcctagtcccgtattcctcacaaagaaatggtccccactgccacattagcagctgtcctacgtggcgagctgtgccaactcgccacattcctgcactgtgaagggacaa

SEQ ID NO: 25160 - DNA, 513 bp, Oryza sativa
gaacaacatatcagatcattaggtgattccctttttgaaatcatatggataccaccagatctgcgagtgagcgggttctgttcatatcttatcatacttggaaaaccagcaagaaaaatcatctgccaacttttaaagttgttggagattatccatgctgccaacagatttgcttccaggtttacaatagctgatctggtgttcctccctgatctgggttgtatagcttttaagaaaggagtaaaaataaggtggaacctcaggagagaggagtacaaactcaacatggtgatgtagctagcataattagctgctggttcaggtttaaccgcaggaagcttgaagcgctggaagcagggatccatgagcttcgtcctggccaaggtgactctccaatgtttgttgatatattagttaaggatcttagaagccccacacatgagactggtctcagtgccaattatagaggtttctacaaaaattgtagtgctctgagatcttgttcggcccaca

SEQ ID NO: 25161 - DNA, 796 bp, Oryza sativa
gggaaaggagggacttaggtgagacctgggcttttcacatataggcgacaagagtgatctaccaaagaaaagcggaagcgtccacacccagccagtaagaaaaccgggtggcgagttaagtgtggtcagacaatctaaagacttaccatgggagttagagcggccattggggaatcaaacggtggtttttcctcagcgactcgggggaaaagagtcagccaagtgggttaccgccagttgggtcaaataaagccggcacgtcctaatcacgcatcgccgataaatcgagaattttctcttaaaatggttagctttcttatccgacgcaccaatccatggaagagatcccgtgtatagggggagatgggccgggaggaaatcggcccatcgacccccgggggaggcaaaatagacttttgtggaggaatttgatttggaaggattggattcgggattggactcgacgatagatcggggattgagatcttgagatggcacgaacactagacaacaagcaaagaaacaaatttcgcaattagggtttttaagagataattttcccgctaggcgccacgacggaacgggcgctacattccctcctcttccatggaggccgatagctaccgagctagaggactccaacaacacaggtgtttgctagctgcggttgcctccagtcttctcccttcttccttcttccctcctcccctcttcacccctgccctcaatctccaatcaagccagcaaccaagccgattgccaaatccacatcccgttgttcgttgaggttccctcc

SEQ ID NO: 25162 - DNA, 1109 bp, Oryza sativa
  unsure (1)..(1109): unsure at all n locations
cgaggnatttgtannacctgatattgatcatcggcctcgccccnacnnnnnnnnnnnnnnnnnnnnnnnnnnnnnnntttttttaaatacaaactaatcccacacatgaacttttaaacagcttttctttacaaactaaccatgacactttgctttaaaatatttaaacagtttgccacgccagcaaaccgggcgtggcaagtaccgggcgtggcaaaactgccacattggcgcccggttgacgatttcaacagcaacgatcgccatggggcagctcttgccatgccatgaccattggtgccgccactctgtttggccacgccactgctattggcatagtcaaaaggtttagttttgaaaatatttttccgggtggtctcttaataaaattatatttttaaaaggtctaacttataaaaaaaatttcgtcatgatgtgaccggaactctaatgatctcgcgtgatatggtgattagcagcagaaggagctgggctcttacagcgatgtcaccctcccgttgctgcacatgacgccgtcccacccgccgccgcaggggtcgccggagttccagctcgacgggtagttcctccattgctgcatcagaccccgcagcgcgtcaactgccccaagaatatttctccaaggattagccgagagccaagcagtttttgcttttcgccggtagtgagtgctgagagatcaactcaccgtccactccattggtctcgcagaaccccgtcggcgttgtcgccgccagcagcaacggcggtgccggcccgcgccggcccgttcttgccattgcgcgctagagcgcgtgaggttggggaagacgaagaactcagggaagaagcggactagagagagagagagagcccacggcttgcgagagcccacgcgacgctgtatatactgggccggcccaccaaccagccgcgggggacgcgcgtgttgggaattttttttatttttaattttttttattaaaagttttacaaaaatagttttccattttgaaaattgacggaagtagtcgcctaccgccctctgggagggcgatttttaaaaatcaccatcccagagggcggcgaaaatgacgtggcagacggcc

SEQ ID NO: 25163 - DNA, 1501 bp, Oryza sativa
cgcgtctttgattgtgtgatgtatgtgtggggtgctggttatgctgattatagcatttggcaacatgtccgtgctattggggcgaagtgcaagctaggagagcctatcatagcaaaccagtcgaacaccagtcgtgtgcaagccagaaaggaaggtggagcaggggtggcgctctcgcagcccctctccacgtcgtccaccacgcgctctccacgccacttgctaggcggcgtcctgaagatggaaagagagaggaagataggtggcaagagaggaggaagaaagtgctgaccattgacatgtgggatgaattttagactaggcgataaacgaagggacctaaagtgaacttaattcatacaaaaagcccatagtgatcacggcacatcataattgggcccatcctgtctccttccttcctctctaccctataccctagttcgacgccgccgtcgcctcggcatagactcccctccccgtctcttcttcgcgagctcgccccgccttctgcgccgagcaccgcctatcttcgccggcgtcctcccgctgcatcagaggtctatctggtggtgagcatccgttctcacgctcctccttcctcatctatctctgcccacgccttatgctttacggtctgcgtctctcgttaggtcgcttgaatcgggaggtttttgttggattggattggattcggagagatggaggatgtggagaacaagctaaaggactatgagattgtgagggaaggcgaggcggagatcatcatcaacaagaaaatagcagcaaatgaagtgttctacaatcccgtgcaggtattgttgtgtatatgttctgtatgcgatttttttgggggttatttgatgctgtatgatggatttgtcggctcctctatcttcttagaatacgtgcatcattagtggttggtttgtttcgaattgatcgaatggtgtgagctgcgagcttcaccaatcgtgcataggtaggactataagtttgggttttggctatttgatttgtatgtgattgggtcgtttcaagtgagtggtctctggtgtagccactagagtactagttgctttgcttttctttacgacttgtttgcattgtgttggtcatttgtgttagcgcatcacgacacgttataatcagtttaaggttgtagacttgcagttgctaggagaatatatgtgaagcttcaaaacagccactcgggcttgtttatgctgcattctcaacaattagtatctctagccataactttttcaagtcactaacagcctgaacttttgctatggaggaattgagtaaagggtggttatgggaatgtgatatcatcggcaaattactatgagtttattcatagttaatatttcctgtatctatcgcttttaaaagttgcagagtaattatatttggcctaaaattatgtctaatctcctatcagctactgtgcttttctgtaattcaattttattgcttgattaggtccacaatagagata

SEQ ID NO: 25164 - DNA, 1501 bp, Oryza sativa
agctgcacttattttgggacggaggtagtactactgatggattcttgcacgagtgagaatctttgatcttgatgaggagcttcttgatcaatgatcatcctctggaattttcagatttgcagttgaaagatgcgcggtttttctttttttttggaggagtttcttttgcgtggcctatagattcgtgcctgcttcaagtctgcatcgtccagttgtaagtacaatgggggtgttgcatcttttcgtgtttggccaaaagagaggaaaagggtaaaggagattcgtgcctactaataacttctgcagttcagcgattctctagaggtgacaagtcacaactcaaaagtgagcggcaacttggccaattctcgcagcagaatagcagtgtaggtgtagcacagtagcacatgctggttttactgaactgaacaatgagcaagaaaaacgtagaaaaaccaaatcattttaagatttaagtggatgatcagcttaaattactgcaacatctgggatccagaagagaataggagatgataaagttcctgtcaggaagtatatcatgcacattaagatttacgatcatgaataaaaacgttgagcacaaacactggatcctaccaccgtattggtgcgtcggaaagcaaagtaaaccacttaaagagaaaattctagatttatgggtgatgtgtgattaggactgcaggattatcttgatccaactggtgataacgcactcgtctgacttttttcccgggatttgctgaggaaaaaccacggttagattccacaattgccgcactaactccattgttcatctctagttttactgaccacactaactctgtcaccgtgtctgttccatgatcggttttagcaagctcatgctttccttgaaagaacaaacaagagcagagaagagaaaagcaaggcatcaactacagctttaattctcactcccacaaaataccaatcattcatcagcttagctagctagctagcacaatcaacattgctgtcaaattcccagcagcatcagttgcatcatcatctttgttaaaaaaaaattgtatcattatcatcttttttttaaaaaataatgaaattgatttacatcccggtctctctaccataagacacataaccaacgagttttgatacctaaaaatcaaaccatataaggtgaagggaaaaaccctcaactccctctaaacaagttcaattgaaaaaacattccaaaatcaaataaattctagcatgtcattcggtatatgctaagtcagccaaagtggaataaaagaaacttggctaccaattccaataaccgaaaattgaccatttttaccatcatttggccccaatttcagatattaagaagataattatatacaatactaattacttaattagtgaccagtgatcacttgtgtgtgtggacagagtggctttaaatacccatcactcctctccccctcacacaccctccctctcaccattgcaaagc

SEQ ID NO: 25165 - DNA, 1501 bp, Oryza sativa
atatatgctgactattttttggtgaaaaatatggtgccataaatatagctactccaaaaaaaaaagcagaaaacacagaaccaaaagccacatatgtattcacagatattttaaaagtggatcaccactctatttctgcaaccattccagcgacaatctttcggatggagtgtttgccgaagatcagaaaaagggaatctaccaggcgttcagtgacgacgacttgatgtaaaagttcacgcaaaggcttcgcttaattacatgaagaacagattagcatgttcttacaagaaagcagctagaagctcgcgcgaacacatccgcttacacaaaaagagcagtctccaaaaaacaacaaaaaaaaaagtcaaaccgagaggtagtgaacgggcacagaggggcttcgtcgtcttcttccatctctcacacacaaaagaaacataataacttgtaaagcagcacaaaacgagatgcaaaagcactgaaccgagcagacctttgcttgcagagggaaagacccgaactagctctcacgagggagagatcaggccgacccttgtacgaaatcagcatttccaaaacacagcaccaacgttctcaagaaaacgacgacatgcatgtaggccgggcgttgagcacatgatatgctttatgcgtagtacatgtgcatgcatgtcaccgaaacgaacacaacggaaggcttcgattcgaagttcgaatggtgagctgcgtgtgctgcggccacgagatttctctcgacatcagccagatctctagcaccaaactagcagcgagcaccgaagtggaaaagaccaaacaaaaagggaaggatcaaaaaacggaccagaaactttatgcaagaaaggaaacgcgacgctccgaccaaacacccacgaactggatgagattggaagccacgctccatacaaaactgcaaatgaaagaatcagagaaacgaacttgcaacgacacaaggaaacaaaaagcatccaaaatccgtgcatacacacacccatacagaggtaaattaaacagatccaaaatccacgggagcacagtagtaaacggcatgcatggagtacacgtagatctgggggtgggaaggagaggaagaggccgggtaatgtgagctcacatcgtagtggaagaggttcactacaccagatcctcacacctttaacggcatatctgtgacggactttagcactcgtcagtgatgagggtcatctttgacggttcttacaggatgccgtcatcagtgaggcatccttctgcaacccgtcacagataactagttacacctctgacggcttccacttctggcccgtgactagttacctgtgacgggttgcatgattataaaccgtcaaaggtgaggttaactcacctcaaacggtccggtcactaggcccgtcacaggtgtgggtggggacttgactaggtcagactaatatgtatatctcctctctccctcacactctctctctctcccttatccaca

SEQ ID NO: 25166 - DNA, 446 bp, Oryza sativa
  unsure (1)..(446): unsure at all n locations
cggtggatgatggatctatnnnnnnnnnnnnnnnnnnnnnnnnnnnnnnnnnnnnnnnnnnnnnnnnnnnnnnnnncaagagcaagatgcaaaccgttcagtccaaaagctggtctccttctaaactctaacaagataaagatttttttttcttcggtactcgttagcacgcttctcaaactgttaaaaagtagtgtgcttcgtacgaaaattttctatatataagttgctataaaaaacaaataaatccatttttcaaacttttaataattacgattcaattaattatgtgctaatgacttgtctcgtttttcgtgcgcgattaatccttgtagggtgatgctaatgactaagccgagaagatgatgctgaccatgtccgtcgtcatggatggtggttgagcgaaactttcggcgaggggagaggaggaggagccagcctcatga

SEQ ID NO: 25167 - DNA, 1501 bp, Oryza sativa
aagaagacgacgaagcccctctgtgcccgttcactacctctcggtttgacttttttttttgttgttttttggagactgctctttttgtgtaagcggatgtgttcgcgcgagcttctagctgctttcttgtaagaacatgctaatctgttcttcatgtaattaagcgaagcctttgcgtgaacttttacatcaagtcgtcgtcactgaacgcctggtagattccctttttctgatcttcggcaaacactccatccgaaagattgtcgctggaatggttgcagaaatagagtggtgatccacttttaaaatatctgtgaatacatatgtggcttttggttctgtgttttctgcttttttttttggagtagctatatttatggcaccatatttttcaccaaaaaatagtcagcatatatttacattgtaagtccctaaattatatatgtaattatagtgtaagtgctatataagtgccgtgtaagtgaataaattacatatgtaattatagtgtaagtgccgtgtaagtgaatgtaagtgggtggtaattagtgtataagtactttaaaattcaatattaatttgttttggcaataaagtgaatggcaataccgtgctcggttggttaggagctctgtctgcgacttcgaaggtctgggttcgactctccgtcacggcgccttatggcgacatatttttagcaaatctattttttttggcattttttttttgaaaattttaattgttgtctttgtcgggatctcgttcttttttattccatgcgaaaaaaaaccagtcgtgttcaacagtaagacatcgagttatagacttgttccgatgattttttttttgtccaataacgtttttcagtccctttctatgtttttgggctttcgaagatgtcgatttctgatttctgagctgtggcccagtttatgtgggcttttgtgggccttagaagaccctatatcatccatccttcatgttctaacctagctataatcttcaactctcactatccattcttccctccccattattcctcaacgcttcgccggcgattcccctctagactctagcgttcgccatggatgcccgccccatgtaagtgtcgtaccccgtagtatagcagcgtagttctacctctatcgtgatttgaatggagaagatcaacctctatcaccttttttttgttgtttgatttctgttggtccttgatttaggtttcgttacttttgggcattcagttttttttggtggttttcgcctacattgatttccacaatcaataggctctgatctgaacgaaacacactgaattttgagtagtttggtgtgttagtgatggctaactgctctgatctaaaattactttgttattatgtgatgttcatctgtcgagttcttcttattttgccctaagatcttctctgtaaaaaaaaaaaatctgcccctcatgtcctatagaaaggctgtttatcttccttttggattatgttacagg

SEQ ID NO: 25168 - DNA, 172 bp, Oryza sativa
aagcaataacactagcgtaacaagttgctttgtttcaaagtatcagtgtgcatcatcagacatgcagggcatggaggcgcctctcacacaataggggctattttaaacatctccccctccctttgggccattttttcccttgtcgatatatgaacaatgccccaggattcca

SEQ ID NO: 25169 - DNA, 373 bp, Oryza sativa
  unsure (1)..(373): unsure at all n locations
gtatggntnnnnattgatagtgctcgtggcnnnnnnnnnnnnnnnnnnnnnnnnnnnnnnnnnnnnnttgaaacctgtttgtccatgattatcggactctgtcaaatcttgtaacggccgtttaccggattttacatgatagaaatttaaattcagttttttttatttggacaaaatagttcttaattcaattttaaaaacaaccatatccttttggtcacttgctcgaactgatcgtcaactccggacggttaccggccggtaaccgctggttttcaagaaccatgtgattgacatcatataaagttataaaccgtctaaaaaattttgataccattcagagagcagccaagaacaagaggttaatggttaa

SEQ ID NO: 25170 - DNA, 1501 bp, Oryza sativa
aacgtacgggtgtacggttttcccgctcccgcacttaaggaccgattccttggaatttcatccgaacataagacaagtacgaccacataggtggaatgggacacccctggctgagtaactagcttatcaggggagccatgatgtcgagagacatgtggattcgccggggtggtgtcggagaggacccccctgggcttcctggcacagtatggtctgggacctaacctgttgttggtctagaacccctctcgtcggcatatggtaagcctgtgtcagctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgtgaaattactgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcaaccgtgtcgtttgagaagcactcacctagatgtttttagaaaagagttcaaataaaatcaattacgaaaacaacagcctttccttgaagcctgcattaaacacttatttcccctggcttgctgagtactcccgtactcacccttgctctatataaatattccccccagttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagagatggtattagagcacaggcttggccctagggcgaaacccgacgcttaggacgaccctaaggatactatgttcaaaaactacttgcgaaaagctaaggtgtcttttgttttctttatttttttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactg

SEQ ID NO: 25171 - DNA, 776 bp, Oryza sativa
  unsure (1)..(776): unsure at all n locations
acaaagcttaagctaagaaatatattcctatccgtctagattcgtagtattagaatgtatttcatctatcttaaacccttttatattttgagacgatggaagtatggaccanatttctctctctttctttttttctcccctttcgttgcaacagtgctcgagacttatgacgaagaaattgctgctcagggtaaatttttgttgctgatgcacaggaggaatgtacgggatggtgcatatagctagcatacatatagtacataaatgaatcaaagcagttttttttcccccacttgagagaaagctctagtgttgctgagtacataaaaatgttgacaagttgacacggtagtcgctttcgacataccttgcgacctaaccatgtttgacttcattttccccttgacctttatatatcagtcagtactgtatcatgttgatctctcatgagagggattcatttacgaaggaactgatgttctcaactctccaaacaggaccaggactatacatgactatacataggatgtgcttgttggagtttttggcttatgcagcaaggttgtcctaaaagtcaaactctacattgaacatcactggaatatcccctgtaagcttttaccctttctgcttatttagttatccgttctgctagttatggaaatggtttgccataaatacctaatgatcatgatacttactactatatttgtcttaaagggtgtgtttagttcacactaaaattggaagtttgattgaaattggaacgatatgac

SEQ ID NO: 25172 - DNA, 1501 bp, Oryza sativa
aacattactttcaggattgaggcagtagtaaatgtgcttcctgattggcttccacaacatgttcacaaagagagacaatcggggagattacgctgtaatgaggcatggaactggtaagaggaaataatggtatgttaaaatcagtatcaagattttcattgtggatgcatctatacatgatgcgatataattccaactatacaaaagagtcaaatttctctaactacaatgtttagcacaaatgctactcaaattagtgatatttcttgagaaacttaatttttgcatgaacagtatgctttggaatctgtaatattaataatttaaattttatgggaattcatatgaatgtgtctcaaacaaatttaaatttattacagtcgacatctataaaatttacaccaaagttacagcataattatggtgtaattaccatataatcttactcaaagtaatcagtaaagtataaactagtactagaggcagcatacagatatgcagcagtacaggcacaagttctctccatttgttcaataggaaaagtgagggccgtgatgcaagatgaaaaaattcaattgactgtttggttgcagagttgcagttgcacactgctacacgcaagagctcttcaggagaaaactactattataactactactcagtgttgacgattagaaaatagactgattgactagaaaatatgtcgatacgattatagcaaaactgcttattattagatcaagtggaaaattaaataaacacaattaaaagattttccctataaaagaactaagcaaagaaaaacttgactgccgacaaaatgaaaaaaaaataatttttttaggttattagtaagagaggaatggatcagtaccttaagtggtggaatgtcagaggtttgaagaagctagccaagagaagatcccctgccaaagatcgagaggatcctagcacagcacaaacaatcggaccaggaggagctgagtatcttaacactttgataatcttggtcgcctggatgatctggaaggaatgggaatccgaatggaacaatcacgtcttcaaccagcagttaagaacctgggcagaagttctcaagtttccgaggaggttaaactctggtgtttagcttttcaggtcatccttccggtgtgtaatcctggttgttttcttctaagccttctcttttcctggaagttgtcagctcgtggaggctgacactccctccctcttgtatgcgcttgcatttttctacttcttccttgatacaatgatacgcaagcattttgcctattacaaaaacaaagaggaggagctgagtaattactactgctttggaattggatggaaattcacaggaaggctaaacaactccaaagcagataccctgtcaacctcaattcttgactaaaatatttcacaggaaggatggaaattctggtatgttcacatggaacataccttagtagcagtatgatgttctctcccagatgtgttgcag

SEQ ID NO: 25173 - DNA, 1501 bp, Oryza sativa
tggtacttctaacagagacaaaatggcctactcctaatggttcttacattgtacagagctcatgaaacacatctgacatttaattcactaaagacgatgattcattggtgttgctgtatgatgcttgtgctgtcatactttggctctcacttgggttttgccaaggctgaggtctgacaaaaatggttgcagtggtgtatgcccctcaagcaggctcactactttggacatctttggtctcggtgctggtgctgcattggttcagaagagggcaacattcatcatgaggtgcacaagtctggatctaccagctctaggagatttccttactcatgtacaacacaagcctgcaacacatctgggagagaacatcatactgctactaaggtatgttccatgtgaacataccagaatttccatccttcctgtgaaatattttagtcaagaattgaggttgacagggtatctgctttggagttgtttagccttcctgtgaatttccatccaattccaaagcagtagtaattactcagctcctcctctttgtttttgtaataggcaaaatgcttgcgtatcattgtatcaaggaagaagtagaaaaatgcaagcgcatacaagagggagggagtgtcagcctccacgagctgacaacttccaggaaaagagaaggcttagaagaaaacaaccaggattacacaccggaaggatgacctgaaaagctaaacaccagagtttaacctcctcggaaacttgagaacttctgcccaggttcttaactgctggttgaagacgtgattgttccattcggattcccattccttccagatcatccaggcgaccaagattatcaaagtgttaagatactcagctcctcctggtccgattgtttgtgctgtgctaggatcctctcgatctttggcaggggatcttctcttggctagcttcttcaaacctctgacattccaccacttaaggtactgatccattcctctcttactaataacctaaaaaaattatttttttttcattttgtcggcagtcaagtttttctttgcttagttcttttatagggaaaatcttttaattgtgtttatttaattttccacttgatctaataataagcagttttgctataatcgtatcgacatattttctagtcaatcagtctattttctaatcgtcaacactgagtagtagttataatagtagttttctcctgaagagctcttgcgtgtagcagtgtgcaactgcaactctgcaaccaaacagtcaattgaattttttcatcttgcatcacggccctcacttttcctattgaacaaatggagagaacttgtgcctgtactgctgcatatctgtatgctgcctctagtactagtttatactttactgattactttgagtaagattatatggtaattacaccataattatgctgtaactttggtgtaaattttatagatgtcgactgtaataaatttaaatttgtttgagacacatt

SEQ ID NO: 25174 - DNA, 1501 bp, Oryza sativa
ctagtttaagtatgtttgttaaatgaagtgatatataacgatataatctgtgtattgacaaatttattcgtggtttttttcatgactgtacgttgtatgacatggaaagggtgagagtatagctcaagattacatataatgctttaattcaaactgtactaaatatggatcttcaatttatagttcaattgtaatgaattatgatgatttatctctgtttagccattcgcattgctataagcttcccattctaggaatctcttcatgtttcttccttttctacatcatgtgcataagtagttattacatgtaaatatgcaatcgcaaacctcaaggagaatagaggtttgtcggagggtgttttccttttctactgatctgaattcggtccagaagaattcttgaggtttgcgattgcatatttactgcaaatatgaagattttgttgacattgttcgtttggaaattttccgaaaagctaattataggttcttctctccatcgaaacaatagggccgttatgcttattactaaacttgttgaagagatgaaatagaaccaaggtctatctttttatcagaggttaaatcaatcatcagaagaaaaattaggccaaaaattaggatacattctgggaaaatgatgatttgcagtaaaatgcaatcgcaaacctcaaggattcttctggactgaattcagaagtagttattacatgtacaagcacattgcagaaggaagatgttatcaaacaataactatcagagtttcaagctcttacaacctcaccttcaagccatggttctcactgaagatggttttaacataaaaaaataaaacttagaactcttattatatatcttgctgcctctgtttgatttacatgttcctatgtgtggctgtatgcattatataataactgtataaataaatttcatttggcagcatacatttcaattttcgttgagctaagaattattgtagcaatgctcggggtatcttctagtttaattatttaatgttatcttcaatattagactatggccattgatttctcatacaattgaactatatgcttgcaagaatataaatagttgccatgcagcttttgtaaaggtgcaatgctgggaacatgatgctaaacttgttgtcggagggtgttttcgttttcacggaagcacctgagatatgacaaaaagaaaagtggaaatatttttaggttaaggggtgtgaagtgtactctctttttttttaacgttttagatttcaggaataagttaagccttgtacctgaacagagaagacatgcattgtgtgcccacatttctctggtgcttttgtgagaatgataacacttcctgcatcaagtttagcatcatctttgttaatttgttcctttagaaaaagctagctaagctgctcattagcaacttctttgatcagttattccaagcattctgcagggcgaagcaaagttaaagaatgtatatatctcctcctcctg

SEQ ID NO: 25175 - DNA, 162 bp, Oryza sativa
  unsure (1)..(162): unsure at all n locations
ttttgattgcatgcatctactcgatggnacagnagttcatcaatggtgcaccatctcaagccacattagagaagtctatgacaattaactcattcctcaacttgcaaaagcgggtttcatcaagaggcttggtaaagatgtcagctagttgatccttggttg

SEQ ID NO: 25176 - DNA, 1501 bp, Oryza sativa
actatctaaaggagaaaataaactagaaacaaaaaattagaaaacttattttctagattttcatcagctagctacttggctgttttaccagattgttggttatgagtgagggaactccaactcgaataattatatgcttggtttatcaagcttgatttttttttctaaattagaactagcatagattaatcttgttggcacgctttttaaattgttaaatgcgttttttttaagtaagaggttgtagggttgagagtgtcctacctcgttttaggtgtgtctgaaaaagctaagccatcgtagtcaaactccatacaccattcttagaccaggttttaaatactgtattttagaccataaactcaatatataatgatgagctaaaaaagagtttgggcatgtcagtagaggacccaagcacaagctctgtttggcgtgcaagttggcaccagtcctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactct

SEQ ID NO: 25177 - DNA, 937 bp, Oryza sativa
  unsure (1)..(937): unsure at all n locations
atgtgnattttgatcgcttgctatgcagtatttcatcacttagacatgaagagctatctgaactggtcatgtttgctgtctgaccaccatctttggtaaagcagctgtctggcttgttcaccacaggaggttcactattgcaagcagcttgattattttcactgctttcacatggctgatctgttatcgatttgcaagcttcttcagatctatcagaggaagcttcagctagttcttcatgctccgagccaagtatttggctacaattgacaatatcctttgaacaccccacttgattggatcgatcaacaccgctaactgtttcagaagaaccattcgaactccctaagctagctttctttctagcatccattggctcccatacttgttttggagctgcattcttgtttggcgtactaccaactcggcttccttttgacactatgaagctatccaatggatagcacctgcggtactgtaaccagggcttctcaaccattgttttcctggacatcttcatctctctacttgatctagctgttggagaaaaatacccataatcttcctgctggccacaactgcaggcattgtactcatacctttctcttgtccggttattcgcactgaacaaagagttgcagcctctacctgcattccttgccctctccctagattgccagtgaatatttccaacacccccagtgtcatcttggcaatcttcataccaaaaaccagtggtctgttcttgaagggaatcccttctaaatctgagtttcctccttgaggatgtagattgttcacacatgaaagaaccattgcaatctgatggaataaattccagtgttgtactgcaatgaaactcattgctttgtccatcactttcccttgttagagattgatcaacacaggtatcaggagagaacgattccaaccaagg

SEQ ID NO: 25178 - DNA, 498 bp, Oryza sativa
tgatctagataagattcctaatgcaagcagcaaatttttggtgccaaatccatttggcgctaaagcatgtaatttgggctgctaatgcatgtaattaagcatgctaataatatggttaattctctcaaacttccttttaatcatttgtatatatggaatgtgtgcatgcaatgggttcattaaataaggccattgtgatcattttccaatcctactgttttatcctaaattagctataaatgtaatttttatgggacggaggaagtatataaaacgttggcaatggcttgaccgttcgaaaaaacagctttagcaagcctcacggagacccttgacaaggtcatcatgagcagtttagcacccgtcttcttcatcacaagctgggctctccattgtctccaagaactggagcagctacctgaactggggctgggatatcctccctgattaggcgaaaatgaaatgtcagttcactgaaaagtgaaaactgggagagaa

SEQ ID NO: 25179 - DNA, 1501 bp, Oryza sativa
  unsure (1)..(1501): unsure at all n locations
ttcttaaagatcctcctgttgcgttcaagccaaatgttccaccaagttattagaagagctcccagtttttccttcctagtatactctttggcattgatttgataatgatcagctcctaccactctctgatgtcgattgccagccagatgttgttttggaaaaatctgtcattccttgccagttacagataagcggccacacctctcattggtgaagcggcattcctttgtttccagattgttagcatcttcgaaagtgctaacgacaacagatccactcacagggccaatgtcttctaagcagattttttggcttgcatactactcctacttacctgccaattttccaagctgcttcctgcattaacaatgatcttttgtagagccatttatattctgctaaggcagataggtgatagattggtgttgctgataacgtcgatttcgccaaaacacttctctgcagggctgctggctctctaggtcgatctgattgcagggtcgtatatctcagttttctccatgtttgggaatccatcactttaacatttttttcccaatctcttaacatttcgtttgggagtccatattgggcaagaatttagacaaaattggtcctcccaaatgggccctaacttacgcatgttatgagaaagaagagacaaaggcaatcaacaggcatatcaggctaagctagattgtgatggattacggcccataataattgtcttttaagttctagcccactattctcctggtccagtctttaacttttgctgttctagtgtaagatatttagtacgtggaatactcgtttcagaggcataatttctgtagagaattacaggaaatgcagagcaatttgaaaggtaggaaataaagtagatttcgttctgaattcgtattctaaagaacgttctgacgtaaatcataattttggtccagtgtgacattaggtctgtctcttgttttatttacaaggaggcgaggcctgttcgtaaattaatgtatcaaatttacataaactactgacattatctaaaaacataaattctgattgtaaaagaataaatatttataaataataatttgctgcaaaagctnnnnnnnnnnnnnnnnnnnnnnnnnncgtttagtaagcgggaggtcttgagttcgactctcaacgaaagcacattacttttctggttttaatttttgttgctttttaatccaaattcatttagactaggagaatacattacattctttctgtttgattccgtctggtatatagattttttaaacaactgaaagatgaacaagtaagagtggttcacaagctttgcaaacaaagaataactcaaccagatgaaatgccacagaataatatcgcagttcccttttgttttcagagtctagatgtattttccctatttctaaatgacacagttaatgtatgacaaggccaaacattaacaagaagcagggagtatatatgaactattccttgtgtatatatc

SEQ ID NO: 25180 - DNA, 591 bp, Oryza sativa
  unsure (1)..(591): unsure at all n locations
agtgcctggaaatcgactgcacgtnnnnnnnnnnnnnnnnnnnnnnnnnnnnnnnnnttgtttgttttgtttgtgtctcgacgagatgtataaatttggttggtacaatattacaaatattaatatatatatatatatatatatatatatatatatatatatatatatatatatatatatatatatattatgaaacgtacattgtacgtgcatgtttatactagtataatatataaaacagagggagtactacatattttccctatcatgggtaaacagtacagtgaactcggcccatttaggcccacccacctgtatttggatcgagacccaaaccagcccacgaaaatttgggccgcaaaatacgggggggccggcctatacacttttgtgatagggaacatgcagctttcacttcaactgggttagctgcgacggccagggcacgtcaaaattaggcagtgtggggagcggatcgcacgcgccacggggagccggacgaaaacgagaagctcacagccaccggcgcgcgccaccagcatatactctctctctctctctctctctcgtcgacgcgccgatgcgccgaga

SEQ ID NO: 25181 - DNA, 267 bp, Oryza sativa
aagcctgttatctctaaatgattttggcgaccaagaagccctctgctactaaattgtactcaacattctacatcatgcacacattctaggaataaatcgtggcacagaaagtaatttcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaa

SEQ ID NO: 25182 - DNA, 1501 bp, Oryza sativa
tagagtaaaaacagttgggtgtggtggtggtgttcagatggggggtgttggcaccctctagcaatcccctagctgcgcgactgcgtgtctgcgtccaccatccacgggcatcacgtaggcgcaccatatgtataacttgttgcatatatatgcatgcaatatgcacattctcgacgtttcgaaacgttgggttaaattttataactttgactattaattattttttaaaaaataataaagcaacatatattgatttatcttacaaaggactataacaaagtaaaattaattatttactatatacactataataaaaatatattttaaagattatgttatattggaaacatcaataattatgaaccggatgaagtaaattccgtgaacctcctcagcttctcttgacgccgcatcctcacattctcacctccctctcgagtctggaccatgccccagctttaatttgctggcggctcacctctttttggtgtagatccatgcatgaccaccaaatcattctgttcttgatacctcctcccttccgaatgtgtccatcgtatccgtgacaaattcatccccccaatccaaaatcctaccaaacgtcgaagctgtcatggcttcctgaatgatttttggtcaccatactagtagcacacgaccatgcattatcagctcattactgtcggttcggcttgaaccaatggcgattggctgtgtttggaactccaaattcccgacacctccctctcattttccacgtgcacgtttttcaaattgttaaacggtgtattttttataaaaagtttctatataaaagttgcttaaaaaatcaaattaatttatttttttaaaaaaaatagcaaatacttaattaatcatacgctaatggaccgctctgttttccgtgcgggaagattgggttcccaatcctaaaatctgaacacagtgtgtatataactatataccactgacggttatcgccacaaatcggcattgcttcgaactgtttggatgcctgacgtaaaagatagcggtccgggttttgaattggttggctggtcaattggactgcccaagggtttaacaactatccaaggtcccttctttttccccgcaaaccacaattagagaaacggatttgctaaataatggaaaatactataggacgatatcgtgttaaataatgagaaatgtccaaacgtgctaccgttctgtatcatttcccggatgtatggattgaacccacgatctcaagtgtgcatgcttgggtccctcaccaaccaagcaatgacacgattccaatcagttttatgccagttacattgtaactataattataccataattacatgtaaaagtttttcatccaaaaaatggtcaaaagttatatagctaatcccttagagaaatgaccccactaagggcctctttgaatcgcaggattgagaaaacgtaggaataggaaaaacgtaggattttgataggaatgtaaatgtaaagc

SEQ ID NO: 25183 - DNA, 859 bp, Oryza sativa
  unsure (1)..(859): unsure at all n locations
atgttttnattgttnaacnnnnnnnnnnnnnnnnnnnnnnnnnnnnnnnnnnnnnnnnnnnnnnnnnnnnnnnnnnnnnntgaattatccatactttgcttttctactgttgcatcttctgctcctaatccaatatgatctgttatatttgcaattaaagtaattgtgatcaaattatatataggttccagtcaaactgtataacaatcaagttgaagtttaaaattattcttattctgtttcaaattgacatgggcataaagaagcaagttatatgtggaggaatgtaggcagttggcatggccgcacatgcacgtatgatggaactgagagtgagttggtacgatggcaccacctctccacattatcattaatgtttcctattgtttgttttgtttgtgtctcgacgagatgtataaatttggttggtacaatattacaaatattaatatatatatatatatattatgaaacgtacattgtacgtgcatgtttatactagtataatatataaaacagagggagtactacatattttccctatcatgggtaaacagtacagtgaactcggcccatttaggcccacccacctgtatttggatcgagacccaaaccagcccacgaaaatttgggccgcaaaatacgggtgggccggcctatacacttttgtgatagtgaacatgcagctttcacttcaactggtttagctgcgacggccagggcacgttaaaataaggcctagtggggatcggatcgcacgccccacggggagccggacgaaaacgagaaaattacaggcaccgacgagcgccaccagattatactgtctctctctatctctgtctaaaacacgcgccga

SEQ ID NO: 25184 - DNA, 1501 bp, Oryza sativa
tcctaaaatctgaacacagtgtgtatataactatataccactgacggttatcgccacaaatcggcattgcttcgaactgtttggatgcctgacgtaaaagatagcggtccgggttttgaattggttggctggtcaattggactgcccaagggtttaacaactatccaaggtcccttctttttccccgcaaaccacaattagagaaacggatttgctaaataatggaaaatactataggacgatatcgtgttaaataatgagaaatgtccaaacgtgctaccgttctgtatcatttcccggatgtatggattgaacccacgatctcaagtgtgcatgcttgggtccctcaccaaccaagcaatgacacgattccaatcagttttatgccagttacattgtaactataattataccataattacatgtaaaagtttttcatccaaaaaatggtcaaaagttatatagctaatcccttagagaaatgaccccactaagggcctctttgaatcgcaggattgagaaaacgtaggaataggaaaaacgtaggattttgataggaatgtaaatgtaaagcagaggattgtaaaacgcagaaaaaatatagaaatgaccgtttaattgagccgcatgaaaaacgcaggaattggatgagagagatagactcaaagaaaagttaccaagaggttgaagctcttgctaaattttctccaaaatctctataggattgtccattccataggaattttaaaggattgtgaaggattcaatcctttatttcaaagggctttataggaaaatttcctataggattaaaatcctctaaaattactatatttttcctccaattcaaagggtcctaaaatacaaacagtaattgatcccatggattaaatttctagttcaaccactggagttctaaaaagaaaagttcaactactggtgacctagtgcacgaatcttgatgtcgatcaaacggccaaaattcgcaagatttagggctgatttggtttgaggccctaccaaaatgttggtagtgccatagagtagatttattactatttagccaatccaaatactatcatgaagctactaaaatattggcatggcacaaattagcactaatccaaacatgcccttattgaaccaaatcagccaattaatactcctcaatcaccaatttaccacccaaatacccggatccaattcttgactcgacgcacgagttacacacttaactacacgagacgacgaaactcgagtaattaagcccagccagggtcatatcgttacctcgccgccgcaccggtgagtgtgtcagtcaacgccacgaacccaactccactcatcctctcatcccgcctctataaatcctacccgtacgtgctaccaactgctcgctcgatcgatcgcccacacgcgctccgcacgtcgacgcgcaaaacccctcctcccctcccctcgccggcgatggagccggccgccgccgccgccgccgggcagc

SEQ ID NO: 25185 - DNA, 995 bp, Oryza sativa
taaatctcattcctcacatcatttctacaacatctcaacataaatatatccatcatttgtacaacatttgatatatatgcatatatatatttcgcagcaaagcctccactggtggagaaaccatctttcgtcggtcggccgaattccataatagtcccggatgcaataaaaaccggggctaaagatgatctttagtcccggttaaaaagggtaacgggcatatttgatctttagtcccggttggtaacaccaaccgggactaaagatcatctttagtcccgggtcaaatgctgtcagggcctgtcaggccccccgggatctttagtcccggttggtaacaccaaccgggactaaagatcgtaactttagtcccggttggtaataccaaccgggactaaagtcccacccctatatatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaacttcatcctccaatgttttttttggtcatattacatttgcagctatgttttgcacacttttttgtctccaaaatttagttgtaagttgatgagggagaaaatttgtgtggggaagaaagaatatatagaaacttagttgatttgctaaagaaggttttataaaatagttgagaaggaaaactatagtgaaagttagtcttgaatactagaaaacaaactaaactgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttgtatgattttttttcgactcatgtaga

SEQ ID NO: 25186 - DNA, 938 bp, Oryza sativa
gaggggggcgccacccgccctcccccaccactttagcaccgtcccaccacgtcggcaggaggacggcgctagagtggctggcgctgtccagttggatcacggcgccagccattctgacgccaaaaaggaccattttaagtttttttaggtctatttacgaaataagttttttaaaaggactaaattatgaaaaatccaggcacgcctgcactgtgtctccgtgcaaggcagcgcgcgcggcagaaagcgggcgaaacccgcggaaatattcgcggctcggcttcgcgctgcgctgctgggcgtctgggcggggcacggcgaaatgttgcatacgccgcgcgcgcgcgcgcgagccgcgagacaaggcgcgagcggcgggcgaccgaatgcccccactgcccacactttccttgcttacggcaggcgaaccttgtgcgcgcgcacgcacgcacagctgcacaccgacacttgttgctgctggcccctctccacggctccacccgccagcctgtgccgccgctgcacgctgcccccaccaaccacggactctgcgtcgtcttctcctctccttcctcgtctcgcggtctcgcctcggcctcgcatccactattccacttcgacaacccttctcactctctctctcttcacttataagcaagctcacacacacctcactctctctctctctctctctctctctctcttccgttggagtaaaaaaggaggggaaagtgagaaaaagaggagaaaagctcacaccacccacctcctccattactagtttacttctcttctcctcctttctcccccattcccccaattcattccttcgccgaaccaccagagtggtggagagtagctagcagagtagcagagcggtgggagcagcagcagccgtagccgcatccggagagattcgggcaggagaagccgccgca

SEQ ID NO: 25187 - DNA, 1501 bp, Oryza sativa
aatgcagaagctctgaacacataatttgtgctgttaattttatatttgaaacgaattcacatgaattgctggtttctgtctattagagcatgtgttgggcgacgcatttgcggggacgtgaagtgtgatgttacatatgtagtggtgtatgatatatatgtgtctgccttgtgataaaaaaaagaaatgcccatgaatatatgaagctgcatgtacatatatatacatcctactagaaagaaaaaaaaataccatagtcttttctttgatatatatgaaagcatttacttgtgtttcttgttaatattgttccctcgctacatttacttgtgtttcttgttcaagctaggagaaaaccaagccatcagtgcacgcataagtaatatatcgatcaggcagagtcaggaacatatatgcatatcttcttcgcttaattgcatcgagacaaacattgtcatacttcttgggctgttgtagtagcaagaacagtgctgtcgatcaccaggatagctgcagcttcgcatggctgctttaagcaaaaacaaaaggtgcttttacctggcgtgtttggagatttggcgctagcaaaaaatgctcatgttcttcttacatgcatatatcttggtcaatttgtgtctgccatagtcttaaaaaaagtttatatttttcagtgcacgcaatcaattaattaagcaggcattttctaatgcaaaataaaggtttgtgcttttttttcttcaacaggagggctcggctaattaggaaattaaaaccgtcgatccctgtttttataagatgccacataggttaaaccgatcacatgacaataaaatatatgaagagataaaggttacaatgggttttataccggtatacacacttacctatgtcttggacaaaattaaaactcacaatttagcaacactatagctagtatatgaaacccaatgctctagagcgtacattgtttaattcatcaactcaaacctctctagacaacgcggcactctttaaaactgtggaattaaactccccataaaaaatgaccttatgttcaactcaccccgaaattattaataggcttatttcgaaatgagagtattacactttgaattcccaaagccattaaaattttcatgctatgcaaaagctttataataagccaaaagaaatttcagaaaaaaaacatttatttcgcaagctgtgtcattgtcatcatgcactagcttgcaccatatgagagacctaccaacaatcttggccgtaagtaaccgggctctgatcacgagaagacagcgtctccagtggcgtcactccatctccagtgagtcatcagcagccaggggcaaatcgggaaacacacgtgcagccaggggcattttcggaaacccccgagcattttaaggcagcaaagagagcattgcatgcatagtgtgagcagcagcttcatcacaccgagctcgcaaaaaacacaatcaatcgatccccaattcgatcccca

SEQ ID NO: 25188 - DNA, 1501 bp, Oryza sativa
  unsure (1)..(1501): unsure at all n locations
gctcttagattttaatttttaaaactttaattttagagtactttgaatgtagttttttaagcgttaaggatatgcatataaaagttttaccagtaaatgattatttttattattaataaattcttttggtttataattagctctcttaaacaaccgacgatggagctacgattatagaactcgatcagatacacaaattcgggaatcgttcattagtatatcacactggcggtacggtagtgttgactacatgcaacctcgtgcaacacacaccacgtattatattagtatattacctagactatagtttgaaacgaagtgtgatgaagctaggttgacttctcgctgttgatgttctgcccccggccacctgatgattaatttgatattagtagttaattaagaataatatcacctcacatgcagagctaggtgattattgatgtataggccacatggggtcaccgttcccagagatgcgcgcatgcaattagaagcaacatcaccggagtcagcagtgagatcgagcaaactagctagcaaattactcccttcatccctaaatatttgacgcagttgacttttctaaacatgtttaaccgtttgtcttattcaaaaaatttaagtaattattttttttatcatttgattaattgttaaatatatttttatatatacatatagttntacatatttcacaaaagtgtttttaaataagaataacggttaaacagcgttaaattttcgggacaaagggagtagctgaaatcgcgtgcgcgcatgtgaaccaggatatgtgcaggattcatttttattttcagactcttttgaagcgcagggattctaaaactatagaaataagaaaacaaatgggaaaacaaaggtttgaatcatataattacttaaaatgtgtttcgatggcacagaaaaagatataaatattgaaattatatgttatttcgagttgagtagtaagagaaaagagaggtgtggctttggaattatcatagaaaaacanataacacgaagtacgtacgagctcatgtntaaaatccttaatttggattggagcatangaatgaatccaacgggattttaatttgcaagcccaaatcttaccaaccaaaacaacctcttcataaagaaaaaaaagcctaaaaattaattaaaatccttcaattttcctttgaaaatgctttaatacaaataagtctttattgggttcagggatagacagccacatgtaagtgataaaatcacctgcctttgccttccaagtagacgacgaaagaacctacgcatgcgcgccacccagccactcactcagctcgcgcgctggagtacaattactaaacaaaaactcaaaaagcgagggcggcgtgagctacaagtatacaaggtgggggcatcttcttcctcccgctcgcttgtcttctcctccacgcgcgcgcacgccgtcgggctcgtgaccgatcgatcgatcgagagagaggtcgctcga

SEQ ID NO: 25189 - DNA, 1501 bp, Oryza sativa
agatcaacaccaatgacatgtacaagttgaagaagaaggagatggaggaaacctcaccttccaagaagtgcattgctcgccaagccgaagttgaagacaagggcaatggcaaggtgaatgaagccaatgagaacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgctttaaagtgcccttccaaggatgatgatggagacaagtcatccaagaagaagagtggaggctacaagctcatgaaaaagctcaagaagtaaggcaagaagattgaggccttcatcggggaatgggactcaaatgaggagagctccgcctcatccgggtccgaggaagaagatggtgatgatacaagctccaagaagaagaagatggccgttgttgccatcaaggaggctccatcactcttcgctccactttgtctcatggcaaagggctcttctaaggtaacatctcttagtgatagtgagagtgatgatgattgtgatgatgtttcctatgatgagcttgtgagtatgtttgaggagctctatgcttatagtgagaaggagattgtcaagttcaaggccctaaagaaggatcatgcttctttggaggtcttgtatgaggagctaaagacttctcatgagagactcaccatttctcatgagaagcttaaggaagctcaagacaacctcatttccactactcaacatggagctctcattgatgttggcatatcttgtgatttgcttggtgatagtgctacttgccatattgctcatgttgcatcatctagcatttctacctcttgtgatgatcttgtggatatgtctagctctagctctacctcttgtgtttctatttgtgatgcctcacttgttgttgagaacaatgagcttaaagagcaagtggctaagctcaacaagagcttggagaggtgcttcaaggataagaacactcttgacaagattttgagtgagcaacggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgtccttgtggtaaacctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgtttgatagtggatgcactcaacaca

SEQ ID NO: 25190 - DNA, 798 bp, Oryza sativa
tcttcccgtgccacgtccgagtcaccgcatgataccatggaaatgaaaacctgtctaaatcatttgctccttccttaaccacctctcctactcgtggatttctttttgttcctttctttctcctctcctctcttcgtaccccctgtcacgtagttcttgtttactctttccattaggtgtcacaggtttcttctcctcttatccttcctttccatcggttcttgtacttggtggtatacccctagctgctcgcctttgtgttaatttggttggattgggagtttcttgttctctctttagccttgagcgatcttggtttcttgcaattagcctttgactgcttcttcttcttccacttgccgccggcagctagaagtggtccatcgtaccaaccctttcgtcctcattgaaccattccgcctcgctcccagctccattactagaagcactagagctagcgtgaatgcgtgatccttgatgcgtagttagcagctagctcctgcccccaatctgccatctccgcattgcgattttgagtttttgagattgtaatttgcgaacgatctcggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcggcaa

SEQ ID NO: 25191 - DNA, 786 bp, Oryza sativa
caaataactatttgccacccctatctcaatgacatgtgggtccacatgtgtctatggtatgtgggtccagtggtaaaaagttaattgccatatttaaatgtggcaaatggttaaatatctcgtttgttggcacgttgtcaagttagagaacaaaacgaggagctgcacaatacaacagtgttggcattgcatcgaatatacttcactggtactgtacaaaaatttgttttttccccaagtgacaaaccctaaccctcataatcgggtgacattaacagaagcaagcatataaattagaatcatatcttccaaattcagtaccttttcttgcaaagaaaatcaaatcggttgcaaacaagaagagagggcatgcatgcatgcatgaagaacagaatctggaggccggccttgcctgatgactgtaaatcagggttttaaatctcccgctatagctgtttgagaagggttctagctatttgctctcatatacaatttagccgctatagctccatttagcccgctatagctgccgctatagctgtttgagaagctaaccgctaaatactttagcccgctatttaaaacattgctgtaaatcgatagtggtcgaaaccacgtggagcagccgagagaggagtagaacaggatcgccggggtacgcagccgcccgccggcgaggctagcgcacggcgtcggaaatatcgctccggcgaagcagggcgtcggaatcgggacggccgcggccgggaaggggatgatggatcgggagcgagcggtgaaccacca

SEQ ID NO: 25192 - DNA, 789 bp, Oryza sativa
cgcggcggcggcggaggcggaggacgcgtacccgccgcagggtggtggtggtggtggtgggtgggtgtcgaggctggtggacccggcgtcccgcctcatcgccggtggcgcggcgcggctgttctcgacggtgttccgcaagcgcctcgaccctgcgccggctccggccccgccgaagtccacgcctcccggtgagcctgtggttcctgtacgctcccatctgggaagactcgtgcttgctcccgcggttcgtgctcgttagctttgcgctagggtttcaatcatccagggcgttctagggtttagctcagattagctggttcctacttctagtctgattgattttagctataaaattgctatcctccttgatatggagcagtagactcgtgatgaaaatgacgctgttctacaatggaagtttagtgtggagtttcatcacctcctatttgtgtgttttaactttaaatcataccagagtgtcccattctcttatttaaaaccatagcagtgtactatttgcttgtctgtcccaaagactagaaggatttgatgctccaaggtaaaaacatcaagtgtagtatgatgaatgtatttatgccacttaaaacaatcttaattcagtgtaatatccggtctttttatttttatttaaaaccatatggaaagaatacagtatgatatggtcttattttgtctgcctgtagtattacctattgataattttgtgcttggtgctgcagtacgttactaattttatagtcgcttcatgcatgcaggaagcaataa

SEQ ID NO: 25193 - DNA, 1501 bp, Oryza sativa
aaatttttataaccgggactaaagatcatctttaatcccggttggtgttaccaaccgggactaaagatcaaaatttttataaccgggactaaaaacaatctttagtcccggttctttttggatccgggactattgtggattttgccggaccgaccaaagatggtttctccaccagtgctacgaatcaaactcgagtatacttacttctatggccatatatgtgtattatatatagtcgtttggatttaactgcttgtgtataccatattcttcattaacacatatacatacctatatataaatcctactccctctgtcccaaaatataacggattttgaacggatagaatattttctagtataacaaatctgaacagagttatctagatttatagtactagtaagtgtcccacaagtccaaaatcccttttatattttgggacaaagggaggagtatataagtagccccatagttatgatttggtgcagtcacgtcatctgtattatttcagccattagatgaggggagagtaggtgtcatatgaaccgttcgattaaatctgagtattggatacttgtataattgttgccccaactttacttttcatatataaggatactctcatttaaaatgataccacaaatcactgctccactactctaaatattctctccatttaagctactccctccgtttcacaatgtaagtcattctagcatttcacatttatattgatgttaataaatctatatagatatatatgtctagattcattaacatcaatatgaatatgggaaatgcttgaatgacttacattgtgaaacggagggagtagaaattaaccaagaggtcaccaatgccataaatcctaaacgaccgttaccactgtcattttatctccatttgcagtttcacatgcatgggcttaatcaagaattaagaacatatctttatatataagatagctttgtttacctaagaattctgtactacctgcttaatgctgaatataccactgatggaatcaaccaaggatgggtgccaattaaaaataggttagtatgctcatatttcatcattttgcatttttgtgtgatcttcacatctttttccataattacactataatttactctatttttttacttgcatcacatttctaatcccttctcttttgtccaaacgagtttgcatgaaaatgtccctctaggacaggagcggatccatcatgggagcggcgggtgtttgaaccttcaatactggcgtgaggaccatgggagtccctttaaagcatctacaattttttttgccatatgtagatgggagagggggttatagctttgttctagtatattcatacccctactatttttttcatggatccgccactgctctaggatgtcacttacactatgatatgcgtggctcaatgttttctccaagggatatatgtttgggatcgtcggtacgagagtatatgcgagattgaggtaaaagaga

SEQ ID NO: 25194 - DNA, 654 bp, Oryza sativa
aaccgctcgctcctaccgaatttggtgctagcctcgtggagcatggcaccaggacaaaaaggtccttaattttggactcgtttgcgacaacaacgagtggctcatgcttgatcaatgctcatagttatgtgcactgccgtatagaggctaaaccactggagacggactgccatggccccctccttgcgggttgccgaccactactatcgccttccttggcagtcaccagtcaccaccaacacaagcttctcgtcaagacttaggagaatcgcataaactaggaaaggagagaaaaagggtagagattgaagatgacatgtgggacccaccatactttcaaggtgtttcttctaattagagacttggtgtgtcacatagtcgtcaggtcagatgaagaccgtgtcaatgtgccacgttaaaaccaaaactgctatcaatattaccgaggaattcattttgcgctgatttttaagagttggagatgctctctaactggttttgcggtcgagagatgcgaatggaactcgacctgtccttgagggacctgaagtgaactttctgcgctgcctgtcgatggttgtggttgtgggctgttagtccatatgaaaattgatccgacagacagaaaaccccaaaaaatgagtgaggcggaga

SEQ ID NO: 25195 - DNA, 1501 bp, Oryza sativa
tcttcggctttggcatactcgttggctttttcaaacatctgcttaaccgtcctggggggtttacatccgaacttgccgactaggtcctcgtggcgaatgcctttagtgaaggcggcgatgatgacgtcgtcggtgatgtcggagatcttgttgcgttgttcggagaagcgccggatgtaatctcgaagggattctccagacttctgaacaacgttgtagagatcaaattgtgtgccggggcgttcaaaggtgccctggaagttggcaatgaagtgatcacgaagttccgcccatgatccgatcgtgccacggggtagtccgttgagccaggattgggcggagtccgctagggccacaggtagatagtttgccatggccttgctgtctcctcctgctgcgcggattgcgagtccgtagacggtgagccaagactccggattagtggtgccgtcatacttctcaattccagtcggcttaaagctggctggccaatccactcgacgcaggtcattagtgaaggcagctactccatccacgtcgtcgtcgtagcgatttggtgaatggcggtgacctcgcgctgcacggcgctggttgatcatgtcgcgaaggtcgacgggacgctggtgaggtggagagtgaggccgtttagctcggcgctccctgtgacgttcgggaggcgagtgaaaagatcgttcgtcgtgacccctgctcctgcgactagatcctgtgccgatgatgctgaggcttggctgatgataatcatgagatcggaagtgagggactcggctactagtcggggtacgggtgcttgcggagttggctggaaccgaggcagcgatcatggtcttcgtctgattcaagatgttgacaacatgatcagcttggttgagtgtgtcttccttgaggagggtgtcgaggagagtgattgctgcaaccgcgttctgctggggggtgcgaaagaccgctgttccatcgacgtcttgttgcccaatgagctctctcgctcggcgcccagattccaaggcgcgttgccgtcgatctttagcctcctttgcaacccgttcgcgatcttgttgctaacgctgtagtcgttctcgctcctgtcactgtcgctcttcctccagtcggcgacgttcagcttcttgccttgcgcgatcttggtccgcttctcgggcttggcgctgttcctccatttcgttgtcagccatgaatacgccgaagaagaggggcgtgtagttatcctcagagctgtcatcgaagttgtcgaggtcgccatggtcatagtggtagccgaaatcgttgtagtcgaggatctcggttggtcgagaactgacgccgggggagctaaggtaaccatccaactcttccgtcgagactgtcccaagaggttggagtataacgccaacctctctggatctagattggatcggggccgaagccggagctctcctagatcttcgagtgggagatgtcttgacagtgaaaacagcggccaaatcat

SEQ ID NO: 25196 - DNA, 1501 bp, Oryza sativa
ttattttggatctgttgtttcttctttgcaatacatctcaaggccatgtttttttttcattacagataagctggggttccttttggtgcctgtcggtccataaaaatagtttctttggttcaccgaatggtcaaaaaaagtagaattgggggaccaaatgtgtgattcgtatgtaattagggggctttccattatatatatttggggtgtgtttcaatcctcttagcacccatgaaaacacgactgtttcttaaagtattctgtttccaagtgtaaaaaggaaaaggaagatatgtagcaggggcatcctgattcaaaatctaccttaggtttggggtcacgcaaaattacaatgttgaactgttaatttgtttgcttacagttcatttgcttccattttgaactgttgcatatatgttttgatacagtggaacagattacatcttcagtcttggttctttttttttggataatcactggaggggagagattccccacctgaattttccattgataagagatttcattacaaaggaggttacatagggcgggcagaacgacagtgccgttgccattacatatgttggagttgcataggacaggagaaaatttctttccaggctgaaaccacaatctgatcagggcgctggatacgctcagcccacaagttagcttcatcaagacagcgtcgaagaagtcgtcggagggaaggttgctcatttctgaagacgacatcgtgttggtggttccacagacaccatcagcagagcaagaagatggtccgatggtgcgccaccggtattgtttcaggggggtaaatgcaaccgacatctcgtacatcagagattccaggatgaacagagagggccgcccagaagtcgcaggtgaaagggcacagcaggcataagtggctggctgtttcatcgtcgagtccacagatatcacaagttggggattgaacagaacacttatctattctaaaccactaatataaaaaaagtatcacttgcgttcttccctacctccacccaaaagaggtgtacactgaactactacagtcacctgccttcaatcaaatccaacgttccaacattcaccgttgcaatacggacaaactatgcaattaatgcattaattacacataaatatctaaggtagatcataaaacctgctaaatcctcaccctaaataatgcccatgaacgtagttaacatatactgctattttgttctgcttgggaaacttgctcgctgaatcattcttttttttaaaataaataaataaatattttagcagggccataattcacgcttctgtagagttcatgtatcagggatatcgatattattgggtttcatttaattttggataataatatttatttcatagtgacgtggattctttatgtactacttaatttcttattgtactgtcctggattacgcatgcacattgatttatttcctaacatgtagattacggaacaactctggaggcatgg

SEQ ID NO: 25197 - DNA, 906 bp, Oryza sativa
tttgtttcgacgagttcttgctttcgggttgagctgcatcggtttcgatcttcaacaagaggtaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctgcttagattatatacgatatccaccactctatgaaacatccaacggcttgattgtctagatattgtccttcttttcatacttatagctgcatcagttgtttgatcttatgagtcgtgattagaatctcaatctctagcctgtctttgattcctgattagggtagcatcggggtttcagccgatcttacctgatttaactatagttattctatatgcttgattgacatgttaaatctgccctttatattaagatcttgttgcatttaagtatattatgcttctgtttagtatattctatttgctttaatatcttaatatagagtggtatcggagtattagccgatacatgctagatctatctaaccggctatgctatgaacatatatagtcttgttgttaatatatatttcgatctaagtgatttatactatctcggcatggcgaccgatctatcccaatcacttgatttaagtatatatcgacataaggattatatattgttaatatctacagccgatcgagtagatttagttctttcttacttattcacgattgccgatcgatctatagatgacatcggctcagagataaatgatatgtcatcggcaactagccaatcggctgtcgtttatggatttaaccgcggtttctttgtctt

SEQ ID NO: 25198 - DNA, 1501 bp, Oryza sativa
ctgttataattaactatttcccttaaatttattgtacacactctgcatggtctgtgcacatggtgcacaggaaaaatatgtttaatatttatattcctgtaacatttataggcaaaatacttggggtttaagaatgcttttttagcgatgagggcttaaaaaatgcttaatttgcttttctcagacaaaattctgcataaaggggatcattcctggcttaatttattggaaaccagggtatattgaaggaaaaaaatagagatttgctccggtccaacaaaaagtacctcaaggtaccgatatctcacgataccaaatcgtttccgatcgttggatctaacaatgcccatcctgcccagctagatccaacgatcagaaatgatttagtaccgtgaagtaccggtacctcgcggtactttttattggaccggagcaaatctaaaaaaataacattcatacatgttcttattttcttaatattaaattgagttatatagtactccgtaagtgtttttccatgaaataaataaagtctagtaagaagatatatgctacttcctccgtcccagaatatagcaatataggatgggatgacaacgaatctgggttagggacggagggagtacactccaacaaataaacaatatttttttgagcgatacaagtaaataattaaatactacctccgtcccaaaataatttatttctaggatttaaaatttgtcctaaaataatagtaattctagagtactaattgccccatcaatcatctctcattcaaatttctctctattttaccctcaaccatctttccactctcacataaacaccatttaatgaggagcaccatagtctttcttatcaaaccttaatatatgctaaacaacatagaattacaattatttggggacagaggtagtagcaaaagtgagtaattaattaaaacgaaataaggatcggagaagcaggcatgcattgcatgatcatatggtgcaatgatcatggtattaatatatggagtatatatatatatatggtgcatgcaacaattaagtagaaaggttgatatgatgggcagctaattaacagggggttaaacactgtagttgatatgcatggaaaagtgatgtttgcccttaattaatcggtgtatgttcctctccattcaaacttcatcactctcattcacgtgtgctcgatggttaccgcgcatacatacacacaatcacaccagaacgaacaatatcaataattttcactttgattaatttagtacgtagtatatctttttggacggtggataccaaatctttatgtgaaagatacaagcacgaacacatatatgcatgtgcatcacctgttacctcgatcgactttcaaaagagtaaattccaacagaagctttttccagactgccaaaatcactgttcacatgtggatgtagcaaccgcctaaaaccagatgtcagatttttattaacaagcctcagaaccagaactat

SEQ ID NO: 25199 - DNA, 1501 bp, Oryza sativa
gcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcga

SEQ ID NO: 25200 - DNA, 1501 bp, Oryza sativa
tggttgctctccaagctgagggactggtttggactttccagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctaatgccacgtaagcgtcaagctcctcttgcgtgcaatcgtactctggatccttgttcttggcggcgtcaacttttcccttcttcgttgcccttgtgtgggcaggcagtggagcttggggggcccttgactttgaaggtgccggaagaggagcttgcggaggagtcagtgcaggagcctgaggaggagtcggtgcaggagcctgaggtggagacggtgctggagcatgaggaggagacggtgcaggatcctaaggaggagatggcggagccggaggagatggtgcatgagacgccgcttgtcgcccagggaagatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaaatacctgaagggtccgttgggatggccatgcccgacgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacgaggcaggtggattcgtcctgggtttgcatggcgtccatgctctgtgatcctacctgccccgttgaggcgtagctgctacggtttcctgacgggctcaccattgcaggaggaatggtcggctggggatcattggaccgatgtgcggccatgcgttcatcaaataatcttatatgctaagactaaatgaacagtcatgtatgctaagtgtaactgtcgtatattagaaccctacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattacgtcacttgcctgggagaattccttcgggggctagctctaccactccggcttgagggacgactccgacaatgtcttttctgca

SEQ ID NO: 25201 - DNA, 397 bp, Oryza sativa
agaaatcgccggattcaatccctaccgtccgtccgtcatgtaatcaaatttcatccatccatcgggtgaaatcaccgaggcggcttttaatccatccatcgtccatcgccgagacaatcccggccaccacatcctccccacgttaccaaaaggccccgcgcgaccaacacatctgccctatgcgctcactatgctgtcacaccctaatcgggcaccgccgtacaacggcacctgacaggagcgtgtcgtaggaataacggcgcgaaccacttcctacgaaaccgcgatctcagtaccagtcccaggacatagtgctggtacccacggtgacaaatatgaatcattgcaaatccttaaaataaatagaggacttatttaccttaacttaggttgcagc

SEQ ID NO: 25202 - DNA, 200 bp, Oryza sativa
tccattatgtctcaggtcatgaattgacttagctacaaatgtaacattaatgcatagctaaatgtaaatcacacatgcactcatgcacgcataccacataacagtcaataggaaccggctcatcactgccagttcacacatttttcccacccaaataatggttaattgatatgaatgtgatattgatactccttatcagt

SEQ ID NO: 25203 - DNA, 1501 bp, Oryza sativa
tgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaatcctttttaacgcgattcaataattctttggaattattatgatgcacatgaaaaggtgcccaacataaaggtattataccatttttgtaagcttttttaggctacgaaagctgttgggttaatttgagatgactggtttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctaca

SEQ ID NO: 25204 - DNA, 388 bp, Oryza sativa
ttcgcaacataccttgcttctacttggacgagtgcaacttataccacatcagcatgtgagtctggagctcgtagatgaaggagtggtgggagataaagtacatgaaatgcagctgcgactttggtttcatgccgagcaccatcgtcgcttgagccgtccactgggtgggtggtagggaagaggacacaaatggtttcagcatcaagacacaaattaatatgcattgatttgacatatgtgtgacttcagcttcttctgtaaaagaaatctcagttttcacttaatgtgtaaaggcattttattgacctgtcgatgcaaaccattaattggttggaaggggagatctctggtttcggattttctcaccaccgccaggacgtaatcccca

SEQ ID NO: 25205 - DNA, 1501 bp, Oryza sativa
tttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtaaggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaa

SEQ ID NO: 25206 - DNA, 290 bp, Oryza sativa
agtgatgctcctcatagtatggtacagtagttcatcaattattgctttaataatttccatcggttagggacgatatagagttgatatacatgacgcgtacagttttgcatacgtgagtagaggagccccatatagcagcaaggttgtctgctaattcgtataagagcccgtacaattacaatgtatagtttattttacatccactagtgaaaaaaaacagatgtacacaataattcatgtcccgcgcttacatctttaattagacccaacattcgatctcattaaggagc

SEQ ID NO: 25207 - DNA, 1501 bp, Oryza sativa
aggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctgctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattgg

SEQ ID NO: 25208 - DNA, 178 bp, Oryza sativa
tttcagaatggaggcagtcaagcgaccttgatgcttgaatgggatgaaactcatcccctctaaaaaaatttgaggcggcctaccgagggtgttataaaagtttttcgatggaggcttattagaccatcaatttcatggatttcaaagacatgattccaagattgcttctttgtcgtca

SEQ ID NO: 25209 - DNA, 1293 bp, Oryza sativa
  unsure (1)..(1293): unsure at all n locations
acagaagctcaggcttaagcctttgatttgtttaaacattgctgttaagattttagcatcatgtttctgttgaacaggtgtttggcggcaacgagggtggtggttggaanccaaaacatcgcaggtagggggtgtgctcatgattgccatttctgggatatttttgttctattacctgaaatgttccaatcacatgggggtgtggttaggtgtatttatcctaattaggtttggtcaatgatgactgatggggtactactgcggaaagagaatttaatctttagatcagtgatgcatttttttttcgcaggaaaatgacaggctgccagtcaacgacacgaacaaatttccgccatcgattgaaaaggtttgcatttgagcccatcggccgcagctgtttcttctctttgttcatgcgtgaaattttatccaagtagagtgcttgttgtgagttgctatcgtgccgattgtggtctcatgggtagtgtttgagtggaattgccttttaatacatggtccatggccccatttttttggaaatgtcagtctgcttttgccatatcatggatcttgtttcacatggccctcttttgcatttctactgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcaggccttcctatcaaacaaatcgtgatctttgatgatatatcattactgagtgtaagagctaatatgctttacagttatttttaacatgcccttgtctgttcgtgcagtaaatatatatgctgctttcgcatgaatttctgagcagggcatgtgatatgcaccttgcttttgcaatattttaaagaaacatttcaataatcctttgtaacttgtttgcggacttgcagaattatcatatattacatactttttatttttcacctaatgttgcagaatactgatgctgatcctaaggacaattttgaacaaggttt

SEQ ID NO: 25210 - DNA, 909 bp, Oryza sativa
catcctcgatagttagagggttattcgtagttttgctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagc

SEQ ID NO: 25211 - DNA, 1501 bp, Oryza sativa
ctttaactcatcactgtccggtccccagaccggcacgccggcctggatttttcacatttaagtccttttaaaaaaattatttcgcaaaatagacctctaaaaaaatttatcctacaaatggtttcttttagggcaccagagtggctggcaccgtcctctaactgaacggcgccaggcactctggcaccgtcctcctgccaacgtggcggggtggtgctgaggtggcagggggaggcgccaccatggctcccccccccaacacctcgtttccaatcttgaccctttttatttatttatttttttgatatttttttacacttagaatcacgatacatacatgcaaaccacaaaaaaaaattaaactcgaatggaatatgtaataaatccttcaacttagctaaaagtctggaaacaacataccaaattttggaccttcaccaaattataccataactcttttagcaaaacccttcggtcagcatgttaaacataatgcactctaccactagatgaaattgcttaatctaactcaaaatataaccacatgaaaatgatagccataagttacttaaacagtctagagatgcaactttttttatttttcttttattttttgattttttttccacgattaggagcatacaagaaccaacgatatacaaaccaaactcaaatagataaaatatgtgacctgcagaatttttctcttctatcctctctagtgtagaggagagagatgtgcaacttttttttttatttttcttttatttttttgatattttttttcacagttaggaacccacaagaacgaaccctaaaaaaataaactcaaacggacgaaatatgtggcatgtagaattttccaaagctccgtcgaaaagcttatcgcctcgaaaacacaatcttgcaagaaaaatttggatattttaatttcgccgaacccagcaaaacgggggagaatcggatgtaactttttctgtagatttttgtggttatattatttgcctgattccgagttcgtatgagaaagttacgtctattttaagaaatgacacacaaatgacacctattttcggtagagatttagaaaattctacaaatcacattgtcggtgacatgggaccgggagtatcatgacttagagacttgaggcagacacgatcacccacgtggcctaaccccctcgggggggggggggtcgggctcgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcatttatccggtctgtgaccggtcacagatcggtcagattgcgggttaggaggcaacaggcgatctgacacacgcctcgccccgtcccatca

SEQ ID NO: 25212 - DNA, 238 bp, Oryza sativa
cttgtgagaaaacaatccatcgctgttttgttttgccattctcttggttctatgaactcttttggtttgtctggtcaagttacgatctattataattaaaatttgaaatggaatgagctcttactttttttttgtccaaaatgaattccagttacccctggagtagtagagagagtgaaattccaagaataaccttatgtttttcaaccttatatggttgtattatttgacctgcaga

SEQ ID NO: 25213 - DNA, 1501 bp, Oryza sativa
tgtgcgtcaggatctggctctcaatgagcccactccatgttcgttgaagaattggatacactgtgaagacaggtatatatgctcttcttgtgcacgagaaagctttaaaatttttaaggttttggggtggcaaaatgtcacaagaaacattttcctttagtagtttctgaaaccgctgtcaaattcacttggatcaggtccagagagaaacgccgtttgttcggagccacctgagatccagcgatgcttcatgatctttggtaggtctgtgtgcttcaggaagttcgctgaagcatttgcatccagatcgcgggacataagacttgtgcttgcggatgaacctttacatttttttaccttgtgtaatatatatgcaaggttgttatgaaatcataatcgctgtaaattgcaacataaagaatgtcggttgtgaaattcttgttgatatccctataaatgtagtgcaccaagggcgtcatgagtcatcagttcgtcgcttgacttgtgagtactcaatcttcacactcataatctcacccttagtttatctgatacaactttgctggggtaatttctgatatcagaaaactttcagttatttgctccactcttcaaaaaatacattttctcaaaattccatttctactgtattgtttagactaattgttctaagatatttgttaagtttgtttttaaaatactaaatttattctcagaatttagtagatactccatcccataatacaagggattttggatggatgtgacacatcctaatataatgaatctgaacaggtcgtctgttcagatttattgtactaggatgtgttatatccactcaaaattccttatatcatgggacggagggattaatccttaacaatagtgagctcaatattctaagcacataagctgtcctgcaagctaaacattgggctgcatatgaggcccacattcttgggctggagccagctatgcatgcctctctcagggccttgctagagtcggcccacggttttctgcaggaaaccaaacaacgcgtcgtcttcttcctgcgggaaactaggcgcccccagtgtgagtcgagtcggtgctgtgctggagtgctggcaacgcaggcatggcgggggccaaaacgaaaccggcggcgttcccgcgatccctgcggcgaggccttgcctttcctcgcttacggcgtgccgaccttgtgtgcgcactgcgcggcggcgcgggcgcacgacgctggcacgacaaccccacctccactactccatttactttgctactcccttctccttccccgagtccatcgccggagtagtagtgccgcagaaggatccctcgccgacgagggcgcggtagcagcagcacaagcaattcgcgcaggagagaagtggccgcaggccgcagcgatgggcgcgccggtttgtggcgcactcgtgtgcttcttcgttctcctcgttgcccgtgcggccgcggagacggcgccggtggaacgtcc

SEQ ID NO: 25214 - DNA, 306 bp, Oryza sativa
aagcataagagcaaagtggggggcaatatacaatatgcaaaagaagcaaccatggtgcaccatctcaagccacattagagaagtctatgacaattaactcattcctcaacttgcaaaagcgggtttcatcaagaggcttggtaaagatgtcagctagttgatccttggttcttatgtggctaatgactatgtcacacttggcaacatggtctcttaggaagtgatggcgtattgtcaatatgcttggatctagaatgttggaccgggttattggctatctttatggcactatcattgtcacatagg

SEQ ID NO: 25215 - DNA, 452 bp, Oryza sativa
tatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctt

SEQ ID NO: 25216 - DNA, 1501 bp, Oryza sativa
atggtagagcaacactactcctagcatgtttgtggtagagctccaacttctaaatttagtttcaggagttgagtctagagtggagttgcggaactgtctaaagtctaaattcagcttcaactctttagtttattttgtaagagcactctacctaactccgctcttattttaggtagagatgaaactgtttggctgagcttcagttacagaagaggtggagctggagctcctgtgccaattgccaaacaggcccaataatctcatccagaatgttaatgtagagagtggagttgtgagtgcatgatttttgtttggaggagctttagattacgagaaacatgggtaggaattcaactggtgagaatatggagaagttgtaaaaaccaatttttctttcctagtttattttttattctacaatcacaacttctcataatctgaaaaaaaaaagtttatggagctttggattcaaaggagaaaacgcaacccaaaagttcctctaacagaaaagcccataaatattgtgcacacacgatacttcataggaatctagtgacatcaaggtacttcactcttcggttgtgttaggggggtggagtggtggacacaaacatatgtgtgcgcatatattttctgcgtaataaaaaaatctagtaataaagtttgggagtacctatgcatctttcgaaagatttttatgatcatatcacacagatttttaatctttagattaaaatctaatgggcacagtaaaatgcaaaaaagcaactaaaaaacaccataatggacactaaattaccatatcttcaagaaaaaaaccaaatctaatatatatttcaaaacttacatgcaaagattcaaaaattacactgtaacttacaaaagttacactgtaaatttcataaattacactataatttacaagaaaacacactgtaaatttgagtgagaaaatcaagtgagagataagaagaaatctttcgagtgagatataacaaaatcgataaagttttgcattgaaaccaaacaatctcatgctccaatggaagggaactatggaagtcctatgtaaatgggccaaagcccaaagtaatacacaaaggcattccaaattcgggcctgcacaagtaaaccgggcgatccagaccgtccgatttggcgcgcagaaacccgatccgcatcccgcgccgtcgcctcaccgctatccctcatcacccactgacaagttgccccacacgggaggatggcccacacgtcagtgatagagggtccgttccagggggcccacctcatttggtcccaggaaggtccttcctcgctctcctctctgtcttcctccgatccacccaaccaaccaagcgcccgccggcctcgtcgcgcgccgcccctccaccgcccgtctccaatgccaccgccgccgcagccgcagccgccgccgccgtcgtccgcgtagggtaggggcatcccgccggcgatgggcaacaactgcgtcggccccagc

SEQ ID NO: 25217 - DNA, 250 bp, Oryza sativa
gcgcttgttcaagctgtgctgctcggttttttgctcggctatgtgcacgaaaaaaaaatcccaaaaatttatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacaga

SEQ ID NO: 25218 - DNA, 356 bp, Oryza sativa
cggtggggcgttgcaaaagcgcatggctgctgcctgtggcgtgtgggatccccatatgccgcgcgggacaagccatgtggggagataaattttgtactggagttggtgatccgagaaagcgtttgtgttcattaagaaaaagaaaaagggggggtggggggggggagaaaaaagaagagagttttgtgttagtgccgcgccggatagacggatgggatcatgggatctcctgtactgtgcgtgtcctctagtttgtggtagcgatcgagctgctgatgacggcagatggcccagtagtgcttgcaaagttgcaatataattttgttggctcgacctgctttgcttccctgatcaga

SEQ ID NO: 25219 - DNA, 1110 bp, Oryza sativa
  unsure (1)..(1110): unsure at all n locations
cggcttgttgatagattcctnnnnnnnnnnnnnnnnnnnnnnnnnnnnnnnnnnnnnnnnnnnnnnnnnnnnnnnnnnnacacgggagatggacaggaatgcccctgggataattaggttgggttggaagggttatgtggctgatggctgtcacgtgtgtatgggacatgggacgccatcaactaataatgacctttcacctttgtgcaaaggaagattagtcctaagtgagatttttaataagattagtactttgaagctttggacaaaggactctagctagatggaagcttaactgacaagcatattagatccaggcttttgccaattttgaaacgattttttaaaaaaattcaggtttattcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcaca

SEQ ID NO: 25220 - DNA, 176 bp, Oryza sativa
cggaatgaaagtatttagaatttaggggataatagattccatttcattttgtgtgaaaacaatccatagcatcagaaaatcagatttaaaagaggtacatagatgaaccagtttatcttactcgggatagataaaaagaagacctgctgattttctgttagattttccataagaaa

SEQ ID NO: 25221 - DNA, 1501 bp, Oryza sativa
agctggagagccagagagctcttattctaaaaaccctcttctccttttttttttttctcgtgggatctcctctccagatcatccccccttccagcctctcctcttaagtgggcaaggtcctccttttatatctcaaggggataccacatgcaccacttctccctctctctttttgggtgggggcccatcctatctatagtaaaacttggcttgccttctcttggaagctgaaacactacctgtttttgagtgtggccacgcgtcctcgttcgtctgacctcggggatcaccctgtcatcccttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctagcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcatttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtca

SEQ ID NO: 25222 - DNA, 669 bp, Oryza sativa
tcaaaaaagaattattccttttcaggttataagttattttgactttggtcaaaataaaactcaagtttgtagaaaaaatagtaacatttttaaaccaagacaaatttattatgaaaatatatttaattattgatttgatgaaactaatttagtattaaaatattattatattttttatagaaacttagttaaacttgatcaaagttaaaacgacttataacctaaaataaatggagtaaactttagaaatgaatctgaatacacgtgttcatgtttaactctagagtttgactttttttttacggggagaattctcctttgcaatagcacaagcacggcaccggccgttcagcagaggagcaggtgcactaccatgcccctttccctgtgtgtacagtacaagtatacaggaagcaacccatcgataaaatggaaagcgaggttcagaaaacccctcgcctccaaaaataaaccaaacgaatcccgaccccttctccgcctcttcttcctcctcccctcccctcccctcccctccttccctttcctttctctcctctccaatcgccatacttcccgcttcccgctttgaccgcctccccttcccccatatcatctccccttcctctcctccacttcccgcccgcgcgattcacccaagagagatgtcaa

SEQ ID NO: 25223 - DNA, 1501 bp, Oryza sativa
tcggcgctcctgcctcctctcctcctcccacttcctcgtccgctcagccaaacttttgactacacggcagtccgcgaggtcgtgaagggaggtgttgtggacggtgcaccacttgccggttgggcgctccctgctgggagcgctggcctcctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctctgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatatatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtgggcagcacgtcggccattatgccggcgctcgatactgatgcgggcatccggccccccacgaagatcttcccgggtcggaggcgctgacgaaggagtgacggccgaatagcgaacagcggccgctgctcgccgcgccctccgtcttgacgacgcggagccggtggtagcagtaccagaggtcttggtggcggaggaccgcccaccagcatctaggcgctgctgcgccgtcatgaccaagttggccatgtcgtccagccaacgttgggctggagactccgggtcagggacaatgggcgggtgacgtaggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgt

SEQ ID NO: 25224 - DNA, 1501 bp, Oryza sativa
tacctacgtccactccgccggaagcaggtgcaacgtgggaacacggttgtcttccggcgacataaccagtgtcagaccggtcacctttgtccaccacgtgtcagtttagcaatctgcatgttcgcccttcttcatacaacgtcttgcttataatggttgggataaagcctggcatacatctgaccaggaccaacgtgccatctccaggagctagcacgctggctccggctagggacgagtgcctagagactctcatcctgatgggacggggcgaggcgtgtgtcagatcgcctgttgcctcctaacccgcaatctgaccgatctgtgaccggtcacagaccggataaatgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgagcccgacccccccccccccgagggggttaggccacgtgggtgatcgtgtctgcctcaagtctctaagtcatgatactcccggtcccatgtcaccgacaatgtgatttgtagaattttctaaatctctaccgaaaataggtgtcatttgtgtgtcatttcttaaaatagacgtaactttctcatacgaactcggaatcaggcaaataatataaccacaaaaatctacagaaaaagttacatccgattctcccccgttttgctgggttcggcgaaattaaaatatccaaatttttcttgcaagattgtgttttcgaggcgataagcttttcgacggagctttggaaaattctacatgccacatatttcgtccgtttgagtttatttttttagggttcgttcttgtgggttcctaactgtgaaaaaaaatatcaaaaaaataaaagaaaaataaaaaaaaaagttgcacatctctctcctctacactagagaggatagaagagaaaaattctgcaggtcacatattttatctatttgagtttggtttgtatatcgttggttcttgtatgctcctaatcgtggaaaaaaaatcaaaaaataaaagaaaaataaaaaaagttgcatctctagactgtttaagtaacttatggctatcattttcatgtggttatattttgagttagattaagcaatttcatctagtggtagagtgcattatgtttaacatgctgaccgaagggttttgctaaaagagttatggtataatttggtgaaggtccaaaatttggtatgttgtttccagacttttagctaagttgaaggatttattacatattccattcgagtttaatttttttttgtggtttgcatgtatgtatcgtgattctaagtgtaaaaaaatatcaaaaaaataaataaataaaaagggtcaagattggaaacgaggtgt

SEQ ID NO: 25225 - DNA, 200 bp, Oryza sativa
  unsure (1)..(200): unsure at all n locations
cgcatgtccaggtgaacgcgtgtttcanacgccnnnnnnnnnnnnnnnnnnnnnnnnnnnncgatagattatttctgtaaatatttaaaaaaaaatctaaatccgaaaaaaattccttccagaagcagaggaacccattccccacacacacacacctcgccaccggcaagccgcgcctccgcctctcgagccctctccaa

SEQ ID NO: 25226 - DNA, 362 bp, Oryza sativa
  unsure (1)..(362): unsure at all n locations
cgcgcntttgtagacccngatatatcnnnnnnnnnnnnnnnnnnnnnnnnnnnnnnnnnnnnnnnnnnnnnnnnnnnnnnnnnnnnnnttcacatcaaaattaaaagtttagttgaaattgaaacgatgtaacggaaaagttaaaagtttgtgtgtagaaaagttttgatgtgattgaaaagttagaagtttgaagaaaaaatttataactaaggttgtgtttagttcctgaaattaggtagaagtttaaagttgagagtttatgtgtgtagaaaattttgaatataatgtgatgtgatggaaagttagaagttgagagaagtttggtgtgtaactaaacagggcctaaactcggccacagt

SEQ ID NO: 25227 - DNA, 652 bp, Oryza sativa
  unsure (1)..(652): unsure at all n locations
aattgaacacgagcaatcacgcgtcaaaaccccagcacagccaaattaaagatgaagccactaagctgggatacgctgagttagttgccacggatcacattccatatagtctatttttacatcgcaatccacagggcacttctgctgctgctgctagtagaagacaagagtatgatcgtggtcgaggcttttttgttgccactgcacgtaaagctagcagggacaagtgtccgtagcgatacagtacaggagaaccggtcgcgacgcaagaattcatgtaaaggcggtggcgtgcgtggtggttcatgtgccatatattcggtcgatcgatagggatccgccggaaatcgatcgcctgtggcgccgtcgtccgatcgatcggcaccgaatccggggctaagctagttgccgctattctcgctattagtccgctatcatactctatcntnagtatagttcaccttagcaacaccaccacccgnngtgagggccttttgaaccccggnaaccccgnatttccgattcgtcccggcttcaacagagacatctcgcaatgtgcagttagatactactgcgactgctctagatcgatctccagctagaggtgcagggttaaagcgttgaaatgaaacatcttttcaacctatttttt

SEQ ID NO: 25228 - DNA, 1501 bp, Oryza sativa; identical to SEQ ID NO: 25163

SEQ ID NO: 25229 - DNA, 1501 bp, Oryza sativa
catagaaagatacaaatggagtaactgtagtattcatcactttctaatgattaaaattcatttctttcaacttaataacatacaattgactgtttggcacaatcaacagtttgtcaataggggaaacaaatcgattaaaagggtaaagcatgaaaatctaccatttttatatagtaaaatgttgctaccaaaaacaatgctataaagatatcctcgtaactaccagaagagaaaggcttaccacatcaaactcttttggatgtgtgagcatataaactcgagcatcagtcaaatgaggctcgatcttactcatagcagaagcaccattaaactttatattccgcttgcaagcttcaatacaagctgaaaaggaagaacccacacagtataatgaatacaagcagagaagcatcattatttagaaaggaaaccagttcagaaaattgggccattacctttatcaatgtccagagcgaccaccttttctaacacgtctatttcacgagcataacggatagatctcaacccagaagcagccaaagcctgcatttagttttgttagccggtaaaaactgaaaaactattacatatcaggtcaggcaacattagtatggaaccgtaaaactgatgtaaacataacacagtaatgatttttttattgtcaaaactgcataacgtattatgacttgcagcacatagaaccaaatattatggtcctcaggttgcaaaatatcccagccctatttaaaattcgaacaatataacattcagagtacatatttaactaaaagtccaaactttcatgtcagagtgttttatgtatttttttaaatattgaattcttgattaagatgattaatttaactcttaattaatttgctaaaattaactgagatttgaacgaagggtggggctctatgaaacccgtagaccataaacctgggattatgtgccacaactcataatatccttgtttttctggaatgtcaaccattaaacctgcatttttttagatttactctatactattcatactatatgtctcacctcaagaacaactggtgccttaagctctctggctactttccgcgaaggtgtctttgttgcttctgttgacagatcttctgtttcatccgcaactttatttgtttccttttcagcatcaacatccatttcatcatgctgtcctgttgacccattctctccatttggaccagatgatttactctggctcactttgttatgcgccttgtccctcttatccatcattgccttatgttcttcctcacgcttggcaatgaaagtccttaaaagagcaactgacatatctctattgtggacctaatcaagcaataaaattgaattacagaaaagcacagtagctgataggagattagacataattttaggccaaatataattactctgcaacttttaaaagcgatagatacaggaaatattaactatgaataaactcatagtaatttgccgatgatatcac

SEQ ID NO: 25230 - DNA, 1501 bp, Oryza sativa
gcatgtactgcacgggccagcgagacgctgtaaagtgcacgagtacgagcacttgcatatggtgcccccaacatgagagccactacgacgataaacgagttaaaaaatggcgagaaagaagaggcgttttctcaagagaaaaagggccatgcatggcctgtatattgtttaggagatgatcaaatatcatttgtacgcccagattccaaatgttctgctgcccaccacttagctttattgttagctttgtgatgctctagcttgtcataagccaacgggtatttgtttacgaatcgtaggctagtagggtttgtagcacattgctactagatccatgaaacgggggattttgctcctggagcaggtgaaaactcccccaagattagctcccatcgaagcctgtttcccggaacgaaagattgttcctactgaaacccgcaaactaaagctagtacccatttttcttcagagaaaaaaaaaacaaaaaccgcacccgttggccgttggtccctgatcgagtagctgggatccgtcgtgttcagcaagcggatagatgccgtggcgatggaacgtgcactgtagccgcgtacattctgtccagtggcgtccgcgtcgctgccctgtagaagatcccagtagacggatcgcggtgcaagcaagagatcgaaaccgtgctactactgtgctagcctagctagctctatgatagatttggagtcaaccgcgcgcgcgagccccatcctttcgtggcaccaaactccgcggcgcacgctggagagacgacgacgaagtgaacgaacactaccgcgctgggcgcgcggctgccggcatgggcatgagcatcggcgtggctcgctcgctcgctttcgccgataggtaggcgatgatccacttcgcgtgttctcgatgggaataatactgtactgtactgtactgaggagggtggtacgtacggctcgatcgatggagacaaagctcagctagtaggtgatgggctcatggatggctgatgcgtcgttcattccttctgtcggtttgcttctacccgtgtagcgacgtagcgtagggtgggtcggcctcgtgtcgcgacgaccgcaacgttggtgatggtggtgggtagcaagcgcgggggcttggccatcctcgccccaagtcgcccacgccgccacgacgccccgcgcgccgcgggacggacgccgagatggaggaggaaaaacgtggggcgcttggtgggatggggtgggattggggatcgaagcgctggtccaccatccgtagccgagaccgaggcccaggcgagaagccatgctccctgctgggccaagccaacccggtggaaaccgcgtcgcacgagcccatcagctgcttttttgctgcgtggtagaagaacccggtggaattcgatgcagatgctagcccatccgtgtatcgacatcgacaacagtaaaaaaaaacgcaacatatgtatgcgtccttataggaagaggaaacgaacaacaca

SEQ ID NO: 25231 - DNA, 1298 bp, Oryza sativa
ccacgtcgtcatatcacaagtgaatccatttatcgatagtgtggttttgtgaaataaactaccaaaatatatgtacttaagtgccaagtgtcaaaatatgtgtggttttctgcaacttgaaccataaaaaaaatatgtagttttgtgaaatttactctttgttttttttctctatgaaattagttgtgcatgttgctttctgtgttgcatggaggttgtccaaatactactgttaaagtgtcaatatcgttaggaagataagaggttagtagctggtgaaattaatgcgggtggccacagctctggaagtctggatgatggtgcttatacttgtcaattggtgataactgattcatgatgtgtggctgcctggtattgataggccgtaggttcaatgcaagaatgtgacattcaaccgtgctgagctgagcaagacagtgttgattgttgaatagttttcgcttaagcgaaatatctcattttcgtgtaattactgctctcctgttggaatttctctagttagtgcagtcagtataactcgtgtgctctggcaaaggttctctagttattttggagtagtctgcactgtttctcgtcatttgtcgtgttctgttctgtttctctgcactgtacttcatagaaggaaaagaaggaaacattggccgggcacattcagttctgttaggaataaggatttttttttgcacgaaaaggaataagtatttgtttttctcaatgtgcctaataccaatatcatgaaaacttatgctgcaatttatttatgcaaggtagtatgtttccctcaattagacatgcatcctccaatgtgaggttagttggagatacattcacgcattaacaaaagaaatctgctcaagatatatgcatgtatcgatttatttaaccaagttgagcattgtcctttgtgttgttgagatttacagatctcaatgtaagttctatgaagcatataaacgagtacatgccatctgcaaaggggaatatttatccgtatgcagaagttgcggagtttgttccctagatcacatggtagtgctaatttatttttaaaagtacagattgctgaaattagacgtgatatcctcttcatagtatacgccatcctccttcacatcaaaggtgtgtgaaaaatatgctctgttatgggttatgtcttatgtgaataagagtggtacttaggttacatatcatatattcaatagtcaatggtggcaatagctgcctcttattttcgttaactactgtctcctaaactgaaaatgatattctatatcttg

SEQ ID NO: 25232 - DNA, 1501 bp, Oryza sativa
aagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtggagttttggttggctgcgctgcgctgacccttgtaaaaccggaccccgattctgacaagagatcgaccttgttttgttcgtgtcgtggtattgctgactactactttggaatgattaatctcctactactaattactccagtctttttgctgtaaattcactcttctttttacctatacgtcaaattggaactttgtgcacaactaaatggagagcacactgctgtctaatctactgctccaaaaatcgtttagcacagcgaccagaagagccgctttcgctttcgcctggccgagtcgaagccacagaaacgcatgggtgacgaggcctcactccctatcagcggttgctgatttgataagacatgtcggccgttagagctgtgtgccgccaattagtactagtacctgatgaggtcgcttacgtggagatggcaccaataagctagtgactctagctgtaatcatggagacggacgaatgcacagtaccgtagattcatggagatcagctgagctagttctaaccaagcatgaaactagatgatttcgcatgaaatggttcataatcagattaaggttcattctatacacatattagaggcaacaaatggacataaacggaattgttgacttgtatatgtagttcttcaagtagaaaatgtgtctgtccgcgctgtactattaactgactgattggattagttcattcgttctgaacatctgatggagaaaatattgcgaaggggttggtggccctacgtttggtgcagggcattatgcgctaatgtgggatttgatgtggaccggtggagcatatccagcgacaagcagggccctctaggttgctgtcgcatttaagtgccttgttggggtccctgtgctccccctgctcattttccgccactgttctgaatctgccgcctaacctcttggttgaatggttgttagacctgttcagttcgttccacggctagtgccttcatctcccctcttctccgggaaaaaagaaaaggcttgcatttacgtacggaaaaggattatctaatttaactattgtgcagttgagccactgatatatggaccttactaaagtggaacccacgtatcagtgactcaactatatgtgtagttaagtcataggatctgctttccacgtatctcattgtgttgcatccaccatgctcatacatagcaggactacttgaagcgaaatgcgagtttcagttcaggtgtagtttctccttaggctgtgttcgttaataggggttgggaacccatctcctccgcacgaaaaagggagcgatccattagcgtgtgattaattaagtattagcta

SEQ ID NO: 25233 - DNA, 1501 bp, Oryza sativa
cgtttatgcgcgcgtgcgcagcgaggctggccgtgcactccggcgcggcggggatcatcgtgtcgaaccacggcgcgcggcagctggactacgtcccggcgaccatcagcgccctggaggaggtggtcacggcggcggcggggcgcatcccggtgtacctcgacggcggcgtccgccgcggcaccgacgtcttcaaggcgctcgccctcggcgccgccggcgtcttcgtaagtccttcgatcgatagccgatgatctatggcgtgatacatgtcatcgtcgtcgtcgtcgtcttgatggattgaattgcgtttgcagatcgggaggccggtggtgttcgcgctggcggcggagggggaggccggggtgaggaacgtgctgcggatgatgcgggaggagttcgagctcaccatggcgctcagcggatgcacctcgctcgccgacatcacccgcgcccacatctacaccgacgccgaccgcctcgcccgccccttccccaggttgtgaggacctcgccgccgccgccgccggcgaactctagccaaacaataaacaatatcgacgacgccagagagcacgccgattaattaattaggtaatttttgcaaaagaatctcgtcgatccacacgcgcgcaagcaacacacgtactccgtgcacccctcgtaactgggtcgttcatgctcttaatcccaacgattaattatactggtataatctttgtaatttcgagtactgtacacctatttggcatctgtatatctcgccttaagatatttacggaaccggtttatatactcctttaatttttaattaacggagttcaacatatatataagttacttcatgaaagatatggatgtgaacaggaacgaaatagtgctactctctcactttactatgctttggatcgagtttaaactgatatagttgtctaagtttgcattgagaggacatatagtgaaaatagatgaactttaagtttatggatttcatttaatgttttaacgggtcggccaaaagttagccgaccaatttcattaagatttggggggaaaatacagtaaaatgttacaacgacttacaataccgtggttgccagggaaagaccccagccaaccaagaacgagaaaagaaagtagggctaaaccccgcagacagtcatggcgattactcgcgaaacagccaccctccagacagcaatttcctcttcaatatcctccgcaagttattccggtgtcttgggcacatgttgaaaaattcttgcattacgatccttccaaatcaaccaacaaattagcatgaatgcactgtcaaaatccgtcctgtagctcgtccggaaacagcatcttgttaaattttcagggtggtagatgcctaggctaatctaatctagcaaggcgatttagccgataccggcagaaaccctaaagcgagagacagccgatagagctaaattgatatgctaagactagattaacagagacatgataaataggtagc

SEQ ID NO: 25234 - DNA, 929 bp, Oryza sativa
aaagtcaaaataacttagaacctgaaaaggaataatcttttttgacaaaagagtactattatttactccgtgttaatactaaaacaatgattctaaatattttaaaacatctatattctaatgttttggacctacaataaatttagtcgcatgtaggttataatatcttagaacaggttataatatcttagaacaaaagtactctatccatttcatttcatattataagatattttgactaaagtcaaactgctttaagtttgactaaatttgtagataaatatagttatatttatattatcaaattagttttattaaattaataattaaatctatttttaaaaaaattattttgggtcaaaaatattattattatttttttataaacttggtcaaacttgaagcagtttgactttgaccagacttaaaacatcttataacctgaaacggagggagtagtaataaatttcttccatatgccattatgcaaatagtggtaacaatatgctaaatagtcaaaacggtgacagagtatgacgatattgtttatgctcatggcaaaattcaactctaaaaacgtggcatccaccaaagggggaaaggaacaaaggcagacgatgtagtggtggaggttagttcttgtctttatttcagaaattttccgtttaatcccatatttgttttcttaatttttgtgggggagcccgtctttgtatctttattctgttttcaaaagtttagtattctgttttctttgtatggctctatctgttgatgtaatcgtctgaaattaataaaagcttcctttataaaaaagaatcgtattcgtccatatatgcaaatatacttgctgttgagtactcaacgccatcacaaattatataagagcatgtacaacggtttttattagtggtctctctctattacca

SEQ ID NO: 25235 - DNA, 768 bp, Oryza sativa
tcagtaacgtatgggtaaagaccaagataggatgaaatgaggaaatgatatgcttctgctcacaggtatcatactctatatcttcgatctttattttcatggattacgtgtggtttttgtaacaaatcattatgatccattggatggttggagtagctgtgaatgtctgtaggctttacgagctggcactcttattagacatcaaatgatcaaagtggtagtactatatccaatccaccaaactgtttctggtatgatttgatgcaacgcaaataatcctatattgctcagcaagtacctacctgttcatagttagatatgactagtatcaatcacgattgcctgcctggaattcaataccatggtccgtgattatctgaaccgatagctcgtaattcccgtgattaacaaatagacaccttttaatcacgcagctgcagccgcagttaccagttaggaaggaatgtgagaggcaatgggaagctattctcagcaacaagtggacgtcacacggaaggatcgatgggaacaagaccgtagccattgctattgctagtctcaagttgcttgtaggaccagaagtccaacgtgcacggctctttcccaaggtctcctcacattcaattcttgggtcgcaatcactcgcagctggaacacggcatgatttcagattgcagagtttggattggaattaggtttgattattcctctttcttaccattcatgcaagtttccaggcaaaacagagggagtaaaatttgatcgatc

SEQ ID NO: 25236 - DNA, 1048 bp, Oryza sativa
tactcattggaatggcccttttttttctgtgaatcttgtagtctgtacggctgtaccacgccaataattataatatgttgaattatgcaaaggttctttctagagttcggtgaaatagttgactaatgattttttttcacatcatgtcatacattattattattttttatatgctgatgcctctaacacgtctctccaggtatattgctaaaatgaggaatgaggccaagaggtccatttgacaattagtttggcttagggcgtattaactttgatgccatttcaaaccttaccaaagcaataataaaattttagtaaggttagtaatattgtcaaattttggcaagataactattttgaatatgttcactttgttaccaacgtacatgctactaaattttgatcattactgtgcagttgccaaatttttagtatatttaccaaagtttgataagaaactaaacagatgcacattttcgttaactttagcaaaaaaaaaaaaggatatgatttgaaatggcattaaagtgaataggcccttaatgacttcgaagagcatatctgcatatggtatgatactatgatgcattgcgctttagttggtgacactagctagcacaacactcttatgttcaattctaaatatggtacctcaccattacgtgcttttatttacttaggacagacatggaggaggtgagatcgcacatgaacctagaaagcacctcttaattgctctagcttagctcgaccaaaatacgtgaaagaagattggaaaaaaaaaagcaccatcactctctgtcgaaagagaaaaaaaaaaaactgccgtacgtcacatcctatttccgtttaaatttctaatgacgactcccatggtccaggtccagcacgagtgcacgcacaaggagtcaaggaggacaaatcaatcccccgtagcgcctaggagatggaccagatggtcgtgtactagtgtgccactcgcctcgaggtgtgtgtctcctccccttttaaaaccccccaacgaagaggcaggagcagccgagcagga

SEQ ID NO: 25237 - DNA, 754 bp, Oryza sativa
agcgttcaagctcgatgatcaaaccagctgcctgaacaagacgctactagcagattttctgaagaaactcaaggccctgaacaaaccatccacgcctgaacacatgtaaaggttagctagcgaaagcacgcgtcagggcgcagcatcaggcaagcgaccagcttttgcaagttgcgatgcgaagaatgaattattctgtgcgtgtgcagatgcaagaagacaaacccatgcgggaacagttggagcctgtagtgagacagaaagaggagcatagtgccatggtgggtttcagtgttctccacaacggaggcacatccactaatttgtagtattctatatgatgcctgaggtgaatatatgctgatgataatacagctcaggtagtaggcccggtgctgcaaacgtatgatgcgtatgtattgagcaagaggcaggggcacatacaaatactgcaccagatagcaatggcgagagaaatcagagagcgtaaattatgcttcctgtctctcacaagtgcgaagcagcgagtggacactaaccttggtggccacctagagctatcctagtacaaatatgtttgcttaaaaggtgcatatctctaaggtagagtacaagatcaccttgtaatttatcaactcaggtgctcttttggtcgggaggatccgaaagcacacagtgggaagtcagcaaaaataccaataaacatgcttacatgtaatgcattacctacttacctgatttctttatcttcagg

SEQ ID NO: 25238 - DNA, 1501 bp, Oryza sativa
tatcactacacaagttgacatctacaagaaacatcttacaatacaattttcttaccagtagcatttgcagtacaaactacagtaattaattactacagaattttgcatctcatcaccatgtctgtcaacctgcaggaactgaagatatcatcatcagattaattgttgtcacctttccagcaagagctcaccgtggggagctgctacaagtttattgcgatgactgcccgtgttcttttagctgggtcatcgttctgctatgctgttttttggccatcatgaacaccctgccgctgctgctacctgccattgccatcactcagacaatcttgtgaatttccttctttttcctagatgaagctgctgtacaaatttttgtgggagacgtgagtttcgaacaagaataagcgtgtcccgtagccagcgttaaacctttcccttccagaaatatttttcgagtgaattgaaattcatatgtgcctctggttattggagtggcattattgtgttctctctgtctcgcggtttgcgctataaagttgagataaatctgatcatctcgtggttcgtcccgtttatttcctcaggattgaatttaaattccatacatacatggctacatactacatttgtcaaaagaaaatccaacctaggtaaggatgtagtccaagtttgattatttttttttaagacggagagagcagtccctctctttaaaatatactttgcgagggagtagacattttgcgtgatgcctggtctccaatattgttagaggtgtgttaggacatagtaaaatgtactttctccgtcccgcaaaaagacctaatctaggagatgaatcttgacatacactatattcatatttcatctttagaattagattcttttatgagtatggtgactgattagcttatggataggttctttgtagtggaactaggattcatcattcatgtactagacaggggtgtttgcatttacaagtaatatgtattttttcatactccctctgtccctaaaaaatctccctaaaaaatcaatctagtaccggatatgacacatcatagtactacgaatctgaacatatatatgtctagattcatcgtattataatatatctcatccggtgctagattcgtttttttatgaaacagagggagtatgtgtttataaggatagtcggtaagtggcagaagatgagtgtgcgcacatcacgctgtgactctaagtttgtaccgtgttttttcccaaagctttttcccttttagccttgcaccgtgtggacatggggccaaatctaagtgatggcctgctaggcagcaacaatatagcatgggcctcacggcccatataggcgtttggagtgtgtgtcctcttgcacgtgacaccttgagaaacacggagagaaaattcccgaattagtggctaaacaactaaacaagtactcgtactaacttaaatttctataatgcataagagtactcagcaatccgcataa

SEQ ID NO: 25239 - DNA, 191 bp, Oryza sativa
gggtgaatctatacatcgatagtgtagttttgtgaaactacacgaccaaaatatatgtactcaagtgccaagtgtcaaagtgcgtgtggttttctgtaacttggaccacaaaatatgtagttttgtgaaatttactcaaaaacaaaaaaccgagaaaagcatgaacatggcatcaaactagcagataggga

SEQ ID NO: 25240 - DNA, 1501 bp, Oryza sativa
gggaccttaggttaaaattatacaccccttaccactcccctgtcaaatgcatctccctagattgtttgaaagcaaccgtagatacggttcgcccgtgaacttgcagcgcagcgggagatcaccgcccaagtctccgaccattttcatttctggcttggcagagttcacatcagcaatggcacggtaccaaacttcaagcatcggagcatactttatccaaatttgatttttaaattttcaattgatttcagtcttcagaatggcggacagttcttgaaaacctgcagaaatcgtaaggttgacggctaatccatgacttgcgcctcaaaatgctgaggcgcacgcgttacatgcctgatcctctggccgcccaaccccaagtacccaacacttcctatccaaaaacacgcactttgcttccggatgatagctgcaacaaaccatgagccccacatattggacactgccttgaaggatcactattatgttgttggtttggtttgactgagccacggcctggagcaacctgcttgcttaatcctctcgataacacggttaacacctgcggattgccgtggggaaatgctcgtcctctttgtttattccagaacaccagatcacaaatagccaatcatgtacttcctgtttcggcgcaagaggtcgcctacctgcacaagttctgtgcagctgcctgctagctccagcttcgtggccctcgatctgtgctgtgcccgcgctgtccatcccgatcctgtcgttcaggtgatcccgtattcaagtcatcaatagttacgccaatgtaaaaaatacgttaagacacttttaaattgtaggaataaaaatacacagaaaatttgattaagatgcaagggaaaatcaaataattgcaaaacaagaaaaaacaaagaaaaaccattgattagaccgtaggaaaaaaacggatgaatttcggatgagagtgatgaactcaaagaaaatttttcaagaatttcaaatgacaataggaatttcaaagatccataggaaatttgttttaacttttaaaaacttctcctctaaaaaaattgtacttttacaacaaattttctacaaaattaaaattctttaaaattcatattttttttcctacgaatcaaaagggcatttttctatctagactgataacgcagaaatgacagtactgtattcactgcgaggtgcgaaaagaatattccataatattatgactggataaagttgtatgaaaatattttaataagattaatggcgtgttagggagtaatggaaccggagaagtaagcgtagaccgagttttagcgaacgttgcgagaggcgggcggcctacaaagcgggcccgcgtttcccggcccacgtcagcctgccgcgcctaccgttgactctccccagcccgatccgaaaccaccacctccccaataaaacccacgcgcggacacagcgcacgcaaaatcgcaaatccacccacccaaactcacgaattcga

SEQ ID NO: 25241 - DNA, 338 bp, Oryza sativa
ccactctggcgccccaaaaaggaccatttctaggataagttttttcaggggtctatttgcgaaataagtttttcaaaaggacaaaaatgtgaaaaatccagtttaaattgtgtcctttgaccgcgatactagataaaatgtgtctctcaacttacaaaatcggtatacatgaggtcccaggatagtgtagtttttgattttgcagccaacccagttgagtcagcgtgggaccacgtgcgccccacatgtcagcagcctcttcttcctcctcttccctccttcccctcttttcccaactctatccataaatccaggatgagaggcgtggatagagacga

SEQ ID NO: 25242 - DNA, 1501 bp, Oryza sativa
ccaattgggactataaaaaaatacagacaaaagggcaacattgcaggatagagacatgactgatatatatgaatttatatgactcaatctgctggtttgtattttcctggaatacattactatacacacatgcgtgccttgaactgttgaacatataattcctccaagttgcaaaggaacagaacattcatgtcatcctgcaagtgtgagcgtggtccaaactaataaatttattccccttcctgtcaaatgggtctcactggattttcagttagattttgttcaaccacccatcacaccaaactttgatttcgaatccgatccaatcctctctttccccctttttatgccttttttttaactgatggtgccttttctattctcttttcatctctgatggaagtgacgaagtagtagtactatgtataagtagaaaatgttgtaggttggggggtcccactaacaggctgatgaaaagaagaacatcaccaaccaaatagcaggaggtgagggtgacagtataataatctctctagcagcagctattgataagcaaaaaatatggagacaatggggcctagtaatagtgcatactgcacagtaaggctttacttcttttgaatggaggaatttccctttgaaccgttcatttcaatcacaggattgagaaaaaaagaaattgaaaacaatgattttagtaggaatgcaagtcacaaaacacacatgaatgattatttgaatagaccataaaaaacgtagagatcgaataagagaaataggctttaaggaaatttctaagaggttagagctttaactaactttcctccaaaatctatttgcatcaagtcaatccctaagaatttcacagaagttgagaagctccaatcatttatttcaaaggactaaggatttgaatgctaataaattcctccataattcccttgtttcatgggaattttgggaatcttatgaagaaaaaactcctatgtggtgatttgaatgaaagaaatagctatccaaaaatccaatgaaattcatctggattgactcaaaacataggaaattggaggaattctaacatgagcttcaacctctttaaaagaaaccgtttatgtttgtctctctcttatccaattcctacgtttttcctacactacatccaaacggtcattcatgcagttttcctataatttttcagtccataggatatatttcagatgttagggcacttcaatcatgcttttttttttctgttcctgcgtttcaaaggagcccgataatggagctgaaatgtcggagaattgaatgagatttcccactaaaattcaataaacctcttgtgttttgaaggagcccttaactatgactatgaaagcttactctctgaagtaggggctattcggtagtgcttgctgcactgagctacaccaggagagcaaagtttaactatcctggtgtcaaatgaagtaaaagtgacccctaactgttctgatgtcaaacg

SEQ ID NO: 25243 - DNA, 277 bp, Oryza sativa
ttttatttttgttttatttgtttgatatttttttcacgcttagggacacacaagaaccatagaaaaattgaactcaaatggacgtaatatgtgacatgtagaatttttcctctcctctcctctctccgaactagtgcagaggagagagatgtgcaacttttttatttttattttatttttttgatattttcttcacacttaggaactcacaggaaccaactatgtaaaaaataaactcaaatgaacgaaatatgtggcacgtggaattttccaaagc

SEQ ID NO: 25244 - DNA, 245 bp, Oryza sativa
tagaccataactcctttagtaaaaccctttgatcagcatgttaaacataatgcactctaccactatatgaaattacttaatctaattcaaaatataaccacatgaaatgacatatataagtaaacaatacatagagatgcaatttttttatttttatttcatttttttgatatttttttcacacttaggagaacataggaaccaaccgtataaaaaataaactcaaacggacaaaatatgtgaca

SEQ ID NO: 25245 - DNA, 1501 bp, Oryza sativa
  unsure (1)..(1501): unsure at all n locations
cgggctattatttctttcatcgttcatcatgcagaccatgacatatgcctaactttgcctacatgacatcgattgatgcttccattatatgaatttacttttaatatgacaaactacacgagctgattgccaatatgctgcaatcttttttcctttttttttacatatgttgaaagggagatctggaagacactactagcatcgaacattcgaattgaactttgttatcaataagtttccaggagtagttatacatcatttctgagttctgaagtcgtttcaatgcaggaaaagcaacatctttgcctgcattactactactagtactaagtgtactcataagcctgtcaatgtccatgacctttcctagtttgtatcaacactatgacctcatgaatgacncaatgcttgatgtgcttgcagacgtccaacagtaganngcatgttatttggcttaaccagtccatcagaagtggatcttatttcaactgattagcattatggacagtgtggttttagcagcaatccacacgtgcaaagcatatgcatatgcgtactaccctgaaattcacaattggaacctcacttgtcgtagctgaattgatctgttctacctgaatcctaagagtgacttggcccaacaggcaacagcccaactattcctcgtcaatccgttagaatgtataagcagaagcggtgtgcttcatggactttgcataggcttcagattactaataaatcgactgtctaataattttttggctttcctgtctttcatatgtaatttatttcgttaccttaccatctccgttctgcagctgggcaccttgtaaaagcatcaattgcacaaagtgaaaacaaggtcactgccctacatgcagtcttgtgctcctggctactgtactgaacactgttcccaataataagtggtcagttaagtgaccacgcatcaatccaccttgcaagtttcaactttgcaagaggttaactgatttgatggcagctaatttctcaagaaattggttagtggtagaagtagctactttcacattctcatctctcacaccctatgatatgaccatcaatggtgtttgatgaagaatccataggccagactggccctatggtaaaggaagaacaagttttgatgccccccttataattcttctagcttttccatgtgccttcccttctgtaaagatggtgagaactgagaacaagaacttgcagtgcgtcagtgcttgattgatgctgcatgagtagtctagtggtagtagacacagacacttagtgatggtgtcatgtgcaaatgcagaccccttgtgtattgaggtgcatttgactggctgtttgccaggagatgtaaaggcatgataatcagaggcctgataaaccttatgacatctgtttctactttactgtatatgcggagtactaatagtacaataaattctcctgattatagttaacacattgttcatccttctatgtcgtggtcagg

SEQ ID NO: 25246 - DNA, 234 bp, Oryza sativa
atttttgggataagtttttctaggggtctacttgcgaaataagtttttcaaaaggaccaaaatgtgaaaaatccagcaatttaaacccggcctacataggacctaaagtgaacatattcgcagcattttccgtgtccctaagaccacggcccaaagggttgtttttgggccatgtggcacgtcttcaatccatgcatgcatggtatgggccttgtacagaacgcgtgggctgca

SEQ ID NO: 25247 - DNA, 1501 bp, Oryza sativa
gcaacgccgcgaagcctgacgaatccatgagcagcaacaaggagaacgtcactgccgttcgtgcgagatctcctgctcggccgagaaagaacgccaacgagaaagagaatcacttgcgatgattagttgatcaattggctcactcgagcctgtgaagctgcaagcatccaacggctttgttgcgaagccttttgatgttacttggtggtggggatgctgcctcggtgtccctcggcatggccggctgcggaggcaaatagaagtgaacctctggagttcctgtgaactgacccgctcgtgatgcaccgttgtttcactttgttgtcttttgttaagctatggctgatcactcaacgttgaatgtagacactttgtacaactcttgttgagatgaattaagttggttaatttatctcatggtaatgggtaacatttccatcagttggctcgcacttcatcttcgctgccttagcctatcctagttccttttgaaaaaaagtttatttgttttcagttacttctttcagtatgggtaatctttgggctcgctgttttgccttggaccgtgtcctgggttaccatgttcctgtataattgcttagtggaatttaacttgcattacagtagtaaatgcgtaaccaatcccactaaaatgctgccaatgtaggagcaaattggctcaatctgctgatcaacaatggaattcaaaacatgataatttcaatattgatagaagaactaatagtgtgtagatacccaacacgagacattaagcgagcactctaaattcactcctctagaaattaaccagcaaatgctatgagtctgcaaaagattttttttttttgaaaaaaaaatccctcttaaccctatgtatctcatttttgattttttttcccttagtgttactccctttgttctttgttatagaataaacaaatctagtactaaaggatgtatcacatctcgtgctttatttatttgggaataaaggatgtatcacatctcgtgctttatttatttgggaatagatggagtaattgttaaagctatattaatgatgttgtcttggtcttagtttattcaaaagaaaataattaccttgtgagttttgattaaaaagccaattattttataaatgaaatcagtaatagtagattattgacatggagttgaacctacctactatcatctgtcatctgtgaccagtttctcgtaatataaggcagcagcgactagtggctgtggttcaacagatacatctcggacactgttttaaatcggcgattgaaatgaattccctcttgtttcagtttgtagggactaaagttgtcaatttcttttagcagaaagattatggtccttgaaaaaaagtactgagattcacatgatcatacatgtgcatgttattagggcattcctaatgtttgttacaaaagttggtagtaagataagtccatgtcagaagacaatagtagattgaaaataaatcacaaattca

SEQ ID NO: 25248 - DNA, 1501 bp, Oryza sativa
aatgacaaaccaaaaaaaaaaatctgtgcatgattaagttataaacaataattgagatatacaagtactcactggtaaagcagggtcaagttttcctcccccaattaaggatccattctgaaagttaaaaggatatacatccttgccaaacttatgctcccggtcacttttccatgaaatattcttcctgttgacctttatttccgtggatccacaggtaaatccataagtgtcattgaacaagctccaggcaatcaagccacatggaacaattggaaggccatcattcctttcaataggatcacatgaactatgtgtgtacttctgcccatagcgtagttgcttatcacttctacttttgacatacctgtcagcatcaacaaattccattgttcgttaataatacacagagattctttttcagaaagagagagccagatacatcgatacaatgacaggaaattgaataaagttgtatcatcagttcatcacctgcgatgattctggtagaagttgtcgagttcataatacacataaattggtgctctcataaggtatttaacctgcaaagatacacactatgaatttctggcccaattacacatgatatggacaggaagaaacagcaacatgatgtaatctgtgcgccaaaaaaaccctagataattataatacaaataaaactggagagaaaaatcattatggaaaaaagggatgttagatctcacaggaataccttcacttcttgagtgcagttctttgaaatcgagctatctttaatatacgcctgcctatttcttttgtaagcattaggtacacaatcaatatcataacggtgagcaatttctgcaacctgcacacgcagaatatggagaacttagtgtgtattagtatgatccaccaactgatggtagttcaacatccaccggacagaaatgaaaaacaatttacatgatttgaagcatgaaggcaaacaagcccaacaggaacaaaagtaactccgatcatcaagaaaatagttatcacctgaaacaacgaaggtaataccatattatatacattaaacaacaaattaaattctgtagaaagcatgtagttgagtcaatgccaacttacacatcctggtgtcattgccggcttccaagctgggaggttctgctgagtgaacctatagaacactgcaaaaccaacacgattaactgtatgaccatgtaataaagtaggatttgcatatataataaagaagcaaataaaattaaatctgtagtctgtaaaacaaatcattctctcatcatctaatatagttcatcatctatgcgaagttcagcaagcgcaaataaatacaaaatactgcctaaaatgcttcaattatccatatttacatggtttaggaggaacgatagagatagctattcatttcccctccgccgattaacaccatgctaaatgacgctcgccaaaattcatatgtaagtatcatgaacacttccagcctatgacc

SEQ ID NO: 25249 - DNA, 437 bp, Oryza sativa
tggaggaggagtttattttgttgtcttatcgatcagatagcatactgccagttactcaatttcaaagggaacaagttttttaattcgattatcaagttcagaacaaaacaaaccagtcagatattattggagtccgtcttgcacagagtatcaccaggaaacaaacatggtcaaaaaaatttgaaatctaatggtttcggaagagacacgatttgttcgtgttttacataattcacaaggaccgtatatgctcttggtttgctcggaatctgacgaagccgcattatgaaacaaagtaaattcgggtaagcctcaatcccacatccatgtgtgatcaatatttcgaactaaaatcccggcccattaacatagatgggccaagatggcccaaataaagtcagaaaatcatgaaacccatatgctcgaatatttttagg

SEQ ID NO: 25250 - DNA, 1501 bp, Oryza sativa
aactcaggattgggttttttttgggacggagggggtagactggattgatatcacgaacggatgacgagatccgaaaaataccaccgatggaaaataaatcctgttggaaaaaatctcaattaaaaatgactaaacaacccctttcagatttttaacaataccaaatctaccctttcatatactacaaatatatacttccgtaaaagtcctcaaacaggataccccacatgagatccacccagaaggcgtggccatcatcagacatgaaggccgtgtcaacgtagaaccacttatcgaccatccactcgccgggaaggtttggccctcttgatcatcttccacgacgggagcgacgacaatggccgccattggtagacaacatctggccagctgatcaccggcatgtcccccggcttgtccgcgggtttttcttccactgccattttgcccagatacgttagagcgtagtccccttcatcatcatcaatggcggtggtggtacggcggcgcgtgacgagcatttgagtggtatggatcgtcgctttgtggctcgataacatcgggatcatggagagggactcgtcgatggtgtcgtagatgaggttgacgccaacgatcctcttggtgaagttgaggtagaacacgatcaaattcctgtccatggtggcgatgccggagacgacgccttgatcctctcgtctcctcctcccagcttcagcgtgaggaaggatagatttggcgcgtcggtgacaagcgctcggagcttgacgtgacacatcaacgatttggtgtcaatgtgatcgccgaacatgttgtcgtcgaatcccaagatcacttggtttcacaggggaggtccggggtgaatggtgtgctttttgcgaaaattttctatacgaaagttgtttttttttttaaaaaaaccatattgattcatttttttaaaaaaactagtacttaattaatcacgtgctaatggatagcttcattttacgtgcactgcagattaactgggaaccacgaggaatgaacacagcctaatagtcatgatcgaacagcaaatttatcctatgtatatatgtcgaaacatcgacagactgcaacagattctaaacaattatagtccttgaatggattataaatatgttctaccttgttttaggtgaaaacacaacattttagctggttaagaaacaagactggtgattttatagtacaaaacaagaagcaaagataaggaaaaaaaataaaaaatgagcagcagaaaatttgatggttttttcaatgaaaaaatgttttaggtgaaaacacaacatttttagctggttaagaaacaagcctggtgattttatagtacaaacaagaagcaaagataaggaaaaaaatttaaaaaaaaagagcagcggaaaatttgatggtttcttcgatgaaaaaaaaaacgatgctataaatatagacaagtcatagaccattaggaataagggaagacaatgaaatagctttg

SEQ ID NO: 25251 - DNA, 182 bp, Oryza sativa
aaatcccttatattttagggttaattggatccatgcccatcgtaaatatgccttattgaaaatatgccactactcttcacattattagctgggtgccattgaaaatttataaaattggaaccatgccactcctgtcactttttttgtcctcctatctcacgtcgccatcctccccgtcaagt

SEQ ID NO: 25252 - DNA, 1501 bp, Oryza sativa
tgccatcaaaaaaacaaaggaagaaaactatatgatctgcggtaggagtatgtcaaaaaaccataattacaccttgtttagatcctacctcaaaattttacaccatatcacatcgaatgtttgaacacatatataaagtatttaatatagattaaaataataactaattgcacatattgcgactaatttgcgagatgaatcttttaagcctaattgctccatgatttgacaatgtggtgctacagtaaacatttgctaatgatggattaattaggcttaataaatttgtctcacggtttactgacagattctgtaattagttttttagtgtccgaacactctatacgataccctatataatattggatgtgacacaccaaaactttacaaaggccgtgtttagttgcaaaatttttcttcaaacttccaacttttccatcacatcaaaagtttcatacacacacaaactttcaatttttccgtcacattatttcaatttcaaccaaatttttaattttagcgtgaactaaaagacatcccacctttaaacaccccctacatcctgcacgtcctgcgagtccgtgacataacagagtactgtaccctagttgtaggagtagtacgtaggagtagattcttcagagggacagtcgtacggctcaaagcaagcactgtatgaatagcacggacaactgacctttgaacaacgtaccagtgattcagcacaagttcccactgtatgcatggcatgcatatgatacagtaagatgaagttacagtggcaagtttggcctatgtgcatactgtagatgcctaaacatcgagaggttgcaacaggctctaaacaaaactccgttttgtatcaggtaattagactccttggctggatagtataaataaattgtactactaccttgtccgaggtgaaaacacaaacatattagttggtgaagaaacaaatatagcgattttatacaaaacaagaagcacagaaaaggggaaaataataataataaaaagcagcagataatatgaaaatagatacacaatggagacgaattttacgtgaaaaacccttgcggaaaaaaccacggacgctgattggcaatgatcactattgaggagttggatacaaacgcaagagatatattgggctgtcccaccctcctcatgcatgcggcttacaagggatatatatataggagaaatctaggagtcctaatagacaaagactcgaagtcctgataggaaactaatccgaatatattgtgggcctaaaattcggatcacatatttaacggcggatgatttgatagttttttttaatgaaaaatgtgtcacataccattagaaataagagaagacaactaaatactccaacaattgtaagggatgctcgagcataagaggtttctacttatcatgactaaagcaaggttgtctgtcaaatcagctataaatcagtactctctcgtctaaaaaaattctaattatgaatctg

SEQ ID NO: 25253 - DNA, 1501 bp, Oryza sativa
ttgtgtttacaaaattacagatctgtacccttcccgccctttgggagggcattttttctaaaaaaaaatcgccctctagaagagcggcaagtggcttaaatgtaaaatttaccgcatatgttgttaacttgtatttctataatttgaaaataggtcatatgaaatcggatgaaattaaaatttatatcaaaattgcatagttgaggatatctacagctttgtggttcacaactttttcatttaagatcgtttagagtccaaatattcgttataaaatctaaagtttgttttagaaaatctcaaatatatacttcaaatgacctttgatgaagacaagttttatataaaagctgtagatctaaatgagatctaaaactttgttgtttataatttttgtcatttaaaattatttagtgtataaaatgagtattaatatttatattgattaaaagcaacgataattgtataaaagcaaacaaaaaatttacatttaagatccttctcgcggtaagccttttgttttaaaaggaactaatcttctctagtaggttagtccacaaaacaacagaatccaaacacaaatcatctaaatgaggctatatttggagagctgataatcaaccggtcggtaaccagattattagaatatagagaaattggttttccggtttctagcttctagtttgttttatagattctttagcttttgattctttggaatatggatgatattatgcattgtttaagagctgaagattttgtaataagttacaactgctaacctcctccaggtaggcctgagttagatataaggctacatcatttacatggcaagttaagaaggacctcatcttttcgtttatgcttatacttatcagtcaaaatttaaatttccatccttaaatttgaaggtgattttgaggttttttccatcgaagtttatttttcagcctttgcctttagatcgttaaaaacacatttataaaaattttattcacaaattatttttcatttataaatatgtcgtttcgcttattctacaaagatgttcaacagtgcaaaaggtttctattccttcaacttgcaagtattcctgatggctaacattgtccgtcagacgaacgatatgcggctaagatcgaggcatgacacgagttttcggaaaaagaccttacatttcattttatttatctcacccatcgaaaaagcccttccatggtatggaatccataccgtcggacggacattgtacggcgaaggtaattttccatttaggctctcggtttcactgtactccaaattaaaagaagcacacctactactccacttcgatggcaaccacagtgtagcacgagaccgaggaggcgccagctcgactccgcgcgagccgaggcctcgaaccctaacccccattcgatttccggcgagatgcccacccgcgtctgaaccttgctcgtcggcggccaagtggggttgggccgggggccggggccgccaagga

SEQ ID NO: 25254 - DNA, 677 bp, Oryza sativa
cttcatcctaaccatggcaggcaaggtgttacactaaaaagggcaaacttgccgttgttaaactgacacgtgtggacaaaaatgaccggtctgacactggtcgcatcagcaacttgcaccacatcccacgttgcgcctgtctccgccggaagtggaggtaggtgtggcctgtcccatcaaaagggctcccggatggaagccataccgatctccgcccattaaagagaaaaaaaccagtccagttagaaaagaaacgggtgcatgtggtatccccttgaagtataaaaggagaaccttgccttagagtggggggttggttgattcttttccggattgagagcctagaacggggggggaagccggctcacactttgtagctttttcatccacagatacaccaaaacacaggagtagggtattacgcttctcagcggcccgaacctgtatacatcgccggtgtctcgcgttttcttgcgggcagatgatctttccacacaccgagagagcttgagatttcaccctaagcccccggccgaactggcaaaggggggcctgcgcggtctcccggtgaggagctacgagctccgtcatctggcgcgccaggtaggggactcagtgtgtgttttctgagctctcagactcttccgtgtgcgccaagtttttcttgttcagcctaa

SEQ ID NO: 25255 - DNA, 406 bp, Oryza sativa
cgatctggtcctccgggttcgaattctgggggatcggtgctggtgttggtgttgccgttgcggttgagggatatcgagtagctcgttgtccggtttttgtttttgcgagagcggaggctgtcttatccgtgtgggctctgggaaaattctggggatttggatggatctggtaatccgatggatgatatactgttacaatcattcggagacgttaagggatttatgtgaaaaatgtagcattatgttcatggagagataattgaagatcgttactgttatatcttatgaagggtttgttatcgaagaattcgagtgaaatgttagagagtttctacttggtttcgtgcaacgttaggacagtgcgttattcctgtatgacaatgctgatatggtttgtgcagctgaa

SEQ ID NO: 25256 - DNA, 447 bp, Oryza sativa
acagttgcgcgcgcgtacccccatccaccgcgagtcgccgtcccgtcgtccggttcgcggtgtgcggcgcggtgcatgcatgcgatcgagcgatgggttgggcgtgtgagtgacggagagcgacggtgtcgggggacggaggctgtggccatggctttgtgggggttgggggacaggctgcctggttcgacgggggtaatccgaaagcgaaacgaaagcgtaccgcactgctgatcgatcgatcgatccgacccacactcgttttgatttaatcgcggctgggctcgctcgaacgccactgggacatcgaattaaggagagggattaagagagacgacaagaagacacaatgatgggattttttgcttagttggggtcctgcaatttggttgcccgcattaacccgcctgtcccctgccgccctcccaccatgtttgcacttgcagg

SEQ ID NO: 25257 - DNA, 1501 bp, Oryza sativa
tttctgcggtgaagggtttctcgcgctgcggggccgcggatttatacagcgcgcggccgccgcgggacgcgatctgcgccgtccgttttccatcggaaggcggggactcctgccctagctcaccctcgtcgaatcacagccgttgatcggggccgatggatcgtgggccggaaaaccaggcccatgggcacagacgtgtgggcctatagtagcgaacaaaagcccagaaggcccacaggtggttcagggctcaggtcgtcgtcgtcctcctcctccgatcccctcgccggcaaacggcgcgccgccgttggtcgccggccgccgccgtccggctcctctccgatccatttttggtatccatctctgcatttgattcgttcttttcgggcttcacgcctctgctcccgaagtcggaggctaacctgtattgtatttgttcctcttgttgctggagggagttgattcgattttgccgcgtcggattgctcgccggcgtgaaagcttactagggcatcatggacggtatgcacgcgcttgccctcttgtaatcccctttctcctactgctctctggttattatgtgttagtctggggggagtagaaagaacagtttttattagttaggggtataatttgtgtcttagctgatagaatgtgcagttggtgattagtgcggacctgggttgattgtagttgcatgacaggcaatttagtggtaagccgagttaattttggatttaacaactgcaactacaaggaaagaactctttttttgcactgataggcgatctgaattatagtgatgtgcagtgtgaaaatcactttgaaattcattattgtcagcattgtcatcctgagtagattgccaattatatgggtttggaggacaataaggactaagctctccagtccatttcttgtcttgaaaaatgaactccatatcatcctacagaatatgatggtaactttaataaaatttgtgttgttatctttgtattgtaagaaaggatgtaatcaaaatacggtgaacaaagcccttatagagtcagtccggacatgttcagtattgcagtctcatcgtatagtatctttttctcaggtgcctcttaagttttttctctctagtataatcttccattgggctttcaacttctggaagttgtgctgatttgctgcacacaatgatacccgagatttgttgattagctcagttggtgtctttgctctatttcccctccattcatgtaaatgatatcaagtttggtggaatgctggtaaaaatcctcttctagctgcataaccaataaagcatctgcaagatactacttacctacatgacattacaatcataactaatctcccaatatgctgtgtattcatacgtaatagataagagaatccagccttagattctaactttgtgatcatgtatggcttctgcttgtgcccgtgatgctattgtttcatatctgtttcccaatagtcgataaacaggaaacaa

SEQ ID NO: 25258 - DNA, 1501 bp, Oryza sativa
ctctcgccaacacagagtcacagaggacgccgaccactagctggataataatctgtagggtcaacgcgtttctttttcacctggcataaacgtcaacacttacacgtagcctccttttggattgatatggaatttttaactaatatataattccgtcttccagtcgtcgtcttcttcagtgtaacatttttccaaaagggaacactgaaagttgattgcgagttcatacacaccttggtcggcacggtttcctcagccgtggcatgccattcccagtgcctaattccagggagcaaacgctttccttttcatctcaacagtgcacaaaccctaccaaaccaaaccatgatctgaaatctcgagtgaaatccactactgtggagtactagtcttcaagagagatcttcagtatcagcagtgatcagtgacagactgacagtgacacaatctcattgtgtatttgtttgtgtgtgtgttcaagaggtcaaccttatagaatccggtcaacggatttcttaggatctcaaacatattgcatccacatggctttacagcgtgtgtatccacatctatggattttagtcacatgagagacatgcttggctgcactgtttcttttctccatgattgtaacatcttcaagtccaattctgattatagcttttgtttgcgagtttgttgaagacgaaattgacagggtacactgaaattgcaaagagcaggttgtacattcagcaaatcagggtggcctgcgattaatcttcaattgttctattccctgaatttatctgacttttccgacagctaaatactactaggtgtaagccattttcactgtccgaaacgttaaataatttcgtctggaaggaatacctgttaacagttgtaggatacttgaattaaacagcccagagcatatatgtgccagcaggttttgcgtttttcaaatttcagattcgagccccgaatttctggttcctgtaatataagtgtatacctcctttccattttcaaccaacagagaaataatattaattaccatagctacaatagcagtgtgtaatcaccgtagagatcccccattaattaccattctctaatggtaacaagctgtgaacacatccttatccaaggtgggctgtaattattcaaggcagtaaactagtggttgtaatctgcgttgtaattattcaaggtcagtaaaatagtaaagctagttatcccagcattgccagcttgtacattgactgggcatgccccatctgtttcttttcataatccatccccaattatcaggtagagagaggtcattagtacggctatgaatggcacgctgccacctaatacatcttgaggatttctcattaaacaaagaaggagatggatgattattcttgctctgactttggtcaattcaaagatatccgtcagacaacagcacaatcgatccaagcacgagcccacgcagaaagagtgaaagatattctgatacatttggttg

SEQ ID NO: 25259 - DNA, 1501 bp, Oryza sativa
aaggggcctaattgtcaaagtgccatattaatcactctctctgatcttaaatgctcatgttatcatcgggtactattcaaacctctaatttattttaagaacttcaaaatgtagctaattagctaattttatgaagtgggcgtagctcaactgattagatttctcgagatggaatcaaaccatctgatttaagtcctatacttaaacatgagtgttcgcatttacggctaattattcttttggtggtaaatgacgtacccgtgtgacggagctcgtagctcctcaccgggagaccgcgcaggcccccctttgccagttcggccgggggcttagggtgaaatctcaagctctctcggtgtgtggaaagatcatctgcccgcaagaaaacgcgagacaccggcgatgtatacaggttcgggccgctgagaagcgtaataccctactcctgtgttttggtgtatctgtggatgaaagagctacaaagtgtgagccggcttccccccccgttctaggctctcaatccggaaaagaatcaaccaaccccccactctaagggcaaggtcctccttttatacttcaaggggataccacatgcacccttctctttccaaactggactgttctttttctctttaatgggcggagatcggtatggcttccatccgggagcccttctgatgggacagcccacacctacctccactcccggcggagacaggcgcaacgtgggatcgtggctgcccgttgctgatgcgaccagtgtcagaccggtcattcttgtccaccacgtgtcagtttaacaacgtgcatgtttgcccttcttcgtgtaacaccttgcctgtaatggttaggatgaagcctggtataaatctgaccagggctaacgtgccatcttttaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaatgcgctgtgctgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaagaggagggcggacacctcaccctcgggcccgacgcccccgaaggtgccaggccacgtgggcgattatgtctgcctcaagcctctggtcatgatactcccggtcccatatcaccgacagtagcccccggcgttatgccagagcaatttcctttcccaagggaagcggtcaggtgtgacgccacccctaaagcctggtgacaggtgggaccggtctccgtagttgggcaaaatacccaacggtctcaatccatgcacatcggtattggtaactttgg

SEQ ID NO: 25260 - DNA, 266 bp, Oryza sativa
gtacgcatagtgcgaacatattctcctttctgctcgccatgaagaggaaaatctctgcagacatgcagcctgtctcctcggcggagtgtagtctgagatgacgtgagctttcggtcgccatcgacgtatcatgggtggcatcgttgtggtgcagttggacgcttccgaaacaatcagagaaaacctcgagaagaaagaaagggagacatgcagagactctgtctgtgctgtccaggtttgccttcccttttcttcctttcatcagt

SEQ ID NO: 25261 - DNA, 1501 bp, Oryza sativa
catgaatgagacagtgtgttaaatcaactcaccaaaaatcgcataaaaatatctcgtcggatagcaaaaccacgatataataaatcgcctgatctgcagctcgcttccgtcctagggtttaaccaaacatccacactctaccgcacctccttacgctcaccgtacacaagatcaaaattttccaactatacatttggaattggcattcaagcaactcctacttaccatgaatgagacagcgcgctaaatcaactcaccaaatatcgcccggtttccacctagagggatatatatctcgcccgagagcaaaaccgtgatggatgcaggccagtagctcgctcccgccctagggtttaaccaaacatctacactcaccgcctcactacgctcgccgtacacaagaccaaaatcccttcgagcaatcgccgccccagtaacaaatccaacgaacacctcgagaacccaaccacgacacaatcgatccaagcaccgagagcccgattcaccgaccacgcccaccgcgacccctgcgaatctaccgccaaaaatgagcgcccccccgcgatcgtaccttgcaaccggcgtaggaggcggctcggccgccgcccccgacgagctcctcacctcctcccgcatctcccctcccctctcctctcctcacctctccccctcgccgcgccgcgtcgccgcccctctcctcctcgccgcggcgtaattgggagagaaaaaaaaaattccccgaccgcgacgcgcagaggcagagttgggttccccggccgttacagccgttagccctcgccgtcaatcgcaaaccctcacacctcacgccgtcacttagatgggccgggctttaatcgagatcacatgggcccaaacgttgaggaggcccagattccgcggctcgcttcgtcgtctcgtctagctccgtctcctctcgcgaagtctcctcgggccattctctcgccggattcggatcccgcggcggcgagccgactcggcggggggatttgccggcgggatgatggaggaggcgagcacgtcggcgtccggtggtgggggggccgccgcgaacggcgggcagcggggcttcccgccggcgagatcgggaggtgagtccgtacacgtagcttagctctgacgacgggctcgcttcgatctggcgtcgttgaggtcataggctggaagtgttcatgatacttacatatgaattttggcgagcgtcatttagcatggtgttaatcggcggaggggaaatgaatagctatctctatcgttcctcctaaaccatgtaaatatggataattgaagcattttaggcagtattttgtatttatttgcgcttgctgaacttcgcatagatgatgaactatattagatgatgagagaatgatttgttttacagactacagatttaattttatttgcttctttattatatatgcaaatcctactttattacatggtcatacagttaatcgtgttggttttgcagtgttctata

SEQ ID NO: 25262 - DNA, 1501 bp, Oryza sativa
tcggttctcaatcggtgtcaataagggcttttgtagtagtgtatatgtatgaacgaacatttgaaatcataaaatacagggcttgtgaactatggtcacacgcatatatcgacagtagtataagctacggggaaaatatcgttgcatacatcttctactcattaacttgtcaagttaaatttgtattatatgaccttacacgtctttggtttgattgatgattgattaattaattgtttgatctagacaactccatgtatttttgtgattagaattgcttcatgctttttctatatagacaaatgattatagaggggtgaatgttcagaaattattttaacttcacaagaacaacactgaagaattcaatttaatgtacatttaattctagctggcaaattacagtcaaattaaacaagtataaattaagattgacaggtaatattgaaagatcgaagctagcacttcattactaggaagaagtaattaattaaggtggcatagaataaattgcacaagtatattggattctatttctcaactgctatgcataaaaaaacagtatatagtacttgcaacagattccaattacaatataatgtaaacttgtgctcacaaattaaagaaactgaaagcctaaattgatttatcaattatatgtagtacatgaaataacagtaagcaccagcacatacatagtagattcaattcatggacagattcagagaaggagctagctagagaccccaattaattagacacccttcaagagtatatatactagctacactcatattatttctcagaaatacttcacagagagagtacgcatgatcgatttcggtgctcacaataattatttgatccggctcttgatcattcagagatgatctagtctgacagccaagaacaaaaattaaaccaatgcacaccttcttctgacgactatgaaaatcgtcagaacgacctcgtctcgtctttgtactagctggaaactagctagtgtatgcctgcatataattaattaaacagcgaaaagaaatataatgaatcaaatcatagctagtttgtgttttgccgtggagatgatattggcaggctcatcataataagcatgtgcataatagctagctaggcagaaaatttaacaggagatctggcaaagaaattactgtcaactgagagaaggagattaatcatattgggcatggtgaacggctgacagatagagagtgagcacgcacagctcccagcatggctcttgcatgctaagaaagcaccgtgtgtgctcactctcttctgtcagacctccaaaacccatagagatctcttcccctctcaagacaaattaactgatccaaaaaccccaagaaattaaattaaactgttctctttctttgtgaaaaaaaatgaacaagcatgtatgtggttgtggtcatatatgcaagaaatgaggccggatcagcagctgatcatcatacacaaataattaagcagctta

SEQ ID NO: 25263 - DNA, 152 bp, Oryza sativa
ccgtgctaaccaactctcatgcgtggggagaagaccatcaaatccaatcgggaaacccggattaggacagaacaaaaacctagctagattccgagcagcagcagcagcttgaccgctacaaaacgccgacggtgccgccgttgttcgctagc

SEQ ID NO: 25264 - DNA, 1501 bp, Oryza sativa
gcacagatgttacagcagctttgtgctcagagagtgtttggacacactgcagagttttaaggtcccatacctgatgaatagagttttatggtcaaatactagtactaacataatactccttagtagccaacacagaagcacaagtttgcacaagttttgcagcattaccatactttgatggtcttgtcaagtgagccagagtaaagccttgttactgagacaccgagcgaaatcacttggcgctcatggccactgaggattgccactggtccagagtcacccttcttgtcaggaattttccaagccatgatgcgaccatctccggtaccagcaaacaacatctcatccttgatagtcatggaacaaaccagaccagaaggttcacggagactggacttcatccctgtttgtgtgttccatgcctacaattcattgtagggatcaatatcaacagttcaatgcacaatagtaacatcgcaatatgtaacacaaaatggactactcccacaaaaaaaaatcaacgaaattaaaatattacctccacggacttcgtgattccaacaaatatccatgggccatgggtaatcatgcaaccaatcttgcctcccatcttgatggcatcaacgcactatgacagaaacattaagaaaacaatgcaatgtaataaatattagaatttttttatcagccagacacctatcttttcctccttgttcagtcttctctttccaagaaaatataatcatcaatcatctcacatctttttttttcttttttttttactttctctttctttttttcactactttttttttgacaaaaccatgtatggaccatcagccagagagaactgtaatgtaattccagagagccccttgcttatcagccaaaccagcctcattgccttgctcgcaaactgaccctgatatactgatcaacagtacacaagcaggcgaaaagattcccgtaacaattcggtccggcatgccgataaccccaatcttgcaaagaaaaaactgatttggtaccaatatgtctgaccacaggaagcaatcagatagtactccccaattgatctcatggaagcacttcaaagaccgccacaatcaacggaggaatcgacgcagatgcaacccccaacttgaatttactcaacttgaatcgtgcgtaaagagcctgaagggagtgccgagagcggagagcccagctaccttgccagagttgcagtcccagacgcggacggagccgtcagcgctgccggagtaaagcttgtcggaacccacaggcagagagatcccactgatagcctgcagcgttggacaattactcatcagaagattaggttatagaatcgacgcaaattcctctcaatcagatgattaggttatagaatcgagcaaattcctcactcatcagatgattaggttatagaatcgagcaaattcctcactcatcagatgattaggttatagaatcgaccaaattcctcactcgtcagatg

SEQ ID NO: 25265 - DNA, 1501 bp, Oryza sativa
acatttccaatttaatcacgtgattacttatgcaaaccacccgaaaacagagttcagcacggcattatgaacatcccatccataaccatcatgcgccctgtcactggtgtcatgtcagttttcggtggtgactcgcatgtagatatcccattttattgccaactgaacccatctacttctaataaattcgcattttgccaaacaacctgaaatcttctcattttaagtgactttaattcgaggcagataaacggatttaattagagatattgagcttaagatcacaatctctgaactttctgaactctgaagtggtcctgcggcctctgcctgtgtagggaagcagtggtagcagttgatgattcagctctcggcttcctatgaggtagcaaaagacattattgaaaagaagtgatactaaatgccatgacatgtttaattgatggagcggtaatggtaatagttcttcactcagagttgaacagttataaaccggtggcactcgtaaaaacctactagtagtaaatgtagaaaacaataaatgtgaataattgtagcagcagcacgaacgtagaactacatgtttcagatctttaacctgacaaagcaaatccatcttgcacagtgcacacttcggtagtaaaatagtaaaaattcgtagtttgcactagtctgaatgactcaattagtccgaatgactgaaattccacggggaaatctccgaatttgcagctttcagctcgaacagtgcgagcacatcgctaattgctgaaattccattgttgcgagtactatactaccaaagaatttctttctctttcagatcataaagatcactttgtccgaaagccaggcaaagatgcagtgaaaaactagagggtaaacaaaagagaacaacagcaatggcttggctttcccgacaacggggggcgcggaaagtgaaacgcaagaaaagcgcggtgctttcttgcttatttttatactagtactactactaatcagctaatcaatctcatcctcctctctgcagcagcagcagcagagcgtgccacactgccacgcacacaagcacaagcccaccgatggcagcaataatgcgcacgcagtggtggcagctgcagctgcggcagtaatggccgggttcccgggtgttggtggtggtggccactactagtagagtagagtagtagcgaggtggcgtgatgatccgggaccgggaggagtagagtagaccacccttgatctgcaaggcgcgccgctcattgggtggccagcgtcgaccaccgttttcttggccccgtctcgccgcgatctggtggtgtgcgggcacggctcttcttgccaagaagaacacgcacctagaagttcttggtgcgtgttctttgggtgattttgttttgcttcttttttgtggagagatttttgaggtttggattggttggttgctgatgagaaagattgcggctttaggtttttgtctcggttgaggggcgcggcgcca

SEQ ID NO: 25266 - DNA, 1501 bp, Oryza sativa
ttatgaagggattttgctgccattcgacaacaggaaggagctgctcaatgcatagaacacgccaagaaaaactttatataaataaaagatagaaaagtaaagtagatagtaaacagtgcagtttatataccatatttggtgctaggcacgaccaccccaaaaaaagaaggtttcaacatagtgtcttttttttaattgtgcaaaagctacgtagtgctcccattcaacatagtataactgcattagcattgaaatgcagtttaaaaacagaaagtaatgtgacttaactcttaaactaagtttaatttagttactacatcatctgaaataaaaatgccctaagtgatttagcagccagaaactatttgagtgttggagaatagtaatgttcaacacaagaaaatacgcacaatagtactccctccggtcaaaaaacatgtcaacctaatatgcagtttagatacacaaaaatgtcatcttattgactattttaactggttaagtagctaaataaatttgtgcctgaaatttcaatgctataaaacttgtgcaaccattgctacagaggatgcaggccagagtagaacttacatgctcctcagaatgggtatatatcacttgaaggtctccagactttgaagcagcccagatctttacagtcttgtccagagagcaagataatagtttttcatcccaacaaagcacagatgttacagcagctttgtgctcagagagtgtttggacacactgcagagttttaaggtcccatacctgatgaatagagttttatggtcaaatactagtactaacataatactccttagtagccaacacagaagcacaagtttgcacaagttttgcagcattaccatactttgatggtcttgtcaagtgagccagagtaaagccttgttactgagacaccgagcgaaatcacttggcgctcatggccactgaggattgccactggtccagagtcacccttcttgtcaggaattttccaagccatgatgcgaccatctccggtaccagcaaacaacatctcatccttgatagtcatggaacaaaccagaccagaaggttcacggagactggacttcatccctgtttgtgtgttccatgcctacaattcattgtagggatcaatatcaacagttcaatgcacaatagtaacatcgcaatatgtaacacaaaatggactactcccacaaaaaaaaatcaacgaaattaaaatattacctccacggacttcgtgattccaacaaatatccatgggccatgggtaatcatgcaaccaatcttgcctcccatcttgatggcatcaacgcactatgacagaaacattaagaaaacaatgcaatgtaataaatattagaatttttttatcagccagacacctatcttttcctccttgttcagtcttctctttccaagaaaatataatcatcaatcatctcacatctttttttttcttttttttttactttctctttcttttttt

SEQ ID NO: 25267 - DNA, 159 bp, Oryza sativa
  unsure (1)..(159): unsure at all n locations
ccaaacaccagtagatcctaaattgttaccgggtgtattgcaaacaatgcattctggaatcacctcttgcattcacagtggttaggtgaacgctgaccagtccatcctgtcaggaaacgttaagcagatctgatatcttttcnccatgtcacccgcagt

SEQ ID NO: 25268 - DNA, 1501 bp, Oryza sativa
tgaattagaaaaatattaaattataattaaatgaaacacaaaatttctgaaatatttgggtattttttaagtaggtaggtatataattaaattaatttataagtaaagtaagtgtgagaaataaaatgttatggttggatttattttttattaaattttctatattaattacactcattgaaattttcttgaaatttacatagcttaattgctatttttataatacaaacatcatttcagcatttattgaaataaaaatctaaataaaaatccctttatctctatgggcctttttcagcccactttcttcttcagccctcaagcgaccaaagtctaattaatatccccatactcctcctctcgcttgctggaccaccggcccgcgtacggcccaagtggtttggcccaacgctcgatcgatctgagccgttcgttttaatggacggctcggataagttccaaattgatgagaaccctaaccctccccctccccccgccaagcgggccacctcccccgccccggatgccgcctctcccctccccctctccccattggcgtgcttcccctcccctaccctccagcggacccctccctcccagccgagccagccgcctcgcccgcccccgatgccgcctctccccctccccctttccccaccggcgccgcttccctcccctcccctccagcggcgccgctccctctcctctccccccgtctcaccggcacggcgcggcgatggcaggatgcggcggagacggcagaccgctccctctccccctctccctcccgtctcacggcgtggcgcggcgacggcggagacggcggagatggccgtccctccccctcttcctcttcctctccctgtcggcctcgacggccatccctccctccctacctctcggtgacggtgccctcccaacggcggcatccgcgctccctcggcgacggccgtccctaaggcaagcgtcgacggcgacgatggcgtctgcagcgtccgcgggtggatccgttagcagtggcggcgaccgcgggcggatccggcagcggcggcttcctccggcggcggcatctgcggccaccatttttttcttttgcaatttttttccatcgttattgctaaccaaatcggattgcatacagatgaaaacacggacgaaaattagatgtgacgaaaggaaaaatacgaatatttatattagttattagttatagatatagattaaatgataaaatatgaataatactttatgcgtaacttattttttaaaattttttcatatatattttaaataaaacggattgtcaaagattgtacacggaaacccatgaatcaacttattttgggacagcatgtgtgtgtatttttttttaagaaaaaattgaagctcctactttaataagaagggaaaatatcgtgagttcgtgacttgttgcctggtggccctggtcacagtcacagagctagccttatctctatcttcttctcttttttttttggtg

SEQ ID NO: 25269 - DNA, 656 bp, Oryza sativa
ctctggataagggccaggttagttcagatattgcggctgatacggatgagtcattgtcagcggcatgtaaggtggtcaatgacaatactgtgcactgccaggcagtaggtaatggctctccccgcgtattcaaagggccacgtgggcttcgtgctggatatagtgcaggtgattacagatgtgcctaattatatttctagtccaagttcgcttgcgagaggtgattttgtgtctgtctactgagtatgtccacattcaagtgttcgactctgcagcgagtagctaacaagcaagtggttagggttgtcaaggctgaattgtattgtcccgcgttctgtgttctaaagagagacactaaaagaaggggagggcggtcatccgcttttgcattcaccagatataggttagacacatgcgttcgccacgttgtgccttaggctgttcattgggtttatggtatgtatgtacacacaaataatggaatgctgcattagttcatgttcatcatgttgtcatatgagtagacttcacgtcatgggctacaagatgaaaggtggtgaaagtgcactagatattaagtgtggagacgagaatgatatgagtcattcacacttgtatgtgtagcaagagttactatgataattaatcatgcacga

SEQ ID NO: 25270 - DNA, 1501 bp, Oryza sativa; identical to SEQ ID NO: 25195

SEQ ID NO: 25271 - DNA, 642 bp, Oryza sativa
caccacaaaatatcaagaaatttatctgagattacaaatcaatctaatatatattgattattgataacaaattgaaacgaaaaactcaagtcgagcagtgaggctggatcgtgggtgatagccggcgacgcgccatgcaacatgtataagccccggcaactaactgctaactcgatgttctttcggtatgacgccattatcggagatggccggcggagcacatcaactgtcatacatggaaacaggaatcgaacggcacatgtgtacatgcaatagaaagcaattagtagattaattccagtctgcatatacgtgttgattaataaatcaacagatgcgtgtgtttaatttgctcctggcggcctgtgctactccagcaacacgtccaactgcaaggaaaggaagagaggagcactcggacacggcaagggcacccgagcaggcgacgatgatggccgtgtctcgatctcatcgagtatatgaaatgcatcaaaatatcaggaaatcaaacaacgattaaaaatcaatctaataaaaattagattggaacgataaacccgattaaagatttgagccgtcgaaattgatgagattgatctccgggcttcttctgaagttgattccatcgcacttttcgacagg

SEQ ID NO: 25272 - DNA, 1501 bp, Oryza sativa
gtgccgcgcgctcctcggcggtcgcgtcgtctagtccttgtgcacgctcggtgtcgaaacaagatttcggcaataataaaagggggtggctatcaagctaggaaagtgaatgggtttggagaaaaagaattttatacaggtttaggccttcttattcaagaagtaataccttactcctgtccggggatgattccgccgagtatgttattgattgtatgattgggagaaaaaagaaatcgtcccgagaggaacccggacccctccttatataggggaagggatccgtaatacaaaatacagtccatatcctaacggaatatgggattacagataaaatacaatcgtaaccgactagaatcctgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatctgagtgcttcaattcaacttgctccggcttaccgagtgctagaagactgtgaagggcgaaaataaaacatggtgcatcgagtagatgcacctaattaggtgtaacccccgactatgtgattagttgaaaaattaaacatatagtcaagaaccgagtgatcttatatcgaagcatgcatggtactcaataaaatacccagccgactgcttctcacttgaatatatcaaggacaaaaaatatgaaaagggccgagtgataaacactcaaaggtccaaaaatagacatgtttgataggaatccgagtaagaatctcataaaatgacccatcaaacatgatagaaaatcatggtaattaatgagtctaatagcctaggctgtgacccttaccataaccaaaataagcatataacatgctgggagaatgactactaacaaaccagtcatctcaaattaacccaacagctttcgtagcctaaaaaagcttacaaaaatggtataatacctttatgttgggcaccttttcatgtgcatcataataattccaaagaattattgaatcgcgttaaaaaggatttcaacagcatcgggccgcatcattgtgagcacatattgccaaagcaaaaagcgcctaagtccctagggatcacaacgggccacgctgaaaacataattgggctgaagtactgtacaggccagggcccattagtactcccgataccctaaaaacaccgaagtccaaacgtcgtttcgtcttccccgctgagactctcgccattttccccatttcctgctacagtacaaaattgcgccgggcaaactagggttcatcaatccgctccaatccacccttaaaaaacttcacgaaatctcttcccgcatccaccgctccgattccccatccctttccagccgtatctcgaactaaatcaaatcatcagttctcattca

SEQ ID NO: 25273 - DNA, 244 bp, Oryza sativa
taccccatacccacacggcatggttatccgactagttataggggataacttatatatatgaaatatgtaacagattatgacttgggtattacgtttccctgtatattatggaacggcctaaagtcctggtttgataagattgtaaagtagatttagtaaaccgataccgtgttggttaaggtttctatcttgtaatcctgccccccatcctatataaggtgggcaggaggccctctagggggca

SEQ ID NO: 25274 - DNA, 403 bp, Oryza sativa
ccacccctctttatatggcacagtgtgacgggggcccaccagccattgggctgggcgcccccgatcagggcgcgggtcaaggcccccttgagccgttgggctcaaggggagggagatccatctaacatgtggcattatcttccatgcattaatctggggataacgtgttatgtatcctgattttctatcccgaaacatataaacgtgtcaaatgtcgcattaatttgttcaaaaaaggacaaaatttcctttctttcaaaaaaagaaaaagaaaaattgctactccagttttctacattttcagatatatgtgttgctatgctagaaccccagcatttcacatctgtatagcgtgctctagagacaagttgaatctgtggttatacaaagttcttcagtcaac

SEQ ID NO: 25275 - DNA, 243 bp, Oryza sativa
cgatgttcattttgattttgattgtgggggggcccattttgtagtgggcttaatatgagataccggaaaaacccaccaggcccaaatacaagtaagcccgcggccccagaaaaaattactactgcctactcgtctggtctggtctcccagactcccaccaccggagaaggctccggcgagaaagggcgaggggagatagagtccgctccggcgccaccgggggcggcgggggcgatgtccgcc

SEQ ID NO: 25276 - DNA, 1501 bp, Oryza sativa
gatgcttataaatggttttgatcagatacagcgtaaacatgggcaaagataccgacttcaaatttagcaggtttcagaagtgaagttcaatgacagctacatatatacaaagtcatccaaattgacacgaggttttgcttcacacctactcaaatcaagatcaagagaaatggactgctactgcagcaaccttattccatctgaccaaccgactggtacttgagagccgaacaatggttgctcagagacagatgtgttacatccttcttctttttcttttttctgaatctttctcctctgttctgtctcgatgcagattctgaaaaataagttgaaccgccggctagtcaggatggaaggtcaactgccagaagtatataggcatcattttattttgggtttaggtttggttgggttgaatcgaatatggataatgcattacttgagcagcctgcctccagtgatgccttccctaaatgcgcccccgtgttttggatcaagcaaagaacactcatgaaaaggtaaaaagaaaaaaaatagtagtcactctctctcatgagtcatgacacagaggcactgcatttccatggatagtttgcttgatggtacaagagtgctttactcggggggtgtttagatctagggttgtaaagttttggcgtgtcacatcaggtattatatagggtgtcgcatagagtgttcgggcactaataaaaaaaactaattacagaatccgtcattaaaccgcgagacgaatttattaagcctaattaatctgttattagcaaatgtttactttagtaccacattgtcaaatcatggagtaattaggcttaaaagattcgtctcgtaaattagtcgcaaagtatttaatacttcatgcatgtgttcaaatgttcaatgtgacagggtgaaaaattttagggagggatctaaacagggcctcagtagattttcagcaaatttaatttaaaattatttatcgattttacaagaacaatagcactaaaaaattatgtaaaccatccaaattaattatcgctcttgttttgatattccaccacataacctattttgttgcaaaagcccactcactcagcactgccaagtccatccccttcacaaacatttgattcaacccatttcttctgacatggattcgcagcggaccatatcagtgtggatagttatatggctagctatgaggttagtttgactcaagctcgtccttaggttagttgactctaacccgatttcacctcacaaccacattttatgagacgatatggctgataagtaccactataaatccacgtatgaagaaaaagccgaatagatattcatgtatgtagagaggcagagataattttgacgtggcaatgttggttggataggcttttacaataaaataggtattttgggatgggggagtaatttgctatggcaaaattgtttcaagcattgaaacgatgtttagctgtctcccaagtcccaacttgta

SEQ ID NO: 25277 - DNA, 1501 bp, Oryza sativa
gacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgtactacctgattggataacacaagtgctaacttggctgatggttttcatccctcatcattaacccaatgcaatgctgataccaccgagttgtgacaatgtgttcgctcttggatgtgcaatgcgcgtggatgtgctatgtgtggttagtgtgttaatcttgttataaacgtgtgttctgacttgtgagtgtggtatatcaatctcttataagatgttattgttggaaatttggtcacaattcagcatattttaatccaaaatattaagataataaacatgacgcttataggatatgatctagtgcaattgataaattggagcatcatgaacatgtttaatactccctccgtttcaaaatgtttgacaccgttgattttttagtacgtgtttgaccattcgtcttattcaaaaaattaagtaattatttattcttttcatatcatttgatttattgttaaatatacttttatgtacacatatagttttacatatttcacaaatttttctaataagacgaacggttaaacatgtgctaaaaagtcaacggcgtcaaacattttaaaacggagggagtataaaataagcatcaccatacacaagacaatgcaataacattgcgactgatagtagcagaaaatggagaaccaacagtaacggtaaaaggttatacccaagaatggccaaaatggagaatcaacggtaacagtaaaataaaatgttatactccgagaatggctctccgctggagtttgagaaagtattgcatccccgagaatggccaaaatggataaccaatggtaatagtaaaaggttatactccgagaatggccctccgttggagtttgccaaagtattgcatctgttgatgttgttagagtttgagaaagtattgtaccagttggtgttgtcgttcccattcacctccttgtctccggtgttctccgtggacatgttggtgaaggcgcagatgaacaggagcagtcgcatgttggtgaaggtgcagatgaataggagcagtcgcgcgtagtgctcccaaaaacttgagcgcccgcctacccgtgcaagaa

SEQ ID NO: 25278 - DNA, 252 bp, Oryza sativa
agaaatcctgccaaatttttggcaagtttgtcaaaattttggcaactataccaaaattttggtaaaatttggggctgctcactttgctgccaaaaaaaccttactaaattttggcaatggcaactataccaaaactttggcatgatttcttatatagttatcaaaatttggcggcaaactaaatgtagccacttttttttttgacaactttaccaaaatttggtaaggttgaaaatggcaccaaagtgaaca

SEQ ID NO: 25279 - DNA, 1501 bp, Oryza sativa
tatcatttaagaacaccgtattaaaaacacgaatattagggaatgacctaatatcaaattattagaaggggcaaggcttcaaaccaaaatcgtctagcccaccatcttgtggagctagccggaaggccctgggaggaaaaaatatgtatgtgggtaacaagattaaaattagttagttaacaatatgtaaaaaaaattctaattatgcatgtggacacattatttttgaacagattttttaaaaataatgaaaataatttacatctcctacctctattaatagatgtgtaggtaataaattagataaacataaaactcgaggttatgagacaaatgcatgtatcccttttgatcacagcatcctacttaaataccgaatagaaaacacgtagaataattctataggaatatcacatttcactctgatgtagtatagtatatttaaattttataaatgttgattgcacggttagttcttgatcacgaggtttgtatgtgtgaggattaattagctagcaaaaggagttgcagtgaggtgtacgtaattagctagctagaggcaggcggttgcttgctgtgattaccggtgatgacgtcgagctcgagcacgttggagatctgtggcccgtgccggtaagtctgcccgctgacgccggcgttggagagggtgccgccgacggtgaggtggaggtagtccgtccacgaccgcggcgccacgccgcgcgccagcgcggcgcggagcacgtcgacccacagctgctcgccgccggcgtccacgtacgcgccgtccgccgacacgttgatccgcggcgcgccgccgccgcccatggactgcatgtggacgacgacgccgccggcggcgagggcctggcccatggtggagtggccgcggccgcggaacgagacggtgaacggccgccccggggcggcgtaggcggcgcgcaggagctccgccacgtcgccgggggagcccgggaacagcacggccgccggcagcgccgccgtgatgttgccgaagtccatcgacgccggcacggtggcgttcgggtcggtccggagcttgccggacgcggcgaggtcgccggggaacgggagaggcgccgccgccgccaacggaacgccgccgccggcgccatgcgcggcgagtgcatgggaggaggcgatcagcgcggcgatcagcaggtaaatcgccgccattagcggcgcgtttaagctcgctaataccactttaattaatccgcgagatcgatcgatgagagtgtttggtaattagggattaataagggtgttgtgctcttgcacttgaacttgcacacctatatatatagatagatgatctatctaattatgcgtgtacatttatatccaggagattgttgccaaaattaaagcattaaatcacaatgggattctttgacgtataggtgatcttcagtttctatttctactgttgaccagagaaaaaaaaagtaatatgtatacgtgttgattgccgtagaat

SEQ ID NO: 25280 - DNA, 942 bp, Oryza sativa
ctgtggatgaatcttatctgatactcgataatgagataatttttttagataatggatatcactcctgcctctacatcgataatgagacatgtttgatgctctgtttggagtctctactcgataattcccaccgaagcatttgggaattgggagcctcagcatgacagcattttatgcagacatggccctgatactgcaactcttcaatctcctaatttgattggctgtcgaaaaaaagtctctctctgcgtttatctgtatacacatgatatgattcatttgtacctgtgacactgtaactttgtacagcgagtgtaacttgagttgagcctttttctttcatctcttaacctgtctcagtatgcactgttcttgaatctggttgccaagctgttcttgaaagtgacaaccagatcagtacatatgaaacatgatgttgaagtttttttctaaattttttttgaaccttcttaatttaaaaataaaatctcgcaaaacctatttctaaatctaaacctattggtgtggcaaaacgatacagacacatccactacaggtagggtggcgtggctaaaatgttcagattcggaaaaaatatttttaaaattaaaaattaaaaaagaataaaaaaagtaataacaattccatgatgaattgagaaaacaaaagccaggatgtcagcatgttgtcatctgttgcatcagtggagacaagacaaaccagtttcacaaacctggtgagaaagtgacacgtacatgtattaggtgagagagacagcatcaatcagacgaaacacagcagagaaaaaccttaatcatgattatacttatacagatacagataatgctgtatcaggccagcgtatgaacgtatctgacgatgtcatgcacgtcagagcacaaattaatcaactttaattcgtttgtttaatccgattgcagg

SEQ ID NO: 25281 - DNA, 1501 bp, Oryza sativa
ggaaaaacacaggaatttgaggagagataaagactcgaaggattttttccataaggttctacctcttgttaaaattcctccaaaacttatatgggaagaggcattccataggaattttataggatttcatagggttcattcctttgattcaaagggctttgtaggaaaaattcctataggaatgaaatcctctaaaagaaaattcctatgaatttcctttgaatcaaagggaccgaactctgcaactgatggaattattatgtatataggccgagtttacttccaaactttttcttcaaacttttaactttttcatcacatcaaaacttttctgcacacataaactttcaacttttccatcacatcgtttcaatttcaaccaaacttctaattttagcgtgaactaaacacacccatacttggttttattttcggtcttttgttctctgtcctttttatattgtcgtggtcaagtcaagctgcacacttgcatgcacaggtgcccttgctcgctctggttgatccggtcaaaaacgaccagctgaatgatcgcctacggcttatggctgatcctgatgccatgcatctccattctccagtcttacaaactccagtagcagttttataatactaccagtagcttttttttttttactcttgacaaatttattggcatgatttgaagtttacagttacctgataagctttcataaggccctttttatacggttcgggttccaagatttttcggaaccggtaatttctagttttacaaatttatgatctaataaatcaaccattacattgctaatatttagatatatcattttatttctattttaaattaattttaaaatttaaaccattatgatttaatgtaacgtacaaagttcaaatatgtcgtggatctggagttgtgcaaaacatgacctattttttttcacaaaataaaatgaaatccgtgctccgtttcatagaaagatatttaactatttgtcagtcttataaatggttaattaagggtttgtcaccggatccatataaaaaatcgtgagacgtaaattcttaattatcgcatctttaaagtggtaaaaaaaagttaaatgcaccggcccctctgaggttgcgtggttaggtttgaaacaaagcacaatctggacgcccccggcgcgccaccacacgccaccgcgtgatcaagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtcgccatttcaactccatcctcgcgtgaacgagacgagacccctccgaccccttcaactccgcgtctcctcctcctcccccctcttaactcctccctcctcccgatccaagaaaccggagcaaatcgtggccgatcttgtgttctagtgagttgctgcagcca

SEQ ID NO: 25282 - DNA, 1501 bp, Oryza sativa
tttcaaactactaaccggtgcggtttttgcaaaaaatttctataaaaaagttatttaaaaaaatcatattaatccatttttgaagtttaaaataattaatactcaattaatcatgcgctaatgactcatctcgttttgcgtatcttcccaatcctctctccctcaaacacagcctaagttttggatgcacaacgtgcacaccatctaacaaattccacttaaaattctagaaaaaactgtacatgtgcttccaatagtactacacatacatgtaaagtctccgcttcaaagttatttttatttcatccgtttttttttataaaactaatagttttaagaatataagtaagttagaatttggtctctctctatatataatgaattttttaaagagacttcacacacaattacaatactattggaaatacatgtataattttttcaagaatttttgaggatgcacccgaaacttatttgcataggataggttacctccttaagtagactagtgtcagagtaatatattaccagctcagttttttcgcgaacgcgcaaaaggattacacgtcaatatattagaagaaaaagaatttttgttacaagggaagggagaaaaagcaaagccaaaaactgaagcttaggaactactgcggcagctaaaagcaactcctaaacagcgggaaggggcaaagccacgctatcagctcagcttcacatagttcttttcacttagccaaagtagagttattcacactgttccctgaagctggagcaaattagaggattgcatcttccggctgtctttttgatgtcacaaattttcagactatttgagatcatttgcagtatgaggaatctccgatgagcccgctggcatgatggagaagtcctacttagagttgtagacaaagcattggacataaaagaaaaaaaaatcctacagacagagcaacaggatcaacgagtagtgaacctccaatgttgccaaacaagtgatgatgtgttgcttcagatgttcatttgatcagatatgctcagatccttacaacttggcaggtgaatacaaatggtggatcctgcttacgatatctgaaacaagtttcaacaatcaacaccgatgaaacttccacgtacctctgttgtttcgttctttttgtgcttttgtcatccataagaacccaacagtacaatctcttgagcgtgcagcttactctgcttgcaatgcatgagacatgacaacacagcaaaggttagttagcagtgtacctggaattagacaacatctgaagggcatcaccttgtctgcagctgcattggccatgcaatcaaagagcagatgggagagcagagcagtggagattcctgctgtctctgcataatttgcctcataccatcttctcaacctcctgattataagtagggagagttggagcattagcaccaccagttcatcatctgctcccaacactcagagtctgaggcatagcaccaaatttcattc

SEQ ID NO: 25283 - DNA, 1501 bp, Oryza sativa
tccgatggtgctgccgcgcagtggattgagctcgcgctcatcttcttggagccggcaacgatggctactcgcggtgtcccacgctccatgaagatggccgcctcgtcttcctctcgctagccgatctactcgcaacagcggcatcaccgctgaatcttcttgggcggtagagttggcggctgatctgttggtggcctgacgacgaccacgatggctctcggcgacgacaaccatgacgtgcagcgccgccgcttccccttctccccttcccgccgctttgtgggccctgcgttagatgcatgcagttgcaggcgaggctctcgaagccaaaacgagataggggaagcaaactaaggtcatgggccccatctacttttttgtccaccacagcgagtgtcctacgtggctgagcgagtccacacgctacataggagcgctgtgaatggcctcaaagagaagagttggttaaaggaagtttaatagtatagccaattactagctctaaatcatctataatcaatttaatagccaatttatacaatagttacctacaaacatatactacactattaatatctggtcccacatatcacacatgttgcttcttggagtctatactgcagttagctataaatttatagtccgctgctcttctctcttatttttatctccttaaaatatatttataattggcttatacctgctgttatattagggctttgctcgtaccatagatgacgtcaaaaggagaaaaacgatctctaaaatttctttctccccatcgatgagagatgagggctatggctgtggtgcaatgtgtagcatagatggctactactcctccggctagtggtaattgcttgttgcaggagggggaaatgatgatgctagatttggggtggtcggggccgtgtggaccaaagtcaagtcacgacgacgcagccacccatccatccatccatcctcaaacgccaaagcagcagcagcagcagctagcataggagccacccagtggccactgccccgtagtacgtccatctccagccatgtggtccctacgacgccgacgatgacacaaaatcatgcgacacgtttcgcctcctcgttggccgccatcacacaaactgctctctgctggtacagcctctcttcccatgcactctgccatcagatttctcatatcccgggctgtaaaacgtttaacgtactgtaactcgtacttcaagtaagcttgtaagagcaagtttaaatagtatagtcaactactagcttcaattaatttatagtcaatctaatagctcatttatacgatagttacatactacactattaatatctggtcctacctgtcatacacacactgtgtcttggagtccgtgctacagctggctataaatctatagcccgctgctctttttccttctcatttgtctccttgaaatatgtttgcggctggttatagcatgctattgtacctgctctacgatgaggagtatatact

SEQ ID NO: 25284 - DNA, 1501 bp, Oryza sativa
tcaccctatatttgatctttacacttgagatatgtaatttttcctttcttacactccgaactatcttgaactttcttctcgagcgcatcaatgcctttaagcgtattggcggctacatgtcggtaatttccatgcaagcaaccctttatcatatgagagactatatgcgactcgagaacagagttatggtggtacaaagcgaaacaaatgcgaatttaccaagccaaaagtgaaaatattggatttaaaatgaaaagttgcatttaattgtgtgattagaaaaggttccatttattcagtgaggtcgaatagaaggccagtgactcaaacaggaaaaaaaaattggtggtatgcaagtggggtcgagggaggatgattataatctaaccatcatggtttaaattctcgtgtccatgagtattacacacttatgaacatgtgtttagtggggtgaggcatttgtcgctatctccgtcttctatgtgcaaatgaaaaaaagcgtcacaaatctctcttcaatggagaaaattatctcgtcgcttatgaagcataaagtttcttgtaaagaatttaaaaacagaaaaaacacagccaccatttttgcatgatgcacatataataaccatgaaaaagatacgaagtgagtgtagctctattagtttggttcaagtcctagatttgatatgggtgatcgtatttacggctatctattatttattatttcagtgctaagcaatgttaccgttgacggtgaggcgcatatagtgacttcgtcaatctcaatattttataggtgttcttagagatagagtgtgcgtgtataggggaaattgtgcgcgcgttgtgagtgtccgtgtttattccatgtttctaaaaaaaacatgaaaaaatgaatataaacgtttttcacataatgcacaaataataatcacaaaaaagtgaggaaaaaaaatcctataggagtattcgaaaacaatttaaatccagggaaacttgataaaaataaaaaaacaaaccaaccatattagtagtatactttccttgccttttctcgacagcgcaaggtaagcaagcatcgccaaggcaagaaaaaaggaatctctctgaagagagggaatctccttaccgggttgctcccgtcgcaccggacccgacaaacgcaacccgaaaccggagtcaagtcaacacgcgcggacacacgcgcttcccttccccggaacccgcattgcctctcccccaccctctcgcaggaagaccccggaaggatctggaagctgcaacccccaccgtccgatccagatccgacggccccacgcccgccgcatccgcttcacgcagcttccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgaga

SEQ ID NO: 25285 - DNA, 1501 bp, Oryza sativa
gtaaatcattttagcattttctacatttatattgatgttaactaatctagaccattaacatcgatatgaatgtagaaaatgctaacagagagagttactagctaagctattccagtatccaatgccatgcctagttggtgcagatgcgtgacaggctttcagtgggtcgatcgtcgaagctggcccgtttatttcccaaaaagtttttcgcaaaaatatcatatcgaatctttagacacatggatgaagtattaaataaaaataaaaagaaaaactaattacacagttatggaggaaataacgagacgaatcttttgagcctaattagtccgtgattagccataagtgctacagtaaccacatgtgctaatgacggcttaattaggctcaaaagattcgtctcgcggtttcccggcgagttctgaaattagttttttcattcgtgtctgaaaatcccttccgacatccggtcaaacatccgatgtgacacctaaaaatttttttttccccaactaaacacgctttattggtagttaatccatcatcagctcgtatatactcctatcttggtagcttcactttttatatttgatggagaaaaatatcatggggtaccacatcacacgctgtcacgtactgattcgtaaaagtgaaagtcttgcgattgatcaatcacgatgcccgctcactgtggtgatagcacgcgcacgcaacgccatcacacaaatgatgcgttctagcacggactggtccggtttgcaacccctatagtcccgttgcgcttataaaacgagatactttttagtcctgattttattggaaccgggattattgtggaatttggtcgactgaccagaatttttagtcacagtttttattggaaccgagactattgtggaatttggtcgaccgatcaaagatggtttctccggtagtgtagcggcggcaaccaatgaaattaacctcgtagtggtaaacagtgtgttttacacagtacgtgtgtacgaacctgcccgtgttttcccggcacggacagatgttctagtaagtggtatgaacctgacagccgccggcggcggcggcgaggcgccggaggtgtccggccgtgccggtaaaaaagaacatgatcgatcgatgtcgtgataagatgtggacatatggctgtgccgccaccaccaccactagcttttgatcgattggaaaaaaaaaaaaaagttcgagcgcgcagccctggattgcggcgcggcgcgtgtggttgtggtggtggtggctctcgcgcgtggtccaaaaacgtgcgacatatcaggtcatctccccagtcgcgtcgcgcgcgcgggggatcggagagaaaaccacggggcgcgcgcgacgtcgtcgagacagcgagccccaatccaccggccacgcaaccacgacaaccgcacgcacgcgttctccagtggtcaccaccgcgccagccgcgcgcatgcatgcgtcgcgcgcgcggcagcttccgctttag

SEQ ID NO: 25286 - DNA, 1501 bp, Oryza sativa
ttgatggcctcaaatatattgttatcaaataaaacacattggatataacccatttacaataaacaaattcttaattatatcggataaaagttaaaactatatttttgtacaagtaattctaaattaggactactaaaaaactattgtaagtatttaggtggaaaacttttaaatgtagctacactattaacttctatcaaaagtcttttcgatagcttccgaagacttccatccggaaaactttcatatgaaaattttcattcgaaaatctttgttacgaaaacattcatccaaaaaacacaaggaatttttataattaattttcttttttttctccttttccctttcctttttgtttggtttgttgcccttttgtggcacatttactcgtctcttacttagtccttttgtgtgctcttgataaatggttgaatttgataaaattggaaggactgcactattaacttctatcaaaagtcttttcgataacttctgaagactttcatcaggaaaactttcatatgaaaattttcattcgaaaatctttgttacaaaaacattcatccaaaaaatatgttgggtaagcagatgcgctaaaaaacaatttttataattaattttctatgtttttctcctttcccctttcctttttgtttggtttgttgcccttttgtggcacatttactcgttcatgtaatgctacatagtctttttgtgcactcttgataaatgattgaattcgataaaactggaaggatgatactattttagtacatcaaataaaaaaattggagtgtttaagaatcacttgattatttttccccttatgaacaaagaaaagtaaattatgatttaaatcatatggataaaatgaatatcaagtccttttgaaacaaatgattagctcatgaaagatacctgaaagcatacggaacaatctattccataggaattttgtggaaatcaaaacgtgttttttcatttttcctatttcttcatattcactttttttttcaacgtgccatttaaaacatcattttcttcatgttccatgattttctgtattttcgttatattcttgtgctttcaaggtcccgttcttttctccaacaagagttggatgaagattaagattttcgtggcacgcttttcaaactgctaaatggtgacttttgtgcaaaaactttctatatgaaagttgctctaaaatatcatattaatctatttttcaagtttgcaatagttaaaaataatcaatcatacgttaatacaacatcgttttacgtaaaaaaacttaatcttcatcttcatcgggagaaacgccacctaaaatgttactccctccatcccctaatataagagattttgatattttgcttacactatttgaccattcgtcttatttaaaattttttggaattattatctatttttttgacttactttactatccaaagtactttaagcataacttttcgttttttatattcgcataaatttt

SEQ ID NO: 25287 - DNA, 1501 bp, Oryza sativa
cttggctgctaggcatgcacatgatctcgtcgatgctatcatagatgctcttaagcctcttcaagccatcgttcatcgtcctgatggttgaagaaggtgaggagattgttgcctttaggctctgcagctgttcttcgacattggtttcgctggaccgtgggctggatggcgcactcgcagatctgagatggaatgccattatatttttctcttgttttcttttctctggagatggataggaagagaaaggaaactgtgctgcaatggtgtcgacctgggcatggtttgcctgtatatataacgaaaggagctcaagcaatggcatttctgattgtgtagacagccatggaattgttgtgctgctgcaacagaagccacccaactcctcgacaagctgatgttttttttcatgtaagaggcatctctagctcagctaatgattgtaccatcatgtcccgattattggcggcaaactcagctgcacgagcgggttgcttagtgttgaattcaagttcaagatggtgagaccaatgaagcatgcaatgaaatgggagaatcaatcatgcggtttctgcactagcatgttactcctgcctgccgtgctaaactgcaaaatgttcttatcagttgtgagttgtcatgctgcaaaataaggacacattgtgacattgtcaaccatctctaacaagttgatgcttcatgtcttaggttgtgttggcaaagtggcaaactcatctgcacgagggcgtggttggttcttgcttgtgtgagaggattcgttgttcttataaatgacagccttggtccattgacatttcagccattatatatcactctgttgtcttcacagcattgctgtcatgtttcagttgtatggtacagcacatttctctgttcaagtgttcattatggatatgatccacatttagtgcattttttcagtgtattaggtgccgttcgtgtagatgagtttatgttttttcaacatcagtttccggcatcagtctttgttatagtatgtttcagctgtctgcggttagtatttgatgttcatatgccttttattttgatattatgcatgtttgatcctttttcaagtacaatgttggtgcctcttaagagcttaattaccacatatacattttccagttattggcgagaatgaaaccagtagcgcactggtactaagccaaacaggtgcatgcatctttaggtgattctaaatccaaaatctttttaaggttttaaaccaaacatatcaaaatatattaatgccaaaattggtcaaatttcgtcattaccaagttttgataaaattgaaagtgtcaacaaagtgaaaggacccgagatgcgcattctctgattctcctccatcttcctcatcagcttgggccgaaattgacatgtgacgcccatagtaaagcccacacggcccataacccaccacgcgtctcttcaaatttccgcccctaaataaaaataaaacgaaataaaagaccaa

SEQ ID NO: 25288 - DNA, 1501 bp, Oryza sativa; identical to SEQ ID NO: 25199

SEQ ID NO: 25289 - DNA, 1138 bp, Oryza sativa
gaaaagggtttaggaagatctcgccgatggattattgctgggagtggtacaccggttattcaggtatattatttctcggtataatcgacgagaaccaatgaaacacggacaacctttgcaaaagaaaaaaaaaactgctcggagtactttattcgttttttggttttaactggtttactgagcggtttcttggctcaaagatggttgattagcaccatataaccaaagcgcagtggcttatctacaattttatataggtgatccaacttatatattttttaaatatataaaattatcgtggattattttctcgattacatggacaaattaattgttttttttaaagactgtctatgtaaaattgcagtggtaagcattgcagcgaaagaaagtacggagaaaatgatttttagcaataatccggggtactatataaaattaatttattttctaagtatgtaataattgaaatttaattaatcatgcactgacaattttattatttttcgtgtcctaacttaatcttgattttcgatagaaacgatcagtaaatttatcacacctatacggagtgcaagggcagaactagatatgagagggggtgcctaggaaccgttcaagaaatttgtttagctatagtttatctatttttaacatatttgcaccttcactcaattcaaattcagacatatgtatcagtctaaacttgatttaaagtaaatgatacccctctctatttgacagcgtgtatatgtcagctttatggataccacatatctaatagtagttgactaaatcttggcaggacctaccacatactatgtcctatatggaaacaacctacggatataggaggagttccggataaggaaagacaaccagagttctacatggaaacaacaaagactactcggattgtatccatattgttttccctagttctacttggacgaggggacacctataggtataaatacaagccccccaggaggagaggggacacgagacgatcaacacccaacacaatcgacatagaagccacaacatagaagcctaaatacgccaaaacacgccgccggatatcgacttcagggataagcacggctagtaccctgcggtgtctccggatactgtcagg

SEQ ID NO: 25290 - DNA, 325 bp, Oryza sativa
tgccatgccattctgcaacaatgagttaaaacagattaaatatgaatacccacaaataatacgggatagaaagaaaagtaatactagatagacagatcctacatttgctttggcttctatatgtgcaccacgttcaagtagcaattttgctgattcacaagaactgtttttcacagccatgtgcaggggtgtctctccatactgcagaacaacagaagcagtaatttatatcttaagctcagagcatacaattagtgtcgcagaggtgccaataaggctgcaacaaatgccagatacttcaattaccatgttctttgcttccagc

SEQ ID NO: 25291 - DNA, 459 bp, Oryza sativa
tggtgattcgcaatgaggagcacctgtgggcgttaaagtgctgcatcggacatcttgaggctggagccagactcttgatactgagacggatgcagaccctggttactctactgaacattcttagctcatatatacttcttaagatctgacactcttaagaccctgcgaggggcatacgtctttcaaaggagaggctgatccttcccactcgcatatggtataggctcactgtacagcctggaaaatacatgaagagagacaaagttttgatccaattcttgatgcgcacttgatcctctggtgttgcagagatacatgacgggctatgcaatctaatgtacatataatcgccctggcatatgactgatgcaatatctgggccagctcacgatattactttcatgtgtttgataccctacaggcgaactgatatatgatgcgccatatagctatcaaaaa

SEQ ID NO: 25292 - DNA, 1501 bp, Oryza sativa; identical to SEQ ID NO: 25203

SEQ ID NO: 25293 - DNA, 210 bp, Oryza sativa
catagacatactgcgtcttggagtccgtgctacagctggctacaaatctgtagcccgctgctcttctctctcctgatttatcttcttaaaatatgtttgcagctggcttatagcctgctattgtacctgctctgacagacagcatctgggaggtgaactggcaggattctgtttgtctaccctccaaatgatgccatatcttacaaatcc

SEQ ID NO: 25294 - DNA, 1501 bp, Oryza sativa; identical to SEQ ID NO: 25205

SEQ ID NO: 25295 - DNA, 1501 bp, Oryza sativa
agtaatatagttttcctttattttattatttttatactccaaatgattgctgatatactgatatgccatatggcctcacacatttttcttctagacatgaatatttggaagcaaacaatttgcgctggtccacaactgcctagttgtttatatattcatgtggccatgttacttcacacccgcctaagccaataattagtacatgatcttagttttggtgcatctcacgctacattcatgaaacatgccaggcccaagctacaaagctaaaagcttgcaatcagcacaatattttgtgggtgtgtgttcttagaggtggatcagtgttgatccctccttttatatttgttttctttcttcttaatgcaatgaagcacaacacacctgtgttttcaaggaaaaaaaagttacatcctaaatttgctgcatgatcacatagcttacctagtattgtgttcttgtgtatatattatttttactgttttggagcactgatacacatcttgataataaagcacgttttaattaagttcagaagtaaagagaatttcttttaagcacagaaaaacagtataattatagtgtgcacagcaagacacagattatcttgagacacatctcaagtttatctcagcaaccacaatttaaccatgcaatgtccatgaaactcataactcattggctcaccaggtatgtgcctcgacttggagaaagacatatacttattgagaaagaacaagattttgtcaacttcttgattgattacactgtctatgcaagctttggtacaaaaacataattttcacagaagactgatgttcatcattattgactgttacatgaacagttagcacagatagttccaattcacttttgaaatgctttactacgaaatagtcacatagccaatgctagtttctatgccagtggatcttgcccccatagctaaaataggccagctaccataaacaaagttgagcgggcaagcagcatggattgcacataatagaacacatgttgaaattaacacgagtattaagaaatagattatgcatgtataaaagatactactctggtagcactctactaaaattatcccatgagagcatgcaattatgtctaacatccacaagtagagtgaactaacctgctggttcttgttgccaatagttgggacatgacaatgtgatagctcacttggaagatagatagcagtgcataacaaattattataacatacgagagattccatatgctgctgccagatctcaaaccttgagagacagcatcggggaggtgaactggcaggattctgtttgtctaccatccaaatgatgctctgcattgcacatcaactgaataaataggcctcagcaaaaagctagacatatcaaaccataagtttcctttccttcttatctcttggattcatcacaaagcgccagagtttttgaaacagacatggctttccaccaaagatcaattagtttgccttctaggc

SEQ ID NO: 25296 - DNA, 1501 bp, Oryza sativa
cttgctaggtcccacccctagatgggcccccgctcggtggaccccacgtgtcagagcgcatgcaggacatcgcgcggcagccaacgtgttgcgccgtcatgtcgcgggaggtcggtgcgtggtgcggatccgaatcaactcccaagggtctgttgctcaagacagttggtttggtagctagcttataagaatctaaaaaaggtttttcagcttttaatttttagtttattttttagattataccactataggtttagaatctagatcaaaagctggactattttggagagcttctgattttagaagaagttacagcagctgaagctcctcaacccaaatatgccctaaactagcagcgcccaagtttccccgaaatactccccgctgcagtactagacgtggacgagggcttgagtcagattttgaacgaaacggaatggcagtgttgcaaatacggaggggaaggaggggcaaggagagacgtggggcggtgggggaggcttttggggcgtttggatggaccaaaacagcttccccctcttctttttctcctttcctttggtgagtagccaaaattaaagatgagactttttttctcaattaaattagaaaaaaaaaaagaaaggaaaccacagctaaggaatgggcttgacagaatcagcaggaaaagaaaactttgagcttgactttaaaccgacttcataagatgatttgagaggtgtagaataagtggaagccctcgctcacaagtgaaatatcattacttttaacgttattaactgttcttttctaattaagatttacatttcacctcggtttctgctagtatgattttcaaactactaatgatgtgtttcgtgtaaaaattttctatatcaagtttgctttaaaatattaaatatatatttatttcttaaatttgtaataattaaaacttaattaatcatatattaatatctttctcgttttacatgtgtcaacttaatcttcatagttttaccggaagtagcttgtagtagcacggtccatatataattgactgcaatttcatgtcttcaaatttcatttactgctactgatcagctcctgcctcctgctacctttcaagtagaagactgtttcaacctctaccaattttttgctactacagtaactttttcatagtgactagtagtatatttttttctcgcacaattttagtctacaaacgaacgttatttcatgttttagaggaattttattcgaattgcctggtaagagggaaccctgaattctaagcatgggaagatgagaaatcatttttctggttaacagcctaacaggagtttctacgttgtcaacttgggatgtttcagcacatggagattccagcaatggacatacatggacagtagttattaatgtgttatgtgctgcatcaaaactgcatctaatgatggggcacaatgttcagatgtttagctgttcttgctcactactctgttcatatgctgtgatcagc

SEQ ID NO: 25297 - DNA, 1501 bp, Oryza sativa
ttgttcatgattcatgaagcacctagtcgctcccctgctgctttgtttttgactgtaaataacttttatttctcttaatacaaaatgcgctccttgcgtattccaaaaaagcacctagtcgcccttacaatcttcgtcggtgtcaattcctgcatcaatggcaccgggctttggttgataatgatcatttagtccctttcaagctttcatgacatgtgagttaagagtaaaacataattaacaaataatctagcacagtagcactagtgcactcgcattgtattattctagtacaggtccatgtgacttcgggatccaattcagcttcaagctggccaatcaagcaagagaagagaaatacaaaactaactccatttactccaaagttccctcacaatgaccaactgatcccaagatctaacatattaaaaaaatagcaatcagtctgaaggaaggaaaatctagttagcccagtgtatacaaaaatacaagtaacatcacattaaacaattgaacgttggtgtacagtcttctcttccattctttatgatcgaactaactcaaacaagaaactaataggaaatattagtaaattaaaatctagctcaggggatttagttttcatccaaggaaaaatgaaagagatcacgaagaattacggacatgtagatacagtttagtaaattccagtgagatcacagattcatcagtggtctccatttcttacatgtgtattgaagacactcacgagtcaccaatataagcatatgtatcttccatgtaatcataaaataaaagagatcaacaagaaactagcagccaagaactaaaacaaaacttttttttttgtaagtcgggaacactattttgctatatatattgacaaattttcttccaaatatttatcaaatgtaaatactgttttaatccaattcaggtggggtcttcccccccgatgttccatgaagaaaatgtaaatactgtataattacagtacaattacattcgaacttgtataactataacttatatgttacctttacataatcttgaaccattagtttgattacttcaatttctatgcaagttgggaagaaaaaaaataatagttgcaagttgggaagaaaaaaaatcatagtgcacacacgagtgaggatatttagtcccacggcgtccgctttgcaaattacgaattgtactgcatttacatgcaagttacgatacagttataatatgattgtactgtatttacatctgataaaatttcataagtatatactaggaattaataggcaaggagtagacctgagcaactaggcccattaaaaggcccataggcaggcatgagaaggccgcatccatcagcatttcagcacgcacctgagacctgatgatttgagtcctcgtcgcgtcgcgtcgcgtcgtgtccacctgcgaatcctctagtcctcgcgagtcgcgacacgcggagctttggcacctgcagcgatggcgaccgacc

SEQ ID NO: 25298 - DNA, 1501 bp, Oryza sativa
tgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccgaagggaagcggtcaggtgtgacgccacccctaaagcctggtgacaggtgggaccggtctccgtagttgggcaaaacacccaacggtctcaatccatgcacattggtattggtgactttggttgtccataatgggcggtctactcaagactgccacatcacttgagcagcgcgcgaatctgggtgagcagatttgtctcgctcggagatacggtaacgccgcttcggtcggcgagcgtacttaatgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggaccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgcca

SEQ ID NO: 25299 - DNA, 1501 bp, Oryza sativa
tggagactgtatgctccccgcccaaatcctagactcgttaaaccaagaatgtaggagtaatcatttattcagccaatgtaaaaaaaaaaggtattgggcctactataaccccccaccccaccaaaaaaaaatctattaaaagacagcatgatgatgcaaggatcaacacccgggcaacaggctgattttccattacgggccttcaaggcccataatactactgatttacgtgcgatcaatcaaacatacggtgagcagagacgacgcttgccaagatttgggcaaggcaagtcaggggcaagaatcgaatcgaatcgaatcaaatctctgggagcacaggacgagcggagcagagcaattttctctctcgctctctgcttcactctcatgagatgagagatattcagatgcgtaactctaaccctgccattaccagtagagacgtttgcgattgctttgcttgttccagtcctggaagagaagagaattttgatctagcagcaaaaccaggctctattttttttccctgtcatgtgttttccgttgctaatttttagtcagcattcgatgttatcagtcagtcattctgtgccaaaaggaggactgacatcgttgttggtgaatggtgaatcagtggtaaactaaacacaactgattagaagtttagaacaatgtgatgaagggaaattatattgctgaacacaaaaggcttcctgtgtgtccagcgattgcgttttatacttggtatatttggcaagttgttattatcgcaaaaatttctagaaaaatgagagaaattttggttcctgattcttgcaaccttgcaaggactgtttcatgtgaatggccctccaaacacacctctgtatagacttcatcttctgaaattcgaatgaccatgtagcccagtatcttatgagcattttattcgaattttccagttacatgggaataaacttctttagcttctatctcacagaaaggtagactatgttggcttccttcttatatctacccatagggcgcacaaatatgtgaaagctatgagagcaactttaccgagttcgccgattcaaatttcaacttttgacctacaaaatatacttcccttccagcaaatcagctgaaagcaattacatcatttttcgaagctaagggtctagaatagtgctgcaagattcccctttctttcagaaatcactaggaacgccacaatatggaccataaatatcactagcacattgataaagtttcctagaattgaatcacactaaggtttttccgaccgttttcatccctgctactatctccgttctctcatcaaaccgttttatctcggaaagcagattgaccagacctttaattgttcagacactatctcaaccgcagaagtattttatgtttaacaaacttacaaattttacccgaaaattgatttgctacaagctattgctggtctctgtagagacatgctaatttcatgtatcgcatttttgttaca

SEQ ID NO: 25300 - DNA, 1501 bp, Oryza sativa
tcaaatataaatggcttaagatgttttttacaaaaaagattgtcattttttaagatttatttggagatctgtacacatttcctttggtttatatcctccacaaaggatgtctcatatgttcaggaattggcttgggctgagttcttatctccatcttcccaactcatctctctcattttccgcgtgcacgcttttcgaactgctaaacagtgttttatttgcaaaaaaaaattatatacgaaagttactttaaaaaatcatattaatccatttttcaaatttattttagctaatacttgattaattatgagataaatgctgatttgttttgtgtgctagggagtgtggtttccaaagctcactcccgaacacctttttggtgttgataaaaaaaattaagaatcttatttttgttggagcatccgttttatgttgggctctctgacttagtaggaataagatgggctttgataaattaccataaaaatcttatttgcaggtacttttcagggcaacgtattggcttcagtattgggcaattatagaggtgtgaagaagatatcaaactaattaatgatacatgtcgtaaacttgagtcaacgattatgcagctctttgccaacttcggatggaggttctcaaataggattcaatagttgtgggatctttatcttgtgttggtggtgtattagtttatgcttgtttaaaaatttcatactgtgatttccggactcactgtgtgagtttgctattgtgtgagctacgtaataattggttgtagcttgtttgagcaaaggccacgatattttattctattattaaaaaagagagcaatacgatcagtttatgcatggctaattcttctgtgccgtatttagatagctgtacttgtcccgtgtaaattatttttcaactttaaaaacagatttgttaacagacaaataacttctttaagcgtatctgtatgcgtttaacaaatactttggaagatatgtcttttagattaataggatctacaaaatttatcaaattacatgaaaattacgaaatttatagaatgcatatttttaaagtaaatgactcctatcatcaacttaggccgtgtttagttccaaagtttttcttcaaacttctaacttttccattatatctaaacttttctatatataaatttctaatttttccgtaacatcgttctaaattcaaccaaaggtatgaactaaacacggtcttaatatggagtcatataaaaggttactctttgtacatcagaccaaaccagtattgaaaagttaaaacttagaaggtcctgcacataaatacgtgagtactaacctaggggtattttcgaaaatattttatatgtagtgaagtataggataaaaaatactattaggggtgaaaatgaatatttgctaggtgttagtggcacgcataagttagcaggtagcctttgggaatcgggagctgtgagctgtgagtgcctcgtcgtccacctctg

SEQ ID NO: 25301 - DNA, 1501 bp, Oryza sativa
ggcgacaccgactgcacggtgaagaaccaccggaacaactgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatcctttcctcgatgcttttatacccttgccatcgctggtcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaacggattgtatcgtgcgcgcattaagtacgctcgccgaccgaagcggcgttaccgtatctccgagcgagacaaatctgctcacccagattcgcgcgctgctcaagtgatgtggcagtcttgagtagaccgcccattatggacaaccaaagtcaccaataccaatgtgcatggattgagaccgttgggtgttttgcccaactacggagaccggtcccacctgtcaccaggctttaggggtggcgtcacacctgaccgcttcccttcggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaaga

SEQ ID NO: 25302 - DNA, 1501 bp, Oryza sativa
tgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacggtcccttgggccgccgccgccgccgtggaggtgggctgctgcccaccgctctgctcgctcccgtgccctttcctcttgccagctcctcaagctccctgtcagcggtgatgtcgccggcgatggacccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttagcctacaggaaggtgtggctctgataccagatgttagaatttcaatggttactctcattgagaagaggatggcactcgaga

SEQ ID NO: 25303 - DNA, 1501 bp, Oryza sativa
aggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgcc

SEQ ID NO: 25304 - DNA, 242 bp, Oryza sativa
gctctctatgcaataatgaactaaattgtgatgtttattattgcagggaacacaagtatgctcacaagtagcctactggaaattcatacagactttggacaaagaacagctgcaagccagagatgatctaggttttgggggcttaacaaaaatgaatggagtccagattcgccggcttttctgcaagcaaattgctaggcaatatgacgagtagactagagctttcaatataaatggaacca

SEQ ID NO: 25305 - DNA, 1501 bp, Oryza sativa
tgaatgagatgggccataaatcatggggaaacaaatactatataaattgagttatttgaataaacatttaccagtgcaatggacaaatcacaatagattacatgtgagatgtgaccaagtatatacagagcaaaccaatacaactttgagtggtgatatataaactaaggctcccatcggttgcccatttggccaaaatggcttatttggcttattagaaaattaaaattaatttataagtaaaacttttgtatatttgttcgtagcgacttaaaagccaacattaacaaaaattacgttaaaagcatttcaaaatcaacttcaaaatcaagttcaaaaattcaaattttggcttattctttggctgtttaggccaaatgatggggctataatagtatctagattagcgacacaataaaagataactgtgacgacatggttgaattaaatgtaatctattaacagtaatgcagtatcgtagaatcttgtacaacaatataattgataatataacaaggaaatggatagtgttcatatcaagggagacctgtgccagcagcatggtggagaactgtgcatcctctaacatctgcttttgttacatcaccaccatgatcaagaaaatattttacagtaggaacatcatcagactcagcagctgccataaacggtgttaaacctgtgatgaatagcacattagtatactcacacatcatactaccaaacgtagacatggaagccagcaaactcacgaaaggatgataaaagttagataatgaccttgtgctccagcaatattcacgtcaccccccaattcctccaccaagaacttgcaaacattcagttggccctggcaagccgcagcgtgcagcaacccgattccatcatttttaaaagctaagactgcatcctgggcctttactttctcaatctcaagtctctttataggcatagcaccttctcccaaagaaaaaccaccgaaaacgtcattacactaaggaagagaatggacagattaagtagttatagcctatagaagcttagaacatgaaaaggggaatggctaatgtgtgcaattggaaacaacctcgttgagtcatgtgtgttagaatttcaatggttactctcattgagaagaggatggcactcgagatggggcaattttctggttttcttcattcactaaatacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaggcaccacaagaccaagaccaaccagccaagacttattcctacattctccccctaagtcttgtgcgccgtcttgtgggag

SEQ ID NO: 25306 - DNA, 388 bp, Oryza sativa
tggtatcgattaacaggttaatttggagcgtcacgggctagttccagtcgggactagttcggggggtgacaagagatggtatcagagcacaggcttggccctagggcgaaacccgatgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactg

SEQ ID NO: 25307 - DNA, 1501 bp, Oryza sativa
aaagtggaaaaaaccaaaagtatggattatgcactgcaatatcttggaatggttcagtccaggcaaacaaaacagtcccatgcaaacacgcataagtgtacatcagctaataatctaagtggaaagcaaaacaaatatctagctatccaaactagcagtgaaaaaaaggaagaggaaataagaaatagtagcaactacatacatctgccttgtgatccaacaaaatcttcagtgtcttatccttgtcatcgttagcagcatgcaagagtggtgttccaaggccacagtctatgtcaacaggtattccttttgaaagcaagaactctgttaccttacagcatcctgcaatgaatgagatgggccataaatcatggggaaacaaatactatataaattgagttatttgaataaacatttaccagtgcaatggacaaatcacaatagattacatgtgagatgtgaccaagtatatacagagcaaaccaatacaactttgagtggtgatatataaactaaggctcccatcggttgcccatttggccaaaatggcttatttggcttattagaaaattaaaattaatttataagtaaaacttttgtatatttgttcgtagcgacttaaaagccaacattaacaaaaattacgttaaaagcatttcaaaatcaacttcaaaatcaagttcaaaaattcaaattttggcttattctttggctgtttaggccaaatgatggggctataatagtatctagattagcgacacaataaaagataactgtgacgacatggttgaattaaatgtaatctattaacagtaatgcagtatcgtagaatcttgtacaacaatataattgataatataacaaggaaatggatagtgttcatatcaagggagacctgtgccagcagcatggtggagaactgtgcatcctctaacatctgcttttgttacatcaccaccatgatcaagaaaatattttacagtaggaacatcatcagactcagcagctgccataaacggtgttaaacctgtgatgaatagcacattagtatactcacacatcatactaccaaacgtagacatggaagccagcaaactcacgaaaggatgataaaagttagataatgaccttgtgctccagcaatattcacgtcaccccccaattcctccaccaagaacttgcaaacattcagttggccctggcaagccgcagcgtgcagcaacccgattccatcatttttaaaagctaagactgcatcctgggcctttactttctcaatctcaagtctctttataggcatagcaccttctcccaaagaaaaaccaccgaaaacgtcattacactaaggaagagaatggacagattaagtagttatagcctatagaagcttagaacatgaaaaggggaatggctaatgtgtgcaattggaaacaacctcgttgagtcatgtgtgttagaatttcaatggttactctcattgagaagaggatggcactcgaga

SEQ ID NO: 25308 - DNA, 202 bp, Oryza sativa
ctcaaaatataagcagcctacactctgataggatatatccgtactacgaatatgtactggctttatcgagattcgcactagaggtgtctaatctgattttaggttactataatttagtctgttttttaatagctgacgttcaaagattaaaatgtgcctattcattgtgttgagctcagtaagatgtaatttaatctcaagg

SEQ ID NO: 25309 - DNA, 1501 bp, Oryza sativa
tgagcgtagccggccttgtctctccaactggcaaacggctccctccatgcaccgggtcttggtacacccaggtccccacgacacgagcacgagctctgcgcaccgggtccagtagaccgcaaaacccacaccccatcgtattcgtcgtggacgggggggggggggggcaaaagcaagagggaggccaaaacccccctccacccatttcgctctccttctcctgcaagcttcctcctccccacccacccctcgctcctcgccgcgaggggcgagccatggcgccgccgctcgtctacctcagccccaccgaagacggcaccggtacgtccagatcccgcacctccgctaacctcttggttggctctcttcaattcttctaacggcgatctctctcgctctcgctctcgctttgtacgcgcgcaggtgcgagcactctcatgaaggcggccttctgcgggaacctgggaagcctcaaaggttgcttcctcttctcctctcttctccgccgcgtcgatcccactcgatcgatgtctgtatacatgccccccttttgcatgctcctgtgtgtttcttttcctccgataggtttaatttgtgtgtcgacgcttgtgtactcgttgttgcgcttgcgatggtcgtatgatggattttgcatgagctgcgttgttgttcttgggaatttgccgcattttattttccgtgatgctatggctgcttggattttatcgtgcgtgaaggccgtaaccctctgggcatgtggattagcggatattgcacacttatattatctagaaattgcaagatatgaggcttttattgtagcaagcacttgtgtcggataaatgtggcagcgcgttcgcgttgttatcatcttctattatattacctctccaagtgtggatatatgatgtatagtcaggtactctaaacaaatgttaatttgcaagtcgcaaagtacaggttataggtgcacattgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtatttagtgaatgaagaaaaccagaaaattgccccatctcgagtgccatcctcttctcaatgagagtaaccattgaaattctaacatctggtatcagagccacaccttcctgtaggctaaacatctcttgttccaccccttcccaagctcggttgagctctcagccagcagcagcagcagcagcaccggttgcccctccttcccctttcccttccccctctccacacagcagccccccggaggtgcgcca

SEQ ID NO: 25310 - DNA, 1501 bp, Oryza sativa
atatggcctagttgttatatttctgtataactgtatgactgtgatatcttcagagtgaaattcagtaaggttggaagactaatcaatctgtcatgtttttttataaagttagtttggtattcatcaatagtacacagtaatactatcatccagaatgcagttttgtagtactgaatgcagtgtagttttacttttaacattacatagttcagatctacagagcaaacatatgaaattttcagttctgagttgttgtatttatccagcaaagtggattgttaaccttgtttcatttgacatattcagcaatttcatgtattcttttgaattatatatttgacctaaactctctctttgatctttttcaggaattgtatataggggataagaattggagccttgaactaaccttgaactggagccttcttgtttctcttgattttgccttcctcttgttttttctttgtgttctccagattctgtgtttcctttgtatggatctcaactttctgttcagaagttgtctttgatttcttctttcctatagaactactctttgattctgacattgtactctctccttccatctgcgatttggatcctctttttctctcttctttctcttctcctagctccatgtttgattcgtgctagatctgtttgtgaactagtagtgctgttgaaaagtaggggattgaaaagtgtggtcccatacatggttgattcacgtgacatgtttttcatctacttggcttccaagtttggtccctactacttttttggataggctgttggattatgatttgggctttatttccttgtgttttgcttctaattttgtatcttgggcctgctttttactaatgggcttttatggatctggatatagacttgggccttcaaataattcgcatgggcgaaaaaatcatgggctttgtttatttgtgtttgattcaaattttgtattttgggccttctttttactaatgggcttttatggatctggatatggatttgggcttttatggatctggatctggatttaggctttaaaaaaatggcgttcaaataatcaaataatatatctgtttttaagtgtaatatctatttgtatcactttttctgagttgttggatgtgcatcctatggtagataaaatctgtatgattggagcttcagaaatcattcgattcctatatagacagccccttctttttttttggttctgggatttttttcctctactccaggctcttctagatggcattgtccattttgtttaaaaacccttcttaaaacttgcattttatatttaggtccgctggacctttttctcaccgttcgtatgtcatcggacggctatgggacattttgaatgcgtggcatgttctcctgctgagaatttggatggagcgcaagcgtgatgccacgtggctcagtgagaggcctgggattagacctgaaatcgtatatagagattgagggacctcagatgaactta

SEQ ID NO: 25311 - DNA, 384 bp, Oryza sativa
aatctaagcagaaaagagcaaaatcaccaaaacagcacaaaaacaagcatgaacagtacatgtggatatttttaacatgtagatctcaaatttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggtttcgcggtggaccgggcgcacggcgacggttcacgggaacggacggccgagatcgatcttatccaaaacggacggccgagatcgaccgatccacggccggaccacgagagacgacgacga

SEQ ID NO: 25312 - DNA, 1501 bp, Oryza sativa
ggccgcccgggaatctccgtttccttggtcggcgttggtccgcgacgggatgcgtcggtccggtgtacggcccgcgaaccgtcggacgatcccttgcgccgcctgtggctgcgtgtccccgtccccgtctccgtctccgtcgtggggatccgcatggcggcggcggcggcggcggcggcggcgagggtttggtgtttggtgtttggtgcgcgaaggggaaaacaaaggcgagacgaagataaactactcttgactcttgagtgcaacccgatacggatacgggtgacccaagtgccaacgcaattgctgggcctggctgggaggctgggagagtccgagtcgtgtagttcacttttggttccttctatttgtcgcttaatccgattttcatcacttcatcgcaaaaccggcataacaggtctcccagcatacaaaaccgtttaaataagatccctcggccatattgtgttcggttttaacgcttacatggctccttttaactaggtctttacctaacgtgttattgacgtagtgcttatgtggcaattagattaaaaaataataaaatcaataggacccatgtgtcagttgcacacacaaataataaaaaatggtgggcccgcgcggacccacacgttatcctcactaccccttctctctatcccctgttctctctctagccggtggagcggggtgggcagtggtcggagcaggcgacgacgactcccgctgctcaaagtcctccagaccccgcgccacggcgcgctggatgtcggcagcgctgcgcagggtggccagagcctgcagccgcggcgtcccggcacacggacctcacccatgcctcacgcccactctgctgacgccggcctcactgtacccacgaattgagtacgtcggccacgcacgcattgctctacgcccatgcaatgccggtgacaccaaccgcatccacctgctcccgcctacccgcaacgcctccctgacgccatgactttcggccgcaagcagcagcacctcgacgaccgccggaccgaagagcatcctctggaatgcctcggttcaaacctcccctgcatggcctctgcgccaccttgctgctgccccgccgagtcaagctacgccgctctggccgtcggccactccgccccacagtcgccctctctgaccccgcgccgtcggctggagagaaagaagagggagacagaggatagagagaagagggcacttcatcaagcttttgttctatgtaatttattatgactataagtaacatgagactacgtatttataattggaagttggtttttaaaccttagaatttgattttgatttttataacaattttagcattttttttcactatgcttagcactcgtttcactatgcttagcactcgtttcacaatcgggtctagaaaatctaatctaaatttcaaaaatgctttgaattaattctaatctgcaacataactttctgtacaatgttttgtactactccgttt

SEQ ID NO: 25313 - DNA, 765 bp, Oryza sativa
accagttcatgaaccagttgaagaaaataatgatgatgttaatcaagctgtgcaaaaaaataacaatttcacgctcatctccaaaggtacattggtttctgttctcatttcaattttttttattctaatagtcatgtgaatcattaagcatttttttgtccttttatttttttgtagggaaacagtaaaatagtactagatgatgataagttgccaattccaaatgaagaatttaatcctgtgaataagtctaccattttgaattcttcagaagaggtttttttttcatttttatttcaatcattataatctgaatatatagaactgtaattgttgatagtttttaactgtcattttttatctgtgcagattaaacatatcaacattgatgaaataatgacaaagatgaacaaaacaggttatttttttttctaaatttgttaatctgtttttttaaaaaattaaatatgaattattgatgtttgtgcctatttaacattgaaggtcatgttcctattaatccaccagatgaaacagagaaaaattctgccttgactggtaaattttttttaacggaatctcatttgtttttacttgtatatctttaattgttctagcatcaaaaaaattgagttattgtaatatttcatttcttttgtcatgtgattttagtgcactgtactatggtcctcttactttttgttgccatattttttgtttctaattcttatgttattgctgtagctcgaaacaatcaagtttttc

SEQ ID NO: 25314 - DNA, 1371 bp, Oryza sativa
aattcctgcagccctccgtcaattttcaaaatggaaaattatttttgtaaaacttttaataaaaaaaattataaataaaaagaattgcatataggactactactcagcacaatgaggcccaggcaggctgacgaattctcgcgggcctcacacgacgtactactactctgcagcattctcatgaaaaaccttgtaaaattatcgtcgaaaccggttcggattcggtctcatttggaatgaaatgctcttatgaaaacttcacaaaaatttcattggaattggttcgattcccgcatatttggtcccatcatctagctatattgctgatgaaaactccttgttttcgaatcaccatctctctaaactagtgtaataatctgtactcatatagtgtagtactagtagtatatagaaggctaagctagaagtggtgatgcttttctaatattttcaagccgaatcttcccaacggtagtgacgactagatcacttgacaaaatcccaagtaggaactaaccagtgccctaatttataaagtaatactatgatcaatgcccaactaacccattgttacacaattaactaagcagtgttaatggactataagaaatacaatcttcctaccatagtttaatctcaactacactatgtgccagaagtcatgtgttcatcttcatcaggtcaggagtagaatctgcttaatttagctacaaaagtagcatcaagatcaggggatcacatagccacttaaaaaattcaaatgatggggactctctccagttgataattaattgaagctacttcttcagacttaaactagtggggggcatgcacttgacccaaactaaagcatccaaactttttgaaaaaacactagaaatatactgcactgtagagtattttactttatatagttctgtagtgtttaggacacagataagatgcatgactgctaatgacaaacggctatgcaatacttactcataaagccgcctcgattcacgtgctaatcactaaattagtggagcaggaggagtagcagaaggattcattagagtgagagctgggttagtttaattaatcaacactacacttagtttgacatcattggctggaatcaaatcgatcgaatggccgcaacgacacatgaaaccaaactgtcagcagcagcagcagcagctagcattgctgggctcgagatgcagaagactgaagacccagtgataatccatagctgaagacacacattttgtccatgttttgccgtttgaacaagcaacttaaactgtaattagtgctggccgtattcatgaacagcaatcaggtgtcaggttaggcagtagggtttacgtctccgatcacccaaaaaca

SEQ ID NO: 25315 - DNA, 1501 bp, Oryza sativa
tttattttttatcccccgtttttatcaaattcccaatataactattcctcattttatcttctcctaattctcatacttgtacaaactccaaatacaatgactactttataaaagaacttattttgggacaaagggaaggagctaaaaatgaattcaatacgaggcggaggaagtagtatgggtcactataaatgcttgatgaccgtggaagttttttttttattcggccagaattaggctcctttggaacaaaacggtttttaaaagaaattcaattccatggaaaaaatttcctaagtgatcctttggatcaaatgaatagacatcaaaaaatcatatgcgatttctttgggtctgctcaaaacataggaattttgattttttttttaacttaaggtccaacctattgggaaaaaaagaatcatatgtgcctatctctttcctgcttacattcagacggtcatttttagagttttttttaattcataggatttgaagtgctagggcattctaagtctctaattatgtaaccttttttaactaatttctatgagtgtcgttaatcatgtgttccaaaagagtccttactttagagtttagctctttctctcagactcggaggagaattattgtgtattgttggcctccatatatagtagaacagtcaggagtcttgagagttgagaagcagtggtttaccatatagcagatgtcagtgatttgagtccacttatcttcaatatatgaacttattagatcttgtgcacaatgcaatagtgttatacacaaacaaaattagggtcaaaagcaccctttctagctttactacaactcgtagatttcagtatagactcactgattatagacaactactgtagtttagaatatgatatgaaaattattccttcatatgtgatccattttcacccccctaattcacacccgaaagtgcaaaggtaaagagaaaaaaaaagagtcaagccagacttgcatcagggccagttgacttgggatgtgttcggcaggatacgttggaaactaatcctttcgaaaaaaaagaaacagatcattagcgaatgatttattaagtattaacttaaaaacttaaagaatagactatatgatttttgtaaacaactttttaatagatttttttttgcaaaaaaatacattatttagtagttcgggaaatatacgtgtgaaaaatgagaggtagaagttggaaaagagaagagaagaatatacttaacctagaaagtttccacacgagcatactctaaaattgccagtttcagactattttgagtcatcagtcgggttgggcatgcctgtgaaggtcttatggcagctgtagtatcgattcggcgagtttgttccaccgaagttaaggccccgtttagttccctaatttttttttcaaaaacatcacatcgaatatttgaacacatgcataaacattaaatatagataaatgaaaaaactaattgcacagttagggaga

SEQ ID NO: 25316 - DNA, 1501 bp, Oryza sativa
tgaacgcaccctatatctatctagattcattaacatcaatatgaatatggaaaatattagaatgacttacatcgtaaaaaggtggaagtaagagctacagctctagctacatgtacatcaccagtacccctgagctggaactgggaggaacaaactacggcaagtggcagcagcggcaagtacccaacccagttcaaaacacacgacatgccaaacagttgtaagcagctagcgatcgatcgatccaggatgagtgcaagcctccaaacgagcgcaggcaaagggcacagtgcagcatcggaattcttccgctccccggggaggcaaacgcatgcaggcacgcccccctcatgcctctacagcctccccggtcggtcgtcgtcgacctcgcccggtcacatgcatgcatggcaacctcgagtcggtccaaggccatggtggattggtggtggtcggctatggtggtctcgtcccatgagtgactagctcgcttgctgtgacgagacgtatagggcttgtttgaagaagtttctagctgctgtaacttttctaagaatcagaagcactcttaaatggtacggcttttggtttgaattctaaaaaattatagcattagaatccagaaaataaattagaagctagaaaatgaacttctcttacaattataagctcccctaaacagttttttggttcagattttaaaaaattgtagatgtaaaatttaaaaaataaactaaaagtcagaaactggaaacccaacttttctagattcttaaaagcttactagcaaccatctgcctctcagtaaactccccaaatagggtatagcatactgctggcctctaccattcaaatcctggctggtcaatgccgtttaatccgttacctttccggacttgttttttaaaaaaaaacaacgggatttgatttgctggccttgaattgataggggaatgtacatccaagtgcactgttaaatcagaggggaaagaagtgggattttttttttttgtaatctcccctccagctagctcaacgtacactttgcctgtcacttgtcagtaacaagctcggagacgacggcaatggcggagcacacgatcgccattgccatcgatcaaacatgatcgatcgctactatgtcgcatagaaacagagactaagaagaagaagaagaactagttcttgtagtcctcttccttcttgcaatggcgaacgctgttcagatcaccacctcctctgcaagaagaggtcgcggtccctctcggcggccggctccgacgagcggtcgaagcggctgagcacggcggtcttgaagttgaacgcctcctggacacggttgcacgagcgctgcatgcccacgccgctcaggctcgccctcgcctccagggtcacctcgctcagcggcaccctcttccgcgcgccgccgccggtgccgccggcgacgcccggctccggccgctgcttcggcgcgctctgggaccgcaccttcgcctccgac

SEQ ID NO: 25317 - DNA, 1501 bp, Oryza sativa
agctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttctatgcccaaattcctcatgatcgtcacgaagagaagtgccgagtcaaagtcaccttgaacagtaatagtgaagatattccctcagtgatgttcgaagccggaggaagaaactacatccatacatgtcaggaggtggcaaggatcgccataggagagctccttgatcgctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactgtgttagcagcccaagatcgtgaagaccggaatcgtggtaagatttgcaagcttgaggacaaagtggatcgtttggagaaggaactagccgcattgaagggagaagcaccaccgcagaaggccaggattcgtcttaccgcaaggaagagagctctatttgtccctcgctaccaattggtgccaaaggtccgtgtggtggagaaagaagttaccccagccctagcggatcctccggtcgtcaatgtaagtgatgatgaaggagatgaatcaaagcgcacccattccaagattgagtggggagcaactcaagatgatgaagacgagccgaacgagccttcaatcaactccgatgcccggaagacctagaatgccttgtcaaaccgttgtcttagatcgttgtgttagtttgcttgtttaagtttggttgtgtgtgtctcgcatgtgatttacatcagtggtgggatgtaagtgcgtgcgtttgtttgctttcgagtgttaggtagttggtaagtttagtggtgtgagagtcttcagttttgtaataatgaaactcacttaagatcaataaaagttaaattaattctcggtcctaag

SEQ ID NO: 25318 - DNA, 1501 bp, Oryza sativa
taattctataattcctagatttttctgggatttatttgagctaaggaagtatttttaataaatggaattgcatttcatgaataatttaaattgaaaaaggttttaaaaagtcttcttttggctttgggccgaaagtcggcccaaatcctctctctctctctcctcggcccaagccggcccagtccgcagccgcgcgcgcgccctcgctgtagctgacaggtgggtcccgcctgtcggagtcgtcgtcttcgtcgcgccgccgccgcccgaaaccctagcgccgcgccgccgccgtttccttccaaattcggccgatcctttcctttcccggtgaaatcaattgaggggaaatgtttcccgagatctcctctaccttttctcttttggaatcatcggctaaatcggcttggaaagtgttttattcgaggtcgaatcggatcggtctctttcctccgaaccccgaagtttccatagcgtcgccggtcatcgtgggccttcgccgccgcctcctagcccctttaaaaggacccccggagtcgccgctacccgtcgccaccctcgccttcgcctctcgttgccgatagagccctagccccgtgtagcctcgcgccgccgttgtcgccgccgctccagccgtgctccgccgtcgctccagtcgtcgccgtcgctcggggaggtcgccatcgtggtcgccgtcgcgtcgccgtcctcgtccgccccttcgccgtcgctgaagaccgccggagcatcgtcgccgtcgtcaagccgaaggtcgacgccgcttcttcctcgacgccgtcgccgtccgttgatcttccgccgccgttttggtcgctggtgagttcgccgcgtcgccctctacgtcctggtgccctccgttcgcgccgccgcgccatcgttcgccggcgagcttgtgctcccgagccgccgcaggtggtgacgtcaccgctgacgtcatcgtcgtcgtctctcgtggtccggccgtggatcggtcgatctcggccgtccgttttggataagatcgatctcggccgtccgttcccgtgaaccgtcgccgtgcgcccggtccaccgcgaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaatttgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggtcagcaaggcaagtcacacagatcccaaacaaccctttgagcatgttgatcccgtttaaagctatcgtttctattcaactattgcatttattttcgaatgtcatt

SEQ ID NO: 25319 - DNA, 221 bp, Oryza sativa
cactaatttcctttttccggtagtactggcctgtaagcgggccacccatgtcatagactacctatctatccgctttctccgtaccgagcaaacggctccgtgaacctggtcttggtacacccgtgagagctacaggcctacagtccacggggcacgggtgcaccgccaaaccctcgccctcgtcgtggtggacgagcaaaacccaccacccactccgctcc

SEQ ID NO: 25320 - DNA, 1020 bp, Oryza sativa
tgcaccccaactctagaaactggagctttgtcaaacagttttaacttgatctaaaataagagtggagataaatagagtgtttttataaaataggtgaagctgggtttagtttagttgatctgttccacaactttacttgagatccaatttctaaatctaaatttagaagtttgagttctaccaaaccgacctgacatccacaagtgatcagcaccagtgtatatggatcgatcaatctagctagaccgctgtctagctagtagtactgttcactgttcagtggacaaccctgcatagtgttctctccacaccacggcgcatagctctaaaaagaacagtgcactggctgttttagctagccatcgatagacctgagatcctgtttagatgggactaaaacttgtaagtccctatcacatcggatgtttgaacactaattataaatattaaacgtagactattaataaaatccatccataatcttggactaattcgcgagaacgaaaacatctattgagcctaattaattcatgattagcctatgtagtgctacagtaaacattctctaattatggattaattaggcttaaaaaatttatctcgcaaattagctttcatttatggaattagttttgtaagtagtctatatttaatactctaaattaatgtttaaataaagagactaaagttaagtccctggatccaaacaccacggtagtcctccaccaatactaccattcctccggttaaataaaaatgacatggtcttacccttacaatccacttccagatattctccaagtaaatcacgtcaatcgccatattgcaaccaactgtttgatccttgttactaaatattgcagctgctggtgatactgattttaccaatgacattatcacgatgcatcatgcaagggtaaaaatgatcagagaacagtagcattcggtaaccgtatataataaaatgaatgtatacagtggtccataagaattgagaaatatgctctgccatatgaaatt

SEQ ID NO: 25321 - DNA, 384 bp, Oryza sativa
tccaatagttctgtatgattattgtggagaattgtgagacgaggatcagaatccactttgtattttgccgattttcaagaaaatttatatcgtagttcttagtttataaaccacttatgttcattcactataaatgagatgatacatctttgatatgaggttatataaggctaattacgattgttaatttcatatggcagagcatatttctcaattcttatggaccactgtatacattcattttattatatacggttaccgaatgctactgttctctgatcatttttacccttgcatgatgcatcgtgataatgtcattggtaaaatcagtatcaccagcagctgcaatatttagtaacaaggatcaaacagttggttgcaata

SEQ ID NO: 25322 - DNA, 160 bp, Oryza sativa
ctcggggcgatcgatcgcccattaggaatctcggtaaattggcggcatgtaaaataagataaaccattagtatatattaatcaagtgttaattattataaacttaaaatatattaatatgatttttttaataaactttcatgtataattttttccataga

SEQ ID NO: 25323 - DNA, 333 bp, Oryza sativa
ttctcgatacatttggctagagtttatgagtgtacacaatgtgtagaaaagttcttatttatcctttgaaataatgcattggagttttctaaatctactactactttaaaaataagaggcgtttccatcgtctagtggaaaaaaaggcgagaaaaaaaaagagaaaaacaacttctaccataaaataaaagaaaaaaaagtcccactcctcatgtggaaaaaagagagagagaaaaaaccaaaataaaaacttatatcgttaaaaaatatgtctgacttaattccgactctccggtggagaaaaaagagaaaaaacttatacataaaaaatac

SEQ ID NO: 25324 - DNA, 1501 bp, Oryza sativa
ggcttaagatgctgaaaagcatgtagttctgctaatctgtaatgtttcttttgtttgtcatatctgttttagctgtagtgtgtttgcttgctgtttgaatcaaactgaaatatcaagaatccgcattgctgaatgctgtgttgctaatgtatatcctttttatccgttttcttttgagtgctacaggtcattccagaagatagtgaggtagcaagccgagcagaattttggtggcccattttcatgtacagtgtatggaggcccattttcaggtacaatgtcctctttttttttttagaactacaatgtcctcttctctgttagtttagtaagacaaggaaatgtatttcatgtgtgttatataaaataatcctagtactgaaagtgataatataatagtattaagtgcaattctatgggaaatacatatgatatttgctaatcaatagcggacaagccatctctatctctatatatcgaaatctatgcagattagcgtgcgattagcgaggccacgtggcgctgcgtggttcgtgcatacgctcttcccgcgaagggctaaaatgtaaaatatgatctagcgaaggagtaaaatgcaaaaaggttagcttctcgtcctctcctgaagggtcgatcgacctcatgcctcttccccttccaatcgatctcatctcgacgcctcccgctcccggtaacggcgccggcgagccaacgacagggatcccagcctacggcgtgacgcggagcgcgcactggaggacgacgtggagcgcgaccgcgccgaggccgcagacgaggagggcgagcaggacgatggcattggtgttgaacgacacggtgactggaccgccgccgccatggccgttctcggcggccagcagagcgcgcttatcggtcgtcgccatggccggcagtggtgagcaagctacagtgtaatgtttgttcaatttattttcctgaacgtgtggttgctgatttgtagtgcgaactgtgcattcatggtgttcgatgaaatgaccaagaaagaatatatcttgttctttcttagagttgcatttgatagcacagttaggactattttgttggatagtgtattaattgctctattgctactatactacttctgcagaaatccaggagaaacacacaactagaaattgcagaatttgatgctaagttatgaaactcttatatggattactaatgagttaagttatgtattactgattccatcgtagcagcaatcgaattatacatgagttagagctattagtatatatacagttagcataatctggaaaagaaatattaatgcgctagaagaacataatcaggaatggttcttgacaaaactcaagtttgattttttcttctgaataccctttctaataacatttataatcatgaaaataattctgcattgatacatagttttttctttggtctcaatcctgctcagtagtttatttcgagagtacttctcctcctgacaaaagaaaat

SEQ ID NO: 25325 - DNA, 374 bp, Oryza sativa
tgagtaggtgggatgcgtagcacaagcccacaaattctgcagccatagaccatcaaagatatatcggctaacagcttgctagctctagcttttcaaaacttttttcgatcaattatttagattttagaggtgtcacacatttcgttttcaaaatttcagcacttgttctttatgagaagaaagcagcaggtgagaggagtccgggctttctcaaggttagaacgagtggaggacgtccagaatcattatcagtgccaatgcggatctagtaatttgtgtgagcctgttacgccaatggatatataacaaatcgtacataacttcatagattgtgtaccatccacccccccttttatgtattctaatctagtagc

SEQ ID NO: 25326 - DNA, 312 bp, Oryza sativa
attggttcgagaaccagtgagtagaattatctctcgaacaccaatggaagttgtggtgcgagaggttgctacaattttctggcacgagaaccagcgagtataattatctctcgaacaccaatggaagttgcggtgcgagggattgctacgatttactggttcgagaaccagcgagtagaattatctctcgtacaccaatggaagttgcggcgcgagggattgctacgatttacgattgcatgcatgcaatattcaacgaagattaaaatacacgggcggttcctaaatttatcattctatatgtcatctagg

SEQ ID NO: 25327 - DNA, 1501 bp, Oryza sativa
gtagataaagaagaaaagaagatccatctatccatccatgctacgaaacagaattagaaacgcgtctctctctctctctctctgacttccttgctagcttctcctaccactatgaactatcctatacgctatagctactatcagatcttctattcatgaaagtcatatgatctttcttttttagtttttagatatatttatgagagtgtgatattttttttatatatatagataataatatgagtgagatttttggatgttttctcttctccatccatctcttccattgcatccatgcatccatgccaactaattatactcactagctgctagctatctagttcctgtctacagaaaagaaaaccttatcttcctctctcagcagcttcgtagcaagctcacaattcattcattttatgcatgccatggaatgttccagaaacgtacgtgaacctcatggaaaattacacgacctgctgtgcagtcaatacgtatgtaatacacgctcgtgctattactttaactcaccgctggaatattattacaggattaagggagcacatcatgttcaacttgcagaaaaaaaactgacttaatcggctccacacaccccaattcttcagataaaacaggtataaattaccgatttatctctctgcgtgtgtactgcaaattcagatatataagtgttagctcaagagcataaacatgttcttgcatacttttgactctgaattatttatttttcttcagataaaaagggggcaagaaactttcggtatctgtctgaaagagctagctagctccaaagtctccaaagtaggtcaggaacctctctgcaactttggagcatctaggatagcaactcacttgctcactccagacgtccatgtcgttttcataatcttctatcttttattttggatctcatgtataatctgaactctgtatgcactacgcaaagtgcctgcatgctgcgtctgtcatttattttatcttatcttctctgcacaggtgttcgttcctagttaaaattgacagtttgcaagctagtagtaaacaaatgctaatcattgagacgcaaaaaggctcagatcgatctcgatcgagcaagtagctagggaatcgagattaattactgttctaaactgcatccgctgtatcattagtgcgctgcagaatctgatttgctgtcaggagcgttcagtttaccggtttcagactttcagtgattctgcttgttatattctggcttagaagagatgctaaatcaaaaggttattatatgtgcagattttgtcttctagttccaagaattgccgaataagtaaacatagtttaattaatgagtgaactgattgatggttaccgaaaagattgggatgctaattcgatcaacagctcgatcccctgtagatacagttgcatcaagccgaatatattacacgaactgttttacaaaagctataacattcagtgatatttgttccattaattgtca

SEQ ID NO: 25328 - DNA, 437 bp, Oryza sativa
gcagattctaccatataagaaacacggtttggagcctggagagagaagtcaactgctgctcctgtgagcaaggctcatccttctcatgatctggatctgaatattacattagactatacacttgtgcaggtgaacttgccgccaataatcaggacatgacagcattgtaagctgagctagagatgcctctacacttggttgggaaacataaaaaaacatcagcctgtcgaggagatgggtggcgtctgttgcagcagcaaagcacttcattattattgagatttcattgttgtctacacggtgagggatgccattgcttctgcctctttgtctatatagaggaaagctatagccgggtcgacaccattgcagcacagcattcttctcatcttcacttccacagagaagagaaaaaggataagcttccactgcagcca

SEQ ID NO: 25329 - DNA, 752 bp, Oryza sativa
ccaatctctctctcccttcttgtttttttttgtttttttacgccttcccctcccgatctctctactcccggtgcccacctcctatacatttttttttctttttcttcatttgttctatccctctcatctctctctctcctatcattttatttttttataaaaattaaaaataaattggtgaaatcaagagttgaacccatgatctcatagttcatggcaagctctcctaaccaattcatcatgtgacattatgtgaatagaaaatattgtttgcatgctttgtatgttcaaattgtgtgagaacaaatcagttatgttactacaagaaccatacctcgttattatgattcggcagtaacattatcataaaaggggagtaacatgattactgcaaaatttataggttgttactgcacttttggcagtaacaacattgcggaatttgcagtaacagagaacatgcatagtaacagtggtactacagtagtaatgtttctttagagagcatggtggaatttgcagtaacagagaacatgcatagtaacagtggtactacagtagtaatgtttttttagagagcatggtggaatttgcagtaacagagaacatgcatagtaacagtggtactatagtagtaatgcatagtaaatctcaatctttagagagcaatatctctcacgttatatattatttttctaatccatctacaccataatattcgtaaaaagtgcttaacaaaactagatccatca

SEQ ID NO: 25330 - DNA, 1501 bp, Oryza sativa
ggatgataggtgggctccacaatatttttttttatttgaatgacaagtggatccctcatatatttttttaattttaatgccacttagacgtcacatgggatgaagagcaggtcagctctaccacattagcgccacgtcagtaaaaccactcttcaaagccgctgagggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaactttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttcttggcccaaacaccctgaccgtccgaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatc

SEQ ID NO: 25331 - DNA, 1206 bp, Oryza sativa
ccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttatggatcgccttcttcatcaaatccttattcccctttcgcccttgtccctcgggcttcttggtcgtcttgtcactcttcttcttcaacttgggacaattcactcttatgtggttaggctctccacactcaaaacacacaaatggttcattggtttttcctctttttctatctctcacatttttgtaagctcttgagaattttctagcaaaaagagcaagatcctcttcaggaatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaatatccatctcatgggtttttagctttgagtaaagcttgtccatggtaaggtcactcagaggtgcactctctgtgatggaagtaactttcatttcccaaacaccataatcaagacaattcaaaagatggcgagcattatcattattagaaaattcttttccaacagatctcaacttcgaaacaatttctccaaaacgcttgaaataagaatcaatggactctcctgggtgcatctcaaatctttgatattctttatgaaattgattctgacgaaccaattgaatatcattgtttcccttatggaaattgcacagagcagtccacatgtcatgagcggacttgtggtgttgaacacaattaaattcaccagaagaaattccaccaatgattgcatttcttgcacgataattaaaatcaacctgagccacatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagaatatttttcctccatagcggcgttcgttgccacggttaggttacaat

SEQ ID NO: 25332 - DNA, 230 bp, Oryza sativa
ggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcaggaaggccgagccaacccggcctaagcacgttgctgactcaagatggtgaaggctaggccgagcaagccctagacatgacga

SEQ ID NO: 25333 - DNA, 1501 bp, Oryza sativa
agagatgtcgccacctgatgatctgcgagcggtccgacgacatcagtcaaaggaagggcctacgctaaatcaagtcataagctgatttcgaacagagaatgcaggacgcttatcgagcaaactcacattgatcgcttcatcacgttccgtcgcccccctttcacaaaggggcgcagggatgtcgctcgccgtggtcggaccgctgatcatcacttgatcgacgcgccgctccacggcttcgctgctcagacctgtcaagagggaaccaacttttcgtaagtcgagaggaacatgagtacaagcacgtcaaaatgaatgcgagaaagataccccgaggagaaactcgggtcgcgtctttaggcccggaataattatatgctagatgggcccgagcctggagcggctggattcgcctaccgacgaagtctgcaacgacttcataccccgataagctccgttctcggagatcatcgatgatgtcgataaacgattgaagagagggggtcaaggggggcttggcggtccagaccggaatcttgtccggttgatcctcgggaacaacgaggaccggatttgagtccttgatttcaagataaaaccacatgttccgccatttgtgcgggaagagggacactagaagcggacataacgcgacttcaagccatcacgaagtcggaacccgacgcaaccagacaccctattgggttccatccagcgcaactcataatagaaacggaagagatcaagaaagggctctaccccaatgtaggcctcgcaaagatgaacaaagacactaaggaaagtgatggaattggggttcaaatgcaaaagagaaagaccataggaattcaaaaccagcagaaggaattcggaaggtggagggagaaaaccgcagagaacataatcttcaatcgtaaccatgcgacctaagatgggctgaggattagtacctcctgctcccctctccgcgttttcacggccaggaagggcgccatcctcctgaagcttcttcaaggtcgcgctggtggaagctgacttgccaagatccattgctgcttgaagatcgccggaaaacggacctaagttggcgaagctagggttctttgcggtagcggagaaggcgaggagcgctaacagccggtgtgtgtttgacggagtttgcggacttcaaaatgcgcacccaaaatccctttaaatagacgcactaccgacggtgcgaattccaaggaacagagagagatccccgccggaaatttctgggtccgttacgcgcggcagttttttggacttcagttcaaaattcactcgtgaccgttgggcttcaaacggtgtgctcgactatacttcatctccacggtcctcgcacctggaatgacaacgttcttgacacccgaagtcgtgaatggtcgtacgagttcattttgagcagaagtcgggggctactgtcagggttacgagtcaggcataccctctacccttcgatatacgttacgtatcgaca

SEQ ID NO: 25334 - DNA, 1501 bp, Oryza sativa
cttaatcaatgtgcaatgcttgctctagaagtttgtttaagttgaagtatccatctcatactcatgctatgttttcattctttttgcaataactgtcagtacatgctcatgaatgctcatgcttatgcgtccatactttgtatcaatcttgctttacaagctttatctctgtttttgtccgggctactgagtgtgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaatttaaaaaaaaaatcataaaaagaaaagtcatgagaaaagattaaaagctcatgttctatgctttgttaccatgttgatactctttatgaactgggcattagcacattagcatgggttcattgctttgattatgtaaatcttgcatgattatgagctggtttgcttccttttaagcttcttctagaaatagctatgcacactaaatcactaatccacttgaaagctgtttgcttgctggcgatactatcctgatattcataacttgtttcatacttcttttgcacatgcttagctaggcttgagcacatgcttgtatctgtgtgatccatgtctactttttgatgcctttagataactctcaaagctctcagaactctggaatttgcaagtttcaatcattttcattttgcatttttgtctctttttggtcttgatggcatcattgacaaagggggagagaattttgcacttattgaaaattaaaacttgctttagatcttggtgaaagggggagtttggcacatagggggagcattcttgcatttgcatttgcatcccttttcttcttgtcacttggtcttgatttttcgcgatttcaaaatgaccaaagttcgacttttgcaaaatggtttgctttgtgtcaaaaatcaaattttcaaaattttgcttgagattgtcaatgttcccatcaagggggagattgtgaaaccatgtgtgattatagttcttttgtgatgggaaattgacaagtaccggaagtgcaagaagtgtgtgcgtagactaacattggttaggttgtgacatctatgccaagacaacggttgtttggctcatgtgtgtgcaggtgatcgcagtcaatcttagtcaacggcggatcgggactagactcagggaggagttgaggtccagaacgatcaagaatgctgggtgacaagattggacgcaaggttgcacacggtgggcggacaccgtgtgaggaggtctttacaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgcca

SEQ ID NO: 25335 - DNA, 1501 bp, Oryza sativa
ccattgctgctcctcgctggagctctacctcgccgcctcgctgtcattgaggtcccgacctcaggacagatcctgagccaccgcgctgccgctgcgtcagggagtagtgacccgccgcgtcgccagggagccgttgactcgccggatatggtgaggagcggggcggcggcggcaccttgacctgacgaggaggaatggggccgacggtgcgaggagggagagcgtcagtgagggagagggagcagcgagatgctggtgggggagcaactctccgtggccttggcgcaagcagcggcacctcgacgagctctgtgcgcgcacctggaactcatccgtgccgaagcaaccgtgccctcatccaccagctcacggcagctcccctgccacctcaagacccctctcccacactacctctagctgtggccgcagccgcctctgcaccccaccacggagaaagccctcctggttagcgctggcagcaaagtgaccgcggaggagtggccacggtggagcacatcctcgcctttcccggccatggtggctgctgtcattggcgagtctctcaagaggaggaggaggtgcgcactgtcgacaggtgatacccgtagactagatatagagggtattggggtacgttggtacaaggatctacgtagtacgacatcgagcaatcaaaagacaagaattatactggttcaggccccttgataggtaatagccctaatccagttgatatgggattatatggtggaaaacacaggttacaaaaggaatgatggaacttttcggatccagcgagatcgtagtcgagtggattcgactagctctcgatgacttggctcctcgcagactccggcttcgtaggctatgcgggttgtgttggctctgagattcgatgtcctatgccctccccggggggtcccttttatatcgcaagtctggagctctccgagcagaactcgaatatatcagacccaatacgatacgtagatgacccagttctgtcctagaaggactcttcctatctgtagatttcgtgaaaagtttccttagaacatgcaggaaatatccgcgtacgcgtgggtatgccatgtcgatacgtaacgtatatcgaagggtagagggtatgcctgactcgtaaccctgacagtagcccccgacttctgctcaaaatgaactcgtacgaccattcacgacttcgggtgtcaagaacgttgtcattccaggtgcgaggaccgtggagatgaagtatagtcgagcacaccgtttgaagcccaacggtcacgagtgaattttgaactgaagtccaaaaaactgccgcgcgtaacggacccagaaatttccggcggggatctctctctgttccttggaattcgcaccgtcggtagtgcgtctatttaaagggattttgggtgcgcattttgaagtccgcaaactccgtcaaacacacaccggctgttagcgctcctcgccttctccgctaccgcaaagaaccctagct

SEQ ID NO: 25336 - DNA, 302 bp, Oryza sativa
caaaaacccgaccccagccgccggccggccgaaaccctagcctcttctctcttgcgggcgggtgcggccgcgccgagtggcgtcatctacgccggcgacccttgcgccgccgcgccatggccggcgacctcgcgctgccgcgcgcccactttttctctagcgcgccgccggccggagcggccgagcggagcggcgtcgccgccgccagcggcccttgcgccctcttcattttctcttctccgctccctccaccgtctctagcccccaccgtgtgagagagagcggcggccgaaaaacggaga

SEQ ID NO: 25337 - DNA, 1501 bp, Oryza sativa
gcggcacacggagcggacggggaggcggcggaggatgtcgacgacgaggtcgatcgtcggtgaggctggccaccaggttccgccccacggggagatcctccatcgggtgaagctgccggagcccggagaggcctttagcctgcaatccgtgaatccgcgaagagggattcgagcagatggagcaggtgaacagtgagcagatggggattgctcgaacaaaacaatcaaaacggcaaagagataaatatctgacaacggatcaacaccatgggtcatcaatccgtgcactagacgaactaatccgagaaggtaaatcagtaaatgtttagatcaggaaacctacacatcaaagcagctcgctcactgcggtggctagcttcactcgggctaccatcgtcaagagcatcgtggatgtctctcccattgccccttctcctctgcatgctggctagccccgcctcacatctggcttaaagggtcgagatatcaggtgtcgtggtttagggatacgaatcagatttagccagtagctaagggaatcaaatgaacttaggccctgtttaatttccgaagaaaaatttttggcgtgtcatattggatatacagacacacatttgaaatattaaacgtagtctagtaacaaaataaattacaaattccgcttggaaactacgagaagaaaagtctaattaatccgtcattagcaaatatttactgtagcacaacattgtcaaattatggcgtaattagacttaaaagatttatctcataatttacacgcaatctgtataattggtttttttctacatttaatactccatacatttataaatattcgatgtgacagccgtgaactaaacagagccttatttttcaatttggaatcaatgtcccagcagacactgaattgggggcatctagggatttcgtcgccttcccagcagacccttacttttcttttctgtgtggtgatttttaatgatcttaataattggaatattgctttccttaccttttctagtttgagagagagagagagagagagaaagtttgtgtatgttcaaacaagagcacgtacaagggtacatcgaggatagcatagattggtaaaccaaaaagttctacaatagttcaactatgcatgctggcttcctctcatgtttacccttatcaattttcccaattacctgctacaaaccgtgataaaaattatcaaaacttcaactattatgttccttctctaagttcgaatgtgtataaaccagaaattcagaatgacataaaaaaagttatatacttctttcaattatgtccttactaagttattactgtcaaatcgcaaatgcatctaaaaaaagttacagccacatggctaagcttccttaaaatcgttgtaatttgacatttcattctcctggccgcctaaagggcataattaaccatgtgaacatccctgcaatgaaaccatgcaaatttagcatttaccttctgcagcagtttt

SEQ ID NO: 25338 - DNA, 151 bp, Oryza sativa
tcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagt

SEQ ID NO: 25339 - DNA, 1501 bp, Oryza sativa
cagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgacataacctgatcgtcagatcaatacacacccggcggattcaaacccccaaacaggagtagggtattacctctcattgagagggcctgaacctgtctaaatcctttgtctccgcatccatccacttttaggtctcgtgcgctacccccttttattattgccgaaatcatgtttcgacacaggcgccgcagtcggagtactccggcgccgccgacgagttggcgccgcagaaggccgacgtggagatctggtcgggccgctcgccgacgaggacatcgacgccggaggaggaggaggaggatccgttcgccaccatggctggcagcgtggcggcgacacgccgcaggttggcctcgtacgagctgttgggagcgaaccgaccctgcaccatcccgcacatgtggaacggcgggcggtggccgccgccgccgtcgtcgaggacggcggcggcggcaagcggcggcgcgaccagggcgaggacgaggaggaggatcgcggcgagagtcatcgccggagaagagataattcagccggagtagtagtacaggctgctccagttcagtaggtatacatagataagcggggttagtgttgactttgaccgttgactacaaacctccattgtccattgactagtcagcagctgccaactaaagagctttcacaatgcattatattagttattaactcgatcacttttgatctttgcaatgatgaacatgtgcatatatactccacatatactattcctatagacaaagattcgtaacctttgggttgcacatgctattgctagatattaatattttagtagtattttaaacgtgttgtttactttcaaggctgttcatattaaaataagagttcacatcagttacaacttaccctctctattttaaaatatagtgtttttgaattttcatatagtcatcaagatcctagtttgacagataatatttataaaataagttattttaaatagaatcaccattctatttctagttgcatgatttatttcatttggactctacacacatgatctacgttcacgacaataggatctaacaaattaatggttagatctttctaataaaagtagtagcttcttagaagtaactaatctaattagtatatgtctgtatagatagatagatggatggatggacacatatatcttaactcttgaaaagagaatcccaaaacataagaagaatgagccatatcatctaataaataataaccgttagatcaacaagcaaacaaaacaagagaataaatttcagccat

SEQ ID NO: 25340 - DNA, 1501 bp, Oryza sativa
cattatctttgattggtgtcactgttttttactaccaatgacatcttccgttacttttgatgagcaatttcgtcttcatgttggtcatttcatctccatgccgactgcgtcagctattgccaataaacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcatttagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaatgtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcggggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttcctt

SEQ ID NO: 25341 - DNA, 1501 bp, Oryza sativa
gccgagtgcttcaatcatctttgtcatggtctcccgagtacttttaccaaatctgaagactgtggagggctgaaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgtttaagtccctagaagacacatggtttcaccacacctggaaatatatggcatatgtggtgtaaaatccgagtaaataaactcataaaggatttaccaaccgcctagaaaaagaccacaatatataatcagcctaagccataatattggtcaataaaaatgcacacttacgtggcgaaaagcaatgatattgtatccaatcaattgcttaaaaactcaaacagcaccttgaattatatataaaaaagtcagcgggacagctatataaagctttactgtttgacaccttttaagatgcattgtatcaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcagcagtcagatcagccagcaatgaatatgaaggcgctcagcgataaagttgtgtagctatggcagcaaaataatcagtcggtgacagacgaggcagatcaaaggcgatgacgaaatccaccaatca

SEQ ID NO: 25342 - DNA, 1501 bp, Oryza sativa
ttctacgatgagagtaacataactcgacacgataacacatatctggacatggctgtttagtgacaatgctcaagctgatgggaaacgaactgggatcactagtgattcattaaaaagatttgctgaagctagtaaacaaaacgatgattttcagcaccaagagataaattcaacttctcaactgcgacaagctatacagcatcaaagcaaacattgcagcaataagcaacagtgaaatggactcacacaaatcaaaggtaagctcagcagctcaccatcgactaacctatgccaaatcgagccacattcctaaaatcgcagcatctttagctacagaaggatcacatttacagaacaatcatagcttccttagcttaaaaagcaagttgggcacacgaagcattccaaaaatctcaaggaggaggaggagcatcaagcatgagcttacggagacgaggcacccaggccgcagcgcggcgccgaccatggcgggctcggagagccagagcctcgcctccccgccgcggctcctgcccctgggggccacttccgcgacggtcccggagaagcacccctcgccgccacggggcacgagcgccgggtgccgcgccgccgccgccgcggcgacggacgggaggtcgagagttcctcctccgtcgccgccgcccgcggcgacgcttccaccttcgcggccgcgggatgcaggggtgcgaggggacggctgcggcgacgccgcggactgcttcttcttggccttcggtggcatggcggcggctggggcggcgcggcttccggcgaggtcacgaggtttggtgctttggtagggtttaagttttttttaaaaaaaaataatgtttttttctagatgttgcagttgggccaagtatgaaaatgggcctgaaaatgggttcattgggctcatttggtgttctgggctggcgtctgatatggaattatggcccaataggcctgtgaaggagtatttcatcactgaacaaagttcaggagagaataaattgcacctgacactggctaaagagtgacttatataatcatatctctaaaaaaatcataataaattaatggaacctcgtaaaacatgatctaaattcaaaaggtttcataagttgtgctcatattttatgagttttgtttttaattatgtgatgcaacctagtgcaaagtggaaattatagtataccctggggtaaagcgaaagtatgtactcctactaaactaaggtgagcaaaacaatgtacaatctactctgtcttcggtcttccttgaaaaaaaatataattcatgtgtaccaattttagatgaatcatttttttgagaaaaaaaatgtgaattcttttttaggggaaaattatgtgaattcactcgttctagaatgttatggctaacacactcgttttagatgaatcacccaaatgtatatactagttgacaccgaaaaaaaaattatttgcaagaattgttatggctaacacacttttgc

SEQ ID NO: 25343 - DNA, 344 bp, Oryza sativa
ataggtggtttgtagcttactactaaacttattctaatatgctatttacgtggaagcccatgaagcaagcccctaggatcgatggaggcgcattggggttcccgtggcatgctctcctagggagtaggggtacgcgagccccctttgcctacctattgtgtccgtcattaagttttcttatagtagattattcttgtgctgtaagaaaaaaacattttcatgccaactgagaatttaagaccctagtttaatttgagcaaatatgcaagtgcctttttttatggtcaaaacaattacccttggctgcaatataattatctattggtgcaattaccagtgacagc

SEQ ID NO: 25344 - DNA, 1501 bp, Oryza sativa
gtgtttagatgcatgctaaagttttgccattctagcactaaagtgagagagagaaagagagagggagtggtcccaaagcactttttggcacaatttgctactatggactagcaaatgctaaatgccaaattgccaacttttgctactagtgtttagatccaaaatgacaaaaagtgctacaaaatggcaaaacttttgccattttggaggatctaaacagggcacatcttttcccatgtttgtcaggtggagatatataaattagagatcagacaatgaagggcctatttagatccatttggaatggcaaatggtaaatggcaaaagttttggtattgcaaaagtactagttggtgtttagatgcatcctaaacttttgccattctagtactaaagtgagagagagagaaagagagagggagtagtcctaaagcactttttggcacaatttgctactatggactagcaaatgctaaatgccaaattgctaagttttactactagtgtttaggtccaaaatgacaaaaagtgcttcaaaatggcaaaacttttgtcattttgaaggatctaaacagggccgaagtcacaacatacccctgatcgtggtcgcatgcattaaggcatccatgcatgtatgttatttcattatattgatatctctaatttcatcttttattgcattctagtgcatgaagtcgcgcatgcgtgtgactatcactatcttttctgattagtgtttaagaataatctattactgatattatgtcactgaagaatttgttgtgaaaatatataaaatatatgtttgttttaagatagaaatatatgtttttatcatttctctcaaccatacaaacattttttctttatttcttatgcgtctcttcgttgctctatatccctctcccacatatggagacatggaaagctctataacaccctcttttatccaatggctgaaatttattctcttgttttgtttgcttgttgatctaacggttattatttattagatgatatggctcattcttcttatgttttgggattctcttttcaagagttaagatatatgtgtccatccatccatctatctatctatacagacatatactaattagattagttacttctaagaagctactacttttattagaaagatctaaccattaatttgttagatcctattgtcgtgaacgtagatcatgtgtgtagagtccaaatgaaataaatcatgcaactagaaatagaatggtgattctatttaaaataacttattttataaatattatctgtcaaactaggatcttgatgactatatgaaaattcaaaaacactatattttaaaatagagagggtaagttgtaactgatgtgaactcttattttaatatgaacagccttgaaagtaaacaacacgtttaaaatactactaaaatattaatatctagcaatagcatgtgcaacccaaaggttacgaatctttgtctataggaatagtatat

SEQ ID NO: 25345 - DNA, 1501 bp, Oryza sativa
atgcgtctcttcgttgctctatatccctctcccacatatggagacatggaaagctctataacaccctcttttatccaatggctgaaatttattctcttgttttgtttgcttgttgatctaacggttattatttattagatgatatggctcattcttcttatgttttgggattctcttttcaagagttaagatatatgtgtccatccatccatctatctatctatacagacatatactaattagattagttacttctaagaagctactacttttattagaaagatctaaccattaatttgttagatcctattgtcgtgaacgtagatcatgtgtgtagagtccaaatgaaataaatcatgcaactagaaatagaatggtgattctatttaaaataacttattttataaatattatctgtcaaactaggatcttgatgactatatgaaaattcaaaaacactatattttaaaatagagagggtaagttgtaactgatgtgaactcttattttaatatgaacagccttgaaagtaaacaacacgtttaaaatactactaaaatattaatatctagcaatagcatgtgcaacccaaaggttacgaatctttgtctataggaatagtatatgtggagtatatatgcacatgttcatcattgcaaagatcaaaagtgatcgagttaataactaatataatgcattgtgaaagctctttagttggcagctgctgactagtcaatggacaatggaggtttgtagtcaacggtcaaagtcaacactaaccccgcttatctatgtatacctactgaactggagcagcctgtactactactccggctgaattatctcttctccggcgatgactctcgccgcgatcctcctcctcgtcctcgccctggtcgcgccgccgcttgccgccgccgccgtcctcgacgacggcggcggcggccaccgcccgccgttccacatgtgcgggatggtgcagggtcggttcgctcccaacagctcgtacgaggccaacctgcggcgtgtcgccgccacgctgccagccatggtggcgaacggatcctcctcctcctcctccggcgtcgatgtcctcgtcggcgagcggcccgaccagatctccacgtcggccttctgcggcgccaactcgtcggcggcgccggagtactccgactgcggcgcctgtgtcgaaacatgatttcggcaataataaaagggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 25346 - DNA, 1501 bp, Oryza sativa
ggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaagtttgtcgatacaatgtcatgtgaagtagaatatatgtatatagtcggttgatatccattagttaaccaaacagagccatcttaaaatcaacatgtattgtatagcttacagtaaaaagcaactactcaaatatatgatccaataataagatattgttgcttacacatatactatacatcccattatagtggtacggtatagtattaatttgcgtgttgcatatattaaattaagagggagtgtatgacaaacatgtatattagataaatactagttataaatcttgacctcatataattataattatagttcaactgtaaattaggattattcattgtaaaattatgtgataggataatctgtaaccataatatgattaacctaaacaactctaacatacaaagcatggataattattaaccttttataatttattgtgacaagtaaaatatgttcataattaaagtaaagcttccataaataaaataaataatacaaatgattcactgtaattatttgattgatcctaaatccatctaacaacagaacctctagtaaataaccgtcctatgtagatagatgcatgcttagccataatccttccatagccatttgatagactaaaccaccgattagccaaatatatatgtatcctataaatgctatgttggttaactcctaaataggccacgttgacaatagaaagattaagaaaccttagcccctagcgtgattggaatccattagtagacatgaatagtatattttgttgtgcatatttggttgttatttgaatattggtttttcttgcgtattatagaccttgtgcatcggttagtcgtgaggcaacgtctgcaacttccaggaggtgaaggttgatcaagattatatcaataataaggattatcctgagcaaggcaagtcatcactattctttgaacatgttgatcccaattgcgaaattgttttgtttacaaataaaattgcatgcaatgataaacatcctacttgtgattatgccatgccttgattattgtttaccccttattccttcgtaaccatgcttacgtatgagtccctagtcaactatgacaattgcttagaaatgctattctagaatcatgcatactcatatttatcaaaatgctttatgcttgggcaattacctttgggaaggtaattgagatgcggcatgtggagacatgagcgccacattgccatgatattgatgacatgatttgtgaaaggagaaataaaactaaaacaactattttcgactggggctatagttggccatatggcccgaggcccga

SEQ ID NO: 25347 - DNA, 1501 bp, Oryza sativa
caacactaaccccgcttatctatgtatacctactgaactggagcagcctgtactactactccggctgaattatctcttctccggcgatgactctcgccgcgatcctcctcctcgtcctcgccctggtcgcgccgccgcttgccgccgccgccgtcctcgacgacggcggcggcggccaccgcccgccgttccacatgtgcgggatggtgcagggtcggttcgctcccaacagctcgtacgaggccaacctgcggcgtgtcgccgccacgctgccagccatggtggcgaacggatcctcctcctcctcctccggcgtcgatgtcctcgtcggcgagcggcccgaccagatctccacgtcggccttctgcggcgccaactcgtcggcggcgccggagtactccgactgcggcgcctgtgtcgaaacatgatttcggcaataataaaagggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctgaaaaataaagtcaggtgcatcgaatagatgcacctaataggtgtagccccccgacaatgtggttaattgaacaaaccaagcatatagtcaaggaataaataatccaaccaaccaagtggttttgataatcgtaatcaaccaagtgacttgatatcaatatatagtatatgcggtgtgaatcctccaaataacatgatccgagtgatataccaaaatagctataaaaaagctcgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaatgaccataatatataatcagcctaagccataatattggtcaataaaaatgcacacttacgtggcaaaaagcaatgatattatatccaatcaattgcttgataaacccaaacagcacctt

SEQ ID NO: 25348 - DNA, 1501 bp, Oryza sativa
gatatgtgcaagacaagcaaagtgccacagaacagtgggtgcgtacgtgtaccacatgcatactttaatttgatatactgttgtcaagctaattatgtaaactaaactgagcaaaattaattatattatttcctatgtgagatcattaattattttgataattgatactccctccgtttcatattataaggctttctagcattgtctatattcatagagatgttgaatattaacaatactagaaagtcttttaatatgaaaacggagaaaatagtaaccaaattaaggtcatatcaattccatcacttatcttatagtggagtactaatgtactatcgtagaattcaagtaaaccgtaggattggaggtcgtttaattagtaggtctgacagtaccggtcgataatgtaccatcacgcccaattaattaggtatagtgaacattatattgctggagtaaagccttatgaccaagttatcaacagtaccggagctagttttgtccttgaagggaaaaaaaaaagggaaaactgtagtgcaatattgaagagcatgtgcctatcatgttacacgagatgaaacctttggcatttctgtaggattatgtgacaatggtagaaattagttacaagatggattgctttgtagctaaacgatgttcttgatttgtgtatgcaccattgatcaatagttcaaaaataccataacaattgagatgatgcagtttggagagaagtgagatatataatccgaacaaagcattaaccatccatctgaacttggaaggtaagaaataattgagatgatatttctttgtgaggaaacaggccggagagaaataagagagctaattaggccatatataaattattcatcgaagggtttaaaataagcaaggtagcgtggcttcctgaaaaaatagagaaatgacattaactatatttatttggtggacagtacccgatctatattgctattttcattttaaaactatttcttgccaccatgcatacaaggcgccatatgcattgcatggaaatcaccttataaccaaccctatatattaaatttagcctttgatttcttctctacaaaataaatttccttaacacagtaggagttagtaggagacgaaaatatatagttagcacagagaaacccccatcatctgatgtcacactcccaatgagtgaagaataatactgctgctacctcgctcaatcattagtattcgcatacgaccgcaaaagatcatcgacggcaagagagagagagagagagagagagagcgacctcgatcttgatcttgatctcgatccagcccaaccaacggtcgctgttacgccacgtcacctcaccgacgccgacgcgccatcgcctcgcctctcacctactgcctcgtcctcctcccctctcccgccattgatataaacccccacctcctcctcctcacacctcacaccaatctccacctttcttcctcgtcgacgagatcatcggca

SEQ ID NO: 25349 - DNA, 1501 bp, Oryza sativa
aatgccgacctcagccaattggcaatgcaagttgctgtacgtttatctgatgacgagaacttgacaagtaccagcggcaacgcagaggaaatgaatattctcaaacgacaaacagcgcaactgtaatggcgggcgagagctactgatcattgtctcggtcaaaaaccgccaattgcgcgtttttttcctgcaaaagaaaaaaaattgttagttaagctcaggctcagagttgccgcgcaaggttcgtccgtcaaagaagggaaagaggaattgtacgttgcattctgccggccgcggcaatgctcgcagttgtagtcgtcgtcgttgccgtgctgctgccgctcgccgcggcgcagcagaccatgcagttctcgtcatgcgccagcggcgcctacgcggcgaacagcacgtacgaggcgaacctcgccgtcctcgcggcggcgctcccgggcaacgcgtccaccgcggcggcggccggctacgccacggccaccgtcggcgcggtgcccgaccaggtgtccgcgctggcgctgtgccgcggcgacgcgaacgccacggcgtgccgcgcgtgcgtcgcggcgtcgttccgcgtcgcgcggcgggactgccccagcagcaaggacgccaccacctaccaggacggctgcatcgtccgcttctccgaccagcggttcctcgacttcgtcggcgtgaactcgccggtcagcgagctctactccgacgccgacagcaacatcacggccgtcccggtggcctggttcaacgccgccgtcgtcgcgctgatgaacgcgacggtggacacggccgtggccgccggcagcggcagcaacaacaccaagaagtacttcgccacggcggtggaggacttcgacccgaagcactacccgaagatttacgggatggcgcagtgcgcgccggtgatgacggcggcgcagtgccggagctgcctcggcggcttcgtctcgtcgatcccatggttcttgaacgggaagcccggagggagagttcttgggatttggtgcaacctgaggtacagcgtgaagccgttctatcagggccagccaatgctgcagatttctgcgccgccggagccaccgccgccggccatgccttcacttgctgctccgccgactagaacaggtaaaagaattgccttctttttcttcttcttccattgaagaaacgatacttttttctcgcaaactttgacactgcacatatcaattcaacttctctgaatgtctgtttgttgtatgcagcgaggagaaggagagttgcagggatctctgcaggcgtcgcttgcttcgttgtcttgatgttgatactgtcagcttatgctttcattcgtttcaagagaaagaaggctgcaaagaaagacaactgtaagtaactgatgagtagcttgatgtttgttcaggaactgttttcttattttacatttattgatatgtattgcattaaaaaaaaaacacaacaacagtattgaagaaaatggcaagag

SEQ ID NO: 25350 - DNA, 1205 bp, Oryza sativa
acatatgcgtagaatgagatgtaatttagcgctaaaattagtttaaaaattaataattattaagcacatggtacggcatgactctttactgtagtacatggcccaaccaaccccaagtctcttattcgcttgtgatcaaatcaactatactcacatgtggaaagcacgcttgttttctagcacaacgaactaaggaataattatttccctacgtctcaacggcaaatctaccacgatcgattctcttccaagaaaaattaactagtctaatccactagtttagccataaactttggtcctgttattttctcataaagattaagattttacctcggtttccattactactaaacggtatatttcgtgcgaaaactttctataaaaaaagttattttaaaatatcaaatatatctatttataataattaaaacttaattaataataagttcataactttttctcgttttaactttatctttatcgtcatgagtttcgaacccaaccaaaatatcaccggcctggggaagttgtatactcgtataggccaccttcggcaaccgattttcatttcccttagaggatatttttttccaaactatgccatctgtgtcgatttattaatcaaaaagaaaaaaaatcaccggccaagattactacagctaaaatgccaataggtagcttgcactttctgtatgtcaatcaaaagcatcattctgctgcattgccctgaaagcatcacacacaaacacatatatactcctactgttcttgatactggcaaaaagtcaactaatctcatcatgccaccacaaatccaccatccatacatgcactcgctcactaggccccgttcagatctcacctcaaatttttcaccatatcacatcgaacgtataaacacctacataaaatatttaatataggctaaaaaataactaattacacagattacaagtaatttacgagacgaatcttttaagcctaattgctccataatttgataatgtgatgctaccgtaaacatgtgctaataacagattaattaggcttgataaattcgtcttgctatttactaacggaatatgtaactagttttttttttattaatggccgaacaccccatacagcatcctatataatacctgatgtgacacgctaaaattttacaccgttgcatctaaacccctcactaacccccggccagc

SEQ ID NO: 25351 - DNA, 1501 bp, Oryza sativa
ccaagatctattgttcacaccttaggcaaggtaaggggaaaaattaaatatggcgagtggagtctgtggctaggtaagaagaaaaaatataaggtggtgtttggatacagggacttaattttagtctctatatttagacactaatttaaagtattaaatatagactacttacaaaactaattacataaatgaaagctaatttgcaagacaaattttttaagcctaattaatccataattagagaatgtttactgtagcatcacataggctaatcatggattaattaggctcaatagatttatctcgcgaattagtctaagattatgtatgagtttttattaatagtctacgtttaatatttataattagtgtctaaacatccgatgtgatagggacttaaaagttttagtcccatctaaacagggtcaaatgtgatgagcgtagtctgtgactaaaaaccaattgactatgtttgggtaaaatgtggcattttttggttttcttttaggtgtttaatgtagctttggggaatgattttgaggtgtttttagtgtttgtaatattatggtgtttaaagtgagaactttttcttgggtcatgtgtatctcttgcctttgtttagaaaaaaatgtggcacttaattaagaaaacaaccctgtaaacagatggcctggcacgttaaagcgctgagctgttcagcgtgcagtggccgtggcccatggcagctcagcttgattatattccaattaggcccaaaactgtggcatttgggctaggcaaaatttgctacaggacacgcaaaaaacgtgtaattagctggaagacaccgcgaaaacgtgatacggctaacggacactacaaaaattgtgtaattagctataggacacttgtcgtattattttattattttcggatcaaaagaggtgagatatttttctaaatgcccagattgccccttctctttccttggttttctccttcgccgggatcgcgcgcagtggggtgaggttggcgaggtcggcacaagaggacgcctgtgcatgctccgacttgcaaatcagagaccagatcgagcccctgaccggctgcagctgcctcctggctgcctgctcaagctctcaagcctgaagtctgaaggagctcgccattgctgcctgctcaagctctcaagtctgaattgaaggagctagctagccatcttcttgctggtggagcgagctcgccggcgcatgcttggctgctgctagctgctagctggccggtcttcctcttgtccggcgagatggaggtgggcgccgtgagctgctaccggagagggagttggcggcgatgcgccgctgctctcgccctcgccgtagtcgtcgtcttcgccgcggacactcagcgccttcgccgagaacaccgagcgccttctcgccctgccgccccgctgccgccgagctcatgcccgcccactcgcgccgagctcgccgacgcctccccccacccgcgcggcagcggt

SEQ ID NO: 25352 - DNA, 1501 bp, Oryza sativa
acttatattgtgaaacggaggaagtggttagctaccaagaaattcttaatatctccggctctctagatttgaaggtcggccgacggaataactaaattgaccgccaagggcattttgttttcttgtagtgtcagtgacaaaatggtttacatctcaagttagtctctgccgtgccgtcaaccctggatggattatatgattgtgaccgtatatcgtatttagagtttatgttcaataaaacatgcaattatagaaatatggtggactctttaatctttactcctacttataatactgtagtttagataaaacaaaaggctatatcaattacaaactggagtatttactaatttttatatccgaattttgagcaaaaaaaaaagacataaaagtgctaattataagcctccaaagtccaatatgaggacaaccctatatttattaatctttaattttgaaatattaaattgaaaccccaacactaattacttatgattaattccaaaactccaaaatattaaataaaacacaaaaaaacacagaaactatattactaggatggattataaaatcagtattttattttattctataatttgaaattaataattgacaggtagtaactgctgtagactattctttccatctagtaattcaatatgattcaaaatgtagtcaccatatgattaaaattttaatttgtacattatttcctctgtttcgaaagagaaggcacattttattttgttaggacaagtttttgaccaacaatactttattataatatatttaggtgacacaaaattgaatttattatattcgtattcgaaagtacttagttatcattatgcttttataatatgtatcacataagatatcctaatagagcaattgttgatcaaaattttgtcctgccgaaacaaaatatgtttttatattttgatatgaagggagtactaataccaataacctgtggagcgcatagtttagcgactagcgagtaactgaagagtcattttttcataacataagttatgtggtatacacatttctctgtttttttttaaaatgttctagttagttttacgaggtcaaataagaaaagtcaggctacaaagacatcaaaagaagaagatggaaatattttcaaagcgcgttagccatgcacatcttatagttgttagtcaagctcaaggtataaattgtccactttatgattatcatatggttgttagtcaagctcaaggtattagatcgataaatctcgttagttacatcgttttccatgggtttgcctcctctcatatcgaaaagattatctccagttttaacttgtttcaccattgtcaacaaagtttggtaggggtaggcacgaccaaactacacatcgcctgcataaaaaccggatctgctacctcttaatttatcagtcccgtcacaatcagttgcttaattgaccagttaatgacaaatttaacgcggaggtgtccttccttgacca

SEQ ID NO: 25353 - DNA, 1153 bp, Oryza sativa
gatgattgacacgtatagtaccccaagtactcctacgggggcccgtgggcggccgcatcctatgcccgaattttcatcgagccaggcgtgcgggtttgtcctcgttaactaattcattaattaattactccctcagtccccttaaaagggatacttgtactgattgatcattcgtcttatttaaaaaaaattagaattatttttttttatttgtgacttactttattatctaatgtactttaagcttaacttttcgggttttatacttacacaaatttttaaaataagataagtgatcaaacagtgcaaacaaaatgtcaaaatcccttatattaagggatagagggagtagcttattatcttatttggtttcatgggctgatccaaacaggtgggctaattcattagcccatacaagaggtactaatgggctaattttctatagggacttaaaaaaagcagttatctctctcctatctctctaatctctcgccacattttagtcctgaattagcctatggttccaaacatgtcactctaagctaatgtttagcctaccgattcaagactaaacattagctctcaaaattagtcctgggctaatcttccaaatagggccaatttggatgttgtatagaggagcgcatgtgcatgccgttggttagtcgatacgttgttgaggtggtggtagtactttctcctccgtgaagacttagagcctgtttatgagagtttcgggtagtttgcagcttctctcggaattaaaaatttctcaaacagtataactttttttttatactatgagaagttctatttgtaaaatttagaaaaataaactagaaacctgaagctgtttcttcatattctcaaaagctgagtaccaaccagctgcttctcaaaatcttaagctaataaatccttaacagtgtttgagagaaggagaaagaaaaatgttgatataatacgtaaaacgagatgggtcattagcatatcattatttaagtattagttatttaaaacttaaaaatggattaatattattttttaaaacaactttcctataatttattttggaaaagtacaaattacctcccgaactattgcggtcgaccgaattaccccctaaaacccgaaaatcagacaacgttcaccc

SEQ ID NO: 25354 - DNA, 1501 bp, Oryza sativa
tctttctttttccttctccctctctcttccacgtcaccaaatatgcttgcatgataataaagagagaccgctaataaagaccattgtacatgccctaagcctgcatggaagagtatagagagtaagtttgtcttctttcgaacatttccctagctaacttctatcttccgtttttacacgtacgtttcctaaattatatttgatccatttccaaagttttttaagctaatatttaattaattatacgctaatttattgttccgttttacgtgctgaagtgagggttccaaatccgtagtagcgaatgcagcttaattaaatgggggtgtgcgattggagtgagcccttttgaattggaggaaaaatataggaattttggaggattttaatcatataggaaaattttctatgaagccctttgaaacaaaggattaagtcatatctaattctttgaaattcttatggaatggacaatcctatagaggttttagaggaaatttagcaagagcttcaacctcttggtaactttcctttgagtctatctctctcatccaattcctgtgtttttcctgcggttcaatcaaacagtcatttctgtgtttttcctgcgttttgcaattctttgttttacacttacattcctatcaaaatcctatgtttttttcaatcccgcgattcaaaggggccctaagtaagaagtggaagaattacctctccctccattttatattataagattctctttaatttatctatcataagtttaatttatccacgtttgtccaagtttttatgaaaatgtagcagcatttcaacataaaatgaatatattaaaaaatatatttagtgaaatcaattcggtgttctacgtattgcaatttttttatataaagttagttaaattcaaacaagcttgactttaaactgaaaattttttcaatgtctaagtatctggacaacataatttttttctcataatatacaggcaaaccttctagaagcgtggtagtcttcacaagttcacattggggaaaaaacgaaatatggatatatatatggtatcttttgaaatattaaactaacaaccgttattatctcgcagagtacggctaaatatggagtaccgggcgtgatggaaaacggaaaaaacatactgtattttgtcttaaagacacgacaggagtataggaccatagtttcactgaatgcttatcggttttgtaatattgatgtcaatttttgatgtgacatttatctattcatcttattaaaaatataaaatattatttacttattgttaacttattttatcatcaaagaaactataaccttaacctatatttttcatatttatactgaagttttaataagacgagtaagacgaatatttaaacaattatatgaaaaattaacggtgtcgtatataagaaaaactgcggtagtatcatttataaatgtaaatccatttctttttcccttgattgcacgctagatccggttc

SEQ ID NO: 25355 - DNA, 1501 bp, Oryza sativa
tctgttaaagcagtgtgcgcatggcgtatgcccaatactttggaaatttctttattcacaacatacaagcttctttatagctgttttgctatgtgaattttcaataatgtagtcgactttaagttacacgcatcatattttacaaagcagtcggtatatcacttggatcatattattcagggattcacacatcatatgctattatcgaaaccactcggttggttagattatttattccttgactatatgtttggtttgttcaattaaccacatagtcgggggctacacctattaggtgcatctagtcgatgcacctgactttatttttcagccctccacagtcttcagatttggtaaaagtactcgggaagtcatggcaaagatgattgaagcactcggctttggagtaatctagttcgagagaagattatcttttcgactgtgaaggtctcaggggctactgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatgagacacaactagatcgtcagatcaatacacacccggcggattcaaatccccaaacaggagtagggtattacctctcattgagagggcctgaacctgtctaaatcatttgtctccgcatccatccacttttagggctcgtgcgctacccccttttattattgccgaattcatgtttcggcacattgtttgccgtgatggaagcgcactggatattattgctgaggataatggtataatgatgtatcccattcgaaatacttatatgtatcatgcgattcctaggtatcgacgtataatatcttttaagatattatcccgtctaaacatgatagtgttgtataggtgctaatgatattagtattaaggacctattttatttacaaataggacttcaatgccaataacatggcactgagagctatatgtaaatatttttatattacaagtaaatccttttttaattaaaaatattcctttcacgaataggctctcgacactacttattgctgtctagcctatctatttataaaataagtttttgtaaataaaaatctaaaatataaaaaatccccattgtttgccctcacgccggccatgcaatggtcgtcacggcagcttgacgtgggcccaccagcatttatgcctgggtcccatgatgtcaggatcgacgacagcgcaacatagacgagtcaagcaagctccactcgagtcaaccaagggcccaccgctcatctatcatctcttctccatttatccctctttgctcgccgaccacctcc

SEQ ID NO: 25356 - DNA, 1501 bp, Oryza sativa
gcatgtcgccgccgcgctgccagccatggtggcgaacggatcctccacctcaaatcgctccagctgcgtcggcatcctcgctggcgtgcggccggaccagatctccgcgtcggccttctgctgcgactcgtcggagccggcgtactccgactgcggcgcctgcgtcgccatggcgttccggtacgcgcggtggctgtgcgggtacagcaggcgcgccatggtcgacctcggcgcctgccgcgtcggctaccacgacgtcgaacgcatggagcgggagatgcgcgccgtgtcagccgttcgccgtgagtgatctatttgttactccctccatcctaaaatataaatttttagcatagtaaaaagtcaaatatttttagctttaattattaatagtaaaaaaataaaaaagatcaattatgtaaaattaatgttactagatttgtcattggacaactatcataatatgtaactctttttatttaaaacatattatttttatagatattgctggtcttttttttcgaacagtcaggctgttgacgacgttttatataaaaagaaggtgtctggtttttaggagaaaacgagaccaaaccttacaatgcgcagttaattaggggtagatattgcaagtcaaagtatcatcttggagaccgtgttagagaaaaaaatacttatattttggacggagggaatagctcgataaatttttgtcttttgattatactgtgattttgttcgccttcctttattgattcagaatttcaggtagactctgcatcatccgaatcagcatttttcttcttcttttatttttttcagatacttcaccttggtggaaaattgtttcgatctatgatttccctgtgatggtggtgttcgaagtgatcggaatagcctgtgttctgttcattttcctccaggaatggggagacggtagaaggagaagaacccaggccaatcggctgccataggtggaggttcagttcaggtatatttcatctggttttgttaattcgaaaagttgttacaaatatcatagaatactccaacttggttaaatgcaaatataatgtagacaaaccagagttcttggagatcttggtcggactcttcactggtattcaaattccatttggtacagggttgtcaacttctgtctgtagccgcggttgatcgtagaccacagaacaagcaaaatccagttgcccaaaagaaaagggcacatttctacacaagatgtagatgcagttttcgtgtctaagactgttcattcagaaattaatagggatattttctcttgctcttctgattgatcaaatggaaaggatgatactgatgtaatattggagagtgcgaactgataaatgtgcatatactgagataaaagttttcaggaaaaagtgcgcactacgaacaaacgtggaactaaatagcagtacccgaaattgtgtctgcctgtcttgctacctagtactatggtttacttttgaagctttat

SEQ ID NO: 25357 - DNA, 1501 bp, Oryza sativa
aggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtctatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaaggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttc

SEQ ID NO: 25358 - DNA, 282 bp, Oryza sativa
ttctttatcttgtccggtaatgcttttacatggtttacttctttaccggcaaattctattcatacttgggctcaattagaagaaaaatttcatgattatttctatactggagaaactgagcttaggtttttttttttaacatcggttaagcaaaagtataatgagcctgtcattgattatattaagagatttagggatgttagaaaccgatgttatagcttgaatataactgatagagatttggctggtcttgcttttaatggtttaattgctcctcttaga

SEQ ID NO: 25359 - DNA, 1501 bp, Oryza sativa; identical to SEQ ID NO: 25344

SEQ ID NO: 25360 - DNA, 347 bp, Oryza sativa
cccggtaccaatgatccccgtactattcaaataccgtagtcgcgatctcaaacgtcgacggtattccaaggtatcatatttatttaatttcgaagggaagatttataagagagaactatgctaataatttatgtataccacttttatggtcagagtctaagtaggggttaatacattcataagggtagagtgacacgaaacaaataactcatatcttctcattaattaatcctaaactatgtggaagaagaaatagagaagcaatcaattcctttacttctagtatatactcaaccttagtttacatctgctagtatataattgtgcggccaaaaccccctaatagt

SEQ ID NO: 25361 - DNA, 1501 bp, Oryza sativa
atgctctaagccgtctctagcaaagcaagctgcatttaattctctaattgtatctttcaagttatgtaggatcaactgtaaacatcacttgagtagccacttatatgtcaaccatagacggaagactatgttcaatcaataaaaaaataaaccatgtgatttatcacaaagcagacggatttatcaacaacaatggtgtaatattcctaattcattcgaactaattcattcgaactaaacagtacaatagtgattcagattgttacttgatcgaaagaatattcacagattgacaaataactaattcatagaccgacaaaataacttagtctgttgcaatgatccatacatcaacattcgataaaagaaattaggccattacaacgatccatactgccaatagatggtaacaacacaattgttcttacatgacaccagcgaattactaaaaattactttataactagattatctttctcaagcagccaaaacaagctgctagcctgccaaattgagcatcttcactacctgtcattaaagcaacattatttccatggaaaataggaggctgatgattatagaacaattgtagcatataatctggatggcaaaacaactggaaggaagtagtactactattttaagtagaaacaaaaggactattaaaggacttatttgattatgttgttctttggactgtacagtgcaagtagacatgtacatacctcccaaaaccatagcagaaagcaccaaaaagctaccaccaaagttttccattgtccctgaaataaataaataaaatgataagtgaattaagatgcttgcaattgtaattgaaaatgtgaaaacaagatgcttaatgtcctaccacaactaagtacgacgggtattgctaaacttttgccaaatatgttcaactagatctttttttagttgggaatgtggtgcacgagcatgtattgcagttttcctacacagcacctgatcaaagcatggattgtgcccagtagttacttcaggaggaagagcaaccgatgctccagggtccacattcagatcaataggaattttaacccccctctctcattttcaactatcatattatggagaataatacaagctttcatgattctctcaacactcttccgtttccacgaccgtgttgggtggcgcacaatattgaaactctcctcttaattaacaagtcggttttgagttactattatagattaatactacctccgtcccaaaataagtgtagccgtggatatctgcgcccaacgtttgaccgtccgtcttatttgaaaaatttataaaaaaattgaaaatatttagtcacatataaagtactatttatattttatcatctaatagcaataaaaatactaatcataaaaatattttaaataaaacgaacggtcaaacgttgaatgtgaatagtataaaactacacttattatgagacagagggagtaataataattggactagttaaccaaga

SEQ ID NO: 25362 - DNA, 1501 bp, Oryza sativa
gagcgcctcttcgcctataaaatcccaaccccacgcccacaatcctttcccccttcgccccgtgctccttggaacgaagtactacccccgcctccttcgtcgccacggccaagaacgccgcaccgacaccaagccgttccaccccgtgtcccctccttcctcggagcgcccgcctcggcgtcgcgttcgccaccgtgcgccgccgctcggccaagcgccgccaacggagtccctcgcgcccctccttgctttcccggccgcgccatctccgcgccgtgccgcccagccgtcgcgtctgcctcgccgcgactccatccgccccgccgttcccgctcgtgggtgagctccccgcccaaatcctctcgtctatatcctctagcgactcctaaacagcactggggcatggtagtttgtgcgttcgtcctccaaatcgcgcccttgccgatgctttgcttccgccgccgcccgcgcgccgccggtcggtcccgcgccgaatcccctcgccgccacccaccttgagctccaatgaaccaccccaaaccgccaattccgccgccggcctcctcttttgctcccgcgccatgccacccatcccgccgtcgcacggcctccgtcgcgcctcctctcccacatccgagccggtggatggaacctccgtgaccccctctcgcttccggtgcccgccgcccactccggtttgccaccgttcgccggattccgccgcgcgccgtcagccgtccgatgcgccgccagcctcctctccctccccatccgacgtggcagccacatcggcttgaccaagtcaagctgaccggtcgcgcctgccccgtcagcgcccagtcagccaccccctcctctctctcccgtgcttgtgggcttggcccatcggccaccctcctcctcggcctgataagagaaaggaagtccattataactccctccccaaacacagtgaccaaaagtctatatctgctccctcccaattcacctctctctcgccatatgttggcccccacatgtcaatgagtgataaaagaatattcttgagaatgttcttttccagaaaattcaataaatcctttttcccttgttccctaaatcaattctttattctagaattgcaataaatcatttctcatattccggaaaatccaattaaacttcgaaaatccatatcttttgaaccgctcatccgatttacttcgttcaacttccagtaatttcgtaaaattgagatctattcaatggcactattatttagtctaaatagggtctttttcttggtcttttgtttaggtttttgtttgtttgcgtatagttgcggttaccagattttcgtcgatcgcgggttttctcgaagattcgtgaagctccgtgaagaccttgagcaaggcaagtctccctttgaccaattgctcctataattggaaaatcattattattttgtttgtaacttgcattattagaatcacacacttaatttgcttggcctcggtttgcg

SEQ ID NO: 25363 - DNA, 1029 bp, Oryza sativa
tgcggagaggatgaaacgagggagccacctgctaaaatgggccgactcggcccagcccatgattcggtcgaacccgccgtcgcgccgtttgatccagggttttgatggacggctgagatttgctccctatgatggttggagggtattaccgaccattccaaccgtcggaaccgccattctcaactataaaaggccttcatgtcgtcactttctacacacacctcaagcaaaaagcttcatacatctctcaggtttagtatagtttctagagtacagtggaatagaaatagaatagaatcttcagtcctcggagtcttcagaagaattcgggtatggctctagtagcttttccttcttttgtaagacttgtactttatttagaatattcttcttaatactactctggtattgtattactttccgagtatatgaataccaactttactatatatccgagttatatttattatgatgctagcttatctgggaaatgcaatggtgtgggtataatgagcgtgtatacgatgactctatgtcatgacgatgatattagagtagtatttggtaatttaagcgtggtgtttagattaccggatatcattatttggcgttatatgctgcggaagcgatgtgggccgctaatggtgacagctcagtatgggtatttctccgcgcgtgtatatagtccaaagttaatttcctgtggagggtactcctccgtatttagcccccgttggatggtcatgacggattgtcgcaaggaactcgacaatcagggggtggcttctcgaagcaccagagggcattggaaagagggtaattatataactaggatgtatgtatattatatatgtatactagaagtataggaatatgatctttctactttctttccacttagcttagataattatgaatgagagtataaatgcttctgcttagtgtcgctctactcttttgattatattaacccctgcctagactttggttattgcaagtaacatataaattattagtatggctctctct

SEQ ID NO: 25364 - DNA, 1501 bp, Oryza sativa
ctaccttaaatgtgtacatgcatgcatgcgtaatcaatttgatgcacatatacaataaaccctacaattataatcatgcacattaaaggagggtgtgatcaattttttttttggctatatgatgatgaatattccctccgtttttaaatatttgacgccgttgacttttttaaatatgtttgactttttttcgtcttattcaaaaaaaattaaataattattaattcttttcctatcatttgattcattgttaaatatactcatatagttttacatatttcataaaagtttttgaataaaacgaaaggtcaaacatgtacttaaaaaatcaacgttgtcaaatactcctatttagaaacggagggagtatataatagatagagtataaaattatctctacatgtcacttaattattggatgtcttatatgtccatctataaattgattgatcctttaacttttgttacttaccattgatattttctattatttcgatatgcatcactaattagttaaaagccataatcgtagtcgaaagttgacggtgactgggtgacagcattaatcaaaatgctaagatctgccccaggtttcgcaacagcttttgcacacaggatttcatagcttttttgcatcaccccatcctctcgttcattcaataatctactgacacgatacaactagtgtaagattaaacacacatttgtaactatatactagtgcatacagccatagttactagtgctagtaccagttggttcgtgcaaaccggccagcggcgccggcgcccgcgccacccgcgggcgcgtttcggcgccgtacgcgacagcgacacgccctgcaggtaaccggcttataccaggccggcgcgcgccgccaaagctgttaagcggtaaaaattaagaaatatcttcttctaagctactcaagctagctaaactaaagcaaaggcaggcaaagactaattaatcacgacgagttagtaattaaccagcaatcttacatggactagaggcaaattaatttaaataagagtaaagacagcgtcacataccctttggtagtttggttacctcggaggactgtgacagctagggatgatcgatcgatcgacacatatgatactgacagcgaacgccggcgacgacaccgtctattgctagctatagctggtggtaataatatcaccatcttggttaactagtccaattattattactccctctgtctcataataagtgtagttttatactattcacattcaacgtttgaccgttcgttttatttaaaatatttttatgattagtatttttattgctattagatgataaaatataaatagtactttatatgtgactaaatattttcaatttttttataaatttttcaaataagacggacggtcaaacgttgggcgcagatatccacggctacacttattttgggacggaggtagtattaatctataatagtaactcaaaaccgacttgttaattaaga

SEQ ID NO: 25365 - DNA, 1501 bp, Oryza sativa
gcactagaaggattcccagctcctaaagcacatgatttcaacttatccttgaggagattaatttcagagagatatgaagcacaagtagaacaggtatcctcctcaggaatcatggatcgaagcctagcaatttctagcgccataccatcattttcagattttagtttctcaattttatacttagaagacctatacttgtcactaatttcaatcatcaagtgtgccattctttctttgcttagttcatcatcaacagagtcattatctgagcaaaaatcatcacaaagagaaccatccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttatggatcgccttcttcatcaaatccttattcccctttcgcccttgtccctcgggcttcttggtcgtcttgtcactcttcttcttcaacttgggacaattcactcttatgtggttaggctctccacactcaaaacacacaaatggttcattggtttttcctctttttctatctctcacatttttgtaagctcttgagaattttctagcaaaaagagcaagatcctcttcaggaatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaatatccatctcatgggtttttagctttgagtaaagcttgtccatggtaaggtcactcagaggtgcactctctgtgatggaagtaactttcatttcccaaacaccataatcaagacaattcaaaagatggcgagcattatcattattagaaaattcttttccaacagatctcaacttcgaaacaatttctccaaaacgcttgaaataagaatcaatggactctcctgggtgcatctcaaatctttgatattctttatgaaattgattctgacgaaccaattgaatatcattgtttcccttatggaaattgcacagagcagtccacatgtcatgagcggacttgtggtgttgaacacaattaaattcaccagaagaaattccaccaatgattgcatttcttgcacgataattaaaatcaacctgagccacatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagaatatttttcctccatagcggcgttcgttgccacggttaggttacaat

SEQ ID NO: 25366 - DNA, 1501 bp, Oryza sativa
atgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctgatcagagtaaaactattcgaatagccgtgcccgcggttatgggcgagttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtgtgctgttcagtgttgattaaaattgatgattaatcacttcactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgttgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacaactgacacggcgggccacacgcatgccgtgccggcacgggcacggcccggccatccacgggccgtgcttgggccggcggctcggcacgtgggtcgggacggcacggcccgtttcatgagccgtgcctaacaggccgtgccgaaacgggccgtgccggacccgtgcccgtgccgtgccgggccgggccgcccgtttggccacctctaccgtggacgaagccatcttgggtgctgaaaggagagggaaagtaatggaaaagatagactgtgacactgatgtgtgggccctacataatgacttagcaggttagacaagtctaagcatcacatcagcgaaactgctctctagaatcatcaagggagtcaaattgcaccggttttaacagttaaggtcaagatatccggtattacggtttagggatatgaatcagatttaagctatagttaagggagtcaaaatggacctattccttccgaaaataaaaaggaggaataagttcactttgggtccctctatttgtcgccaaatccgattttcatcccctattcacaaaaccggtacgatgggtcccccaacctaacgaaaccgtttaaataaagtccctcggtggtattgtacccgtttttggctgagatggcgcctacatagctccttttgaccaggtctttgtccaacgtatcgttgacgtggtgcttatgtagcaattagatcg

SEQ ID NO: 25367 - DNA, 1501 bp, Oryza sativa
ctaaatctagtcattaacatgtgattcgcccggcaaatagttctgaaagaatttttagtataaacattcatttttttctagctagtttggatcataaaagtcatcatgggatttcaaataaattgtgaagtgtagttttttgcttgttttattatttatcatatacttttttctactataattttgtactgaaaattcgaattatttttagtcaactgtaaaataattatatatatgttgccctggaattctcaaacgaatgtaaaacacgagctttgagcatatgtttaaaatcctttcttaaaactgaataaatggaagcaatccatttttatcctctatggacttgttcgatagggctacaacaactaaatgtaactctaaaaattgattctgaagtggagttgtgaaacaggatgaagccggcttcacccgtctagttcgttttgtaaaagcgcttcagctgactccactcttatttttgaatggaggtgaaactgtttgactgggcttcaatttcagaaaagttaaagttagagttagagctatgctaaacagactccatatagctccatattgctaatttgctagtggtaagtttggagcttgatttttcttttctttttcatggccatatgcccattcatgtcacggtcttggatgaccactggtgagccgaataccttgacgagtccaattagcatgcctggccacttggccagtcgcctacaaacttgcaaagtttgcaaatttgtggataattaattcgctactgatgcgatgcaacattgccacttgattacaagttgcaatacttggattattgcgaattgcattgcacattgggcgtgattatcgctgccatgcaagttgcaactggaagcctgtgaatcccaaggccggtgaagtcatcgactagtctttggtctttggcttttgcgactccatcgcctccttttccatagccgcctgcgcactactgtcacttctttccgctacgatgaatcgatgatagaggaggttggtcagttggtggcccgaatgaagcgtgttcaccttgaaatttgaatacgttttccctgatttcaacaattaattgctaatttcaaacaaattcaaaagagtgattatacagtttttatgaaagtatcgggagacactatgttttctaaaagatttgctccggtctaacagaaagtatctcgaggtaccgatacctcgtgataccaaatcgtttctgatcgttggatctaacaatatccatcctgtccagttagatccaacgatcggaaataatttggtacagtgaggtaccggcatctcgagatactttttgttggaccggagcaaatctcgttttctaatataaaatttggcgcgatagctaattcgcgcttgcgcgttggcggcgcgcgtttcaggcctataaggcctagcgctggcgcgtatgcgtgcggacagtgtccacatccgtatatttttcccataaaaaatctaacgt

SEQ ID NO: 25368 - DNA, 1501 bp, Oryza sativa
tcagttacttacagttgtctttctttgcagccttctttctcttgaaacgaatgaaagcataagctgacagtatcaacatcaagacaacgaagcaagcgacgcctgcagagatccctgcaactctccttctcctcgctgcatacaacaaacagacattcagagaagttgaattgatatgtgcagtgtcaaagtttgcgagaaaaaagtatcgtttcttcaatggaagaagaagaaaaagaaggcaattcttttacctgttctagtcggcggagcagcaagtgaaggcatggccggcggcggtggctccggcggcgcagaaatctgcagcattggctggccctgatagaacggcttcacgctgtacctcaggttgcaccaaatcccaagaactctccctccgggcttcccgttcaagaaccatgggatcgacgagacgaagccgccgaggcagctccggcactgcgccgccgtcatcaccggcgcgcactgcgccatcccgtaaatcttcgggtagtgcttcgggtcgaagtcctccaccgccgtggcgaagtacttcttggtgttgttgctgccgctgccggcggccacggccgtgtccaccgtcgcgttcatcagcgcgacgacggcggcgttgaaccaggccaccgggacggccgtgatgttgctgtcggcgtcggagtagagctcgctgaccggcgagttcacgccgacgaagtcgaggaaccgctggtcggagaagcggacgatgcagccgtcctggtaggtggtggcgtccttgctgctggggcagtcccgccgcgcgacgcggaacgacgccgcgacgcacgcgcggcacgccgtggcgttcgcgtcgccgcggcacagcgccagcgcggacacctggtcgggcaccgcgccgacggtggccgtggcgtagccggccgccgccgcggtggacgcgttgcccgggagcgccgccgcgaggacggcgaggttcgcctcgtacgtgctgttcgccgcgtaggcgccgctggcgcatgacgagaactgcatggtctgctgcgccgcggcgagcggcagcagcacggcaacgacgacgactacaactgcgagcattgccgcggccggcagaatgcaacgtacaattcctctttcccttctttgacggacgaaccttgcgcggcaactctgagcctgagcttaactaacaattttttttcttttgcaggaaaaaaacgcgcaattggcggtttttgaccgagacaatgatcagtagctctcgcccgccattacagttgcgctgtttgtcgtttgagaatattcatttcctctgcgttgccgctggtacttgtcaagttctcgtcatcagataaacgtacagcaacttgcattgccaattggctgaggtcggcatttccgtgtcggaaggtgaggcccattctccccggcgaactccggtctcgcgtcggtctccctacataagtcgcctgcctccacctcttgacagtgtcagctgtgtcca

SEQ ID NO: 25369 - DNA, 1501 bp, Oryza sativa
tatttacaaaaacttattttataaatagataggctagacagcaataagtagtgtcgagagcctattcgtgaaaggaatatttttaattaaaaaaggatttacttgtaatataaaaatatttacatatagctctcagtgccatgttattggcattgaagtcctatttgtaaataaaataggtccttaatactaatatcattagcacctatacaacactatcatgtttagacgggataatatcttaaaagatattatacgtcgatacctaggaatcgcatgatacatataagtatttcgaatgggatacatcattataccattatcctcagcaataatatccagtgcgcttccatcacggcaaacaatgtgccgaaacatgaattcggcaataataaaagggggtagcgcacgagccctaaaagtggatggatgcggagacaaatgatttagacaggttcaggccctctcaatgagaggtaataccctactcctgtttggggatttgaatccgccgggtgtgtattgatctgacgatctagttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatcttctctcgaactagattactccaaagccgagtgcttcaatcatctttgccatgacttcccgagtacttttaccaaatctgaagactgtggagggctgaaaaataaagtcaggtgcatcgactagatgcacctaataggtgtagcccccgactatgtggttaattgaacaaaccaaacatatagtcaaggaataaataatctaaccaaccgagtggtttcgataatagcatatgatgtgtgaatccctgaataatatgatccaagtgatataccgactgctttgtaaaatatgatgcgtgtaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaagacacatggtttcaccacacctgaaaatatatggcatatgtggtgtaaaatccgagtaaataaactcataaaggatttaccaaccgcctagaaaatgaccaaaatatataatcagcccaagccataatattggtcaataaaagtgtacacttacgtggcaaaaaacaatgatattgtatccaatcaattgctttatgaacccaaacagcacctt

SEQ ID NO: 25370 - DNA, 859 bp, Oryza sativa
aaagaggagaggtatgactttaatatcaccaaggctgacaaaatttttgacttgctactccgagaaaagcagattcaacttcctaccggtcatacaattccatcggctgaagaaattgggcaagaaaaggtattgcaagtggcataattctgtgtctcatactactaatgattgcaaggtcttcaggtagcagatccaagcagctattgaaggaggcaaaatcatgtttgatgattctaagaggccgatgaaagttgatggcaatccttttcctatcaatatggtgcatacaactagccgaatagccgatgggggtcgtgcaagaggttttcaggcaaattcggctaagattatcaacaaatatcagaggaagtatgataaacagcaggtgaagtattatgaagaagatgatgatggctttgatccttgttggggttgcgagttctttagattttgttggaatgaaggtatgaggctgccatctattaaggactgtcctgggtacagtgatactgcggagagctcaagccgatcatatagtaggggcaatcggctaaggcagacaagggttcctgttcatcaaagattgggtccagtaaaccaagatcgtagccgggaggacaacgaaacaagaaaactcaatggtgtccttctagtatctttacaaagaatcagaagagaagggttcaaagattgaggaacagggagcgctttcaggaggtcgagtaggaaatcaatcattggctaaagaagacaaagccgaagcaggagtgacgtgttaagaatcaagttcttgtagacgatgaagccacagccgatgaagcaagaagattggctaaaggaaaaagtgttgtaactg

SEQ ID NO: 25371 - DNA, 1501 bp, Oryza sativa
gagttaaattattctggtttaaggctgcgttctttacctccggttcccaactttcctccctcattttccgcacgcatggttttcaaactactaaacggtgcgttttttgcaaaaaaaaattctatacgaaagttgcttcaaaaaatcatattaatccattttttttaaaaaagcaaatagttaattaatcacgtgctaatcgctcatccgttttctgtgccagggagtgagggttcgaacacagtctaagcaattgaaggagtcgttatacctggttttacggttgaggaataaagatcagatccaacctacagttgagggagtcatattggactttttctataataaacaataacaaggtgacatcgcaagtgatgcctacagccctacattgatttctgtatctgcatatttatcagtccgcactctccagtctccaacattatacggagtatcagtatatcgccttttccatttgataaatcggaggaacaaggaaacagtccctatcaatttctgaatgtacaatcttgtatggaaatatatgggcccttttcttttgccgcaaatggatttgcttgttcaggatcagccgatcggtcgaattacaaacagaagttgaaaccctgtatcaaatggaatatggatatcagtcaagaatccgaccaagatctcaaagaactctggttaacttgtctacattatatttgcatttcaaccaagttgaaacattctatgatattataacgaacttttcgaattcttgttgggaataaacaaaaccagatgaaacatacctgaactgaacctcccacctatggcagccgattggcctgggctcttctccttctaccgtctcgccattcctggaggaacatgaacagaacccaggcgactccgatcacttggaacaccaccatcatagggaaatcatgggtcaaaacaattctccaccaagatgaagtatctggaaaagaaaacgactaaaatgttgattcggatgaagcaaagtctatctgaaattctggaatcagtactgaattaaggcgaacaaaatcacagtataattatatctatcgagctagcagtagcagatcactcacgctcgtcgaagatgcgaacggctaatgaagcttgtatctccagctccacgcgtccgacgtcgtggtagctgacgcggcaggcgccgaggtcgaccatggcgcgcctgctatacccgcacagccgccgcgcgtaccggagcgccttggcgacgcaggctgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagata

SEQ ID NO: 25372 - DNA, 295 bp, Oryza sativa
agtagcttgttgttggagaatccatctttttaacccatctcttcaaaaactttaaagtcaccaaaattcccctactctggcgtgccactgtcgacgtctgagatcacgactacggtattttgcatagtatggggatttttgatactagggtatatgcgagattgaggtaaaagagatggagatagagatttttatacaagttcgggccccttatctaacaggtaatagccctacatcctgttggccgaagccggtgttgctctttattcatcaggatcacacaagtacaatattt

SEQ ID NO: 25373 - DNA, 163 bp, Oryza sativa
actctgtattaatagaaatatcttttctgagtaactaagatttacattgtgagaatatttcttagttaggtcctatagcatattggatgattattcactattgctcacttataaatagtgattactttggtgagttactattggtatttcttaacgtcacaga

SEQ ID NO: 25374 - DNA, 336 bp, Oryza sativa
cgttgggaaagtactttgcttttcatatgagcaataatttttctttctggaaacgaagtgaccaagtgaaatttctcgcttgagtaaggtcaaagtaaatcctcgatggtagcttttataacataaatagaaaaaagtagaaaccattaatatattatagttggcatatttgaaaaatacatctgtgtaatacccaatattcatattttctatgcataataccatctttccctaagatatctgggttcggatgcctatgttgtacagtgccttacctttttcttaagaaaacacttcatatgtaattgttatttatgtgatcgcttgtgttgaagg

SEQ ID NO: 25375 - DNA, 1501 bp, Oryza sativa; identical to SEQ ID NO: 25340

SEQ ID NO: 25376 - DNA, 1501 bp, Oryza sativa; identical to SEQ ID NO: 25339

SEQ ID NO: 25377 - DNA, 1501 bp, Oryza sativa
gtctatgatgcccgtagacatcccgaatcacacagattcgtttccgaccactcgagtcatccatctgccacataggctgattctggttacgattcccaatccacaataacttttcacaaagcacaggcaaacaaatctacgcaacgagaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggataaaatccttcacataaatataggccatttcagttttcgcaaatcaaactccaaccacctcgatcggtaatctggcaagcttcgcgttcttgccttaccaggaacccgggttggctccaaccgaccccgcctcggcgttccccaactattggcatgcgaggtttccctgaaccgactagttacttagctagggtgtcccattccaccttgtggttgcactttgttatgcttgatgaatttcccacaggaatcggtccttatatgtgaatacggaacagtgccacgcaggcacaacccccgcatcgcgagttttcacaattcattttatttttaaacacaccgacaccacatgtcgggttttcaaggcttctcaaacccattcacaatttttcgacaatcaacggtgtatgtgggatatttggtatacgcgctcagagagcatggatactgaagtaccgcaaaggtggagcgacaaggaatctggatagtacaacctacaggaattagtgcaactactaggtaggtccgtcggtttggcacgcaaaccgaggccaagcaaattaagtgtgtgattctaataatgcaagttacaaacaaaataataatgattttccaattataggagcaattggtcaaagggagacttgccttgctcaaggtcttcacggagcttcacgaatcttcgagaaaacccgcgatcgacgaaaatctggtaaccgcaactatacgcaaacaaacaaaaacctaaacaaaagaccaagaaaaagaccctatttagactaaataatagtgccattgaatagatctcaattttacgaaattactggaagttgaacgaagtaaatcggatgagcggttcaaaagatatggattttcgaagtttaattggattttccggaatatgagaaatgatttattgcaattctagaataaagaattgatttagggaacaagggaaaaaggatttattgaattttctggaaaagaacattctcaagaatattcttttatcactcattgacatgtgggggccaacatatggcgagagagaggtgaattgggagggagcagatatagacttttggtcactgtgtttggggagggagttataatggacttcctttctcttatcaggccgaggaggagggtggccgatgggccaagcccacaagc

SEQ ID NO: 25378 - DNA, 1501 bp, Oryza sativa
accgtgcgccgcccctttgtgccgctgacgtgcggggcccgcctgtcggcgctggtttccccttgctgacgtcagcgaggtccatttcctttgtaaaaataaataataattgcgcaataaatcgagtttaattctagaaattcattaaaatggctcaaaacttctaaaatccatatctaattcattcgaactccgaattgagctgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttaccgtttgcaaataaatatgcatgttttgctaattacacgggatcagggtttacctatctgctcgcttgtgccatgtttacttgatatctgttctttgtcaaccttgggtaataaatcgactagctcatgttacttatgtgacctagctagaactatatgcttagccatgcttaattactactagctcagttgatggggtaattacagtattagacctttttagtatcagattgagctgtgtgctcgagacacctggccatgcttcatggtcgtaattatccaactaaaatgcgactacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaa

SEQ ID NO: 25379 - DNA, 1501 bp, Oryza sativa
ttcttctaatgactcagcttttgtgtgtggtggcttctctcttgccgctttacactcagtcactgaggagcaattagagaagattcctgaagaggatcttgctctttttgctagaaaattctcaagagcttacaaaaatgtgagagatagaaaaagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaataaggatttgatgaagaaggcgatccataaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttggatggttctctttgtgatgatttttgctcagataatgactctgttgatgatgaactaagcaaagaaagaatggcacacttgatgattgaaattagtgacaagtataggtcttctaagtataaaattgagaaactaaaatctgaaaatgatggtatggcgctagaaattgctaggcttcgatccatgattcctgaggaggatacctgttctacttgtgcttcatatctctctgaaattaatctcctcaaggataagttgaaatcatgtgctttaggagctgggaatccttctagtgctagtgttgcttgctctacttgctatgaaatgaaagttgatatgggtttgcttgagatggaattgaaagaactaaaagaaaaaaaatttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcatcatgcatttctctgaaagttgatcttgagtctgctaagagagagaacttttacctacaacaatctttagagaggtttgctcaaggaaagaaaaagttgaacatgatcctagactaatccaaagtgtccataaacaatcaaggtataggctatgattttgatgagtctttgaggataggtacccatgagatattaggtgtcacagatgggatgatagaactagctcaaaagcctataaccttcaagtctgcaggtttcattggaaacactagttctagttcacccaaaacctcagaaccaaagatggtacctatgactagcaagtctaagcctgtagagttacctagacccaaaaatccaaaacaagttgagcac

SEQ ID NO: 25380 - DNA, 253 bp, Oryza sativa
tcctaagtagcatatgggattattgttcactataaacaactaaaatatagtaattgctttggtgagttataaacactaaagtagatattgattgcttagaagtggtgtttaggtaattgtatacagtaattgctgtgtatcccacactagtttgaggtaggtgtagaggtggtgacagccctcaagatcacttaagtcctctctctctccgggtacgtagtagagcgacatctgggaacagcgggttgccagt

SEQ ID NO: 25381 - DNA, 615 bp, Oryza sativa
agaacccggtgatcttggctatatgtatatgtagatgcatgtagtaggtgcagggtgtgtgcattgacatgtcacctttccgaatcatcaccttttctcctctttctggcctgcaattatgaatcttctccacacttgactacgtaccagcggccatgtctgccggccggccgtgttcaactccaaccaagcaccaatatctggactctggtcgggtgacactaagttgacacaagattacatcgatgatgcacgatgcaggccaatctgggcggctgagatgagatggcttcatggcgacaactactgtggtcacaaataattgcccactagctgcaacccaacaactcagacagccttggaggggaagattatatatttaacccttcacccactggcccatacggacatcaagcaacggtctgcagatcacccccaactgcaaggaccatttgacactgccatcatcattcaaaacagacctaaaactgattccagtcaggaaccatgataacgtggtcgcatcacaaatgcacatgcaagaggcaacacaggtcaggtcagctttatctaggattgttacagaggctgcaggatatgtacaataatatgttg

SEQ ID NO: 25382 - DNA, 1501 bp, Oryza sativa
gtgtagttcagtgtagaacttgccgtcgatcgccgtaaacttgcgtaaaaacctgatgatggcgtcacggtgggcagggttgcggtactggtacggttgctgatggagcttcacccagtggttgtcgccggggcggcaataccagagctccgggtaggcgaggtcgatgacgagcacggtgcagctggtcgggtccatgggaccgcagcatgacaggaggcacctccggcgatggctgccttcggcggcgaggacggtgccgtcgtggtcgggaggcagcccgacacggcggccggtgaaagggtcccataaaaaagtgcacggcgagccgcggcgcgccatgagcaaccagccctgcgccgtggtccaccagcggtggcatctcatcatgtcgtcgacgccgccgtcgcccaccctcgttggcgttggcattggcagcagcgccctcgtcggcacgctgtacaggaacgtggcgtcgccgtggccgccgaacagcagcagaggagcaaacttgggatccagtgctgcagatgcatcgcctgcctcctccatgatttcgacggacgactggccgatcaaattcataaatccttataaataactattggcataggaaagaggtatgcacatctacgacctacaattagtactcctaccaatcatctgcaccacccgttgatcaggaaaaggaaacatgaattcctacacgatatcaaaattcaaaccactacccaattctaaagcaaaatctaaatactttgcatatatggagattggatagcaaaccaacaaaaaccaaccggggcgccggggcggtatacaatctccaagcggaagccgacctataaggcttattggctcgctggtctctctttttagctttttgagaatgaacaaccttagcaactaacttttatttattttagaaaaatctttgttcaagctacatggctaatggcttatttcagggcatgtttaatgctgacctaactacctgttttagcaagtgaaggattgcccatgtttcgaatttgggttagcggattaagctaaccttgcctagcaaaactctgccagtcggtcagcttgtataagtttaacgcatgacttcaacacagggcatataatgactgcataaagactatcatactttagttactgtactgccagatattgaaaattgccctttgataggtgatcgcgtaatcacaatttcacaattataagtggagttcacaatgaagaagtagatttgcttaagacatattgttcaatcagtctatcaccttgttgatttgattagttgataacttgatatggcttctttgttccatctttgtatttatgagctaaatatttattttgtttgaaaccatcagttatttcttgaaatattctgttgtctgcagtctaatgttagttattatttagttttaataatcttgctacatatcatgcatagatatgctttctgatggctatctttactgaatatgcttca

SEQ ID NO: 25383 - DNA, 1501 bp, Oryza sativa
tgtgtggtgaggtctaggcactatgcaggagaagggaattttttttatgaataatgtgtagtattttagttgaaacaattaggtattgataggtttggaagttttgggattgctatggtatttagagactattttcaaattaattaatgtttatgtatgggttaaatattgtagatggatagattggttcggcttcattatggtggttgtgtggtagatgaaagtaccggtggaagcaaatttgagggaatgattgttagacagttagtgtttcatgcgaagccaacatttgaggagttaatgtctcgcattaagcatgaattggattggagtgatgagtcggttggtatgcaagggagatacgatgtgggcggcggtgtcatgtcgcataagtttatgttagacttgaatggaaagatcgaatggcaaacatatatagatatagtattggggtcacatttcaaagctcttgaggtgtttgcatggaagaaagaaggtaggaaagggaagaaagaacttgtagacttgaacgaaagtccactcatagaatcacccattagttctcacgaactgtcggagaggtgtagtaggaaggaagaattaattgaggaagacgtggaggtgggcgagggagtaaatgatatggcggatgtggaggtcagggaggaagtacatggggaggagaatgtcccggtaagggaggaagtacatgcagaggagaatgtgccgttaagggaggaagttaatgtggaggagaatgtgccggtaagagaggaaggagatattgaggatggtcgggaggtaggagatgatgtggagttgactgaggaagaagcgaatgctaagaatgtaagtatgggcctaagggagttggttaggctggaattctatacccgagaggagtgtgaggaggctatgatacgcagtggattgaactcaggctggttggagtatgatacagatgatgaattggatgagtccgcttccgactccgatgatgatcgtccagtgcgtaagatgtcggagcatgaaaggactgtgtttgagaaattggtgggtagaaactcggaaataacacaattctaggatcttaccagatctgggctagcaattgctgatggggatccacaatatgacggtgccttcgaaccaatgtgtgatgaaccaaggaaggggttggagtttcgatcgatggatgatctgaaaatatggctgcagagttattctatccgtgtccaccggccgtaccatgtgaaggaatctaatgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctccagcagcgattgtcgaggcag

SEQ ID NO: 25384 - DNA, 435 bp, Oryza sativa
atcactctaatatgctatgaagttgtgataatttttaggaactcctattcaccccccctctaggcgacatcaaggtcctttcaattgccacataggatcaaaacaggattgtattggcacagggggtttatttgtctagcttgagaagttgaggggagaaatgtctggtttgttgttcaagtgggtaattcggaccatcgcaatagtttagggggtaattaatttggactattttatagcataaagaggataatatatatataaaggtttagtttatccatagttttttttttagtaaacttcactttgggccccctttattacccaaagtttcaccatggacttttgacaagcctaattttccacataacaacacatacaattaccaatggttgctttggactaggtcacatggacttcatccctgcttaaagc

SEQ ID NO: 25385 - DNA, 240 bp, Oryza sativa
gctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagag

SEQ ID NO: 25386 - DNA, 930 bp, Oryza sativa
tcatatatgctaagtccaactgtcgtatatatattagaaccctagacaataattatatactaagtctaattacaaatctaataatcttatattaaaactcaaataatcttgtattagaactctaataatcttatattaaaactcaaatagtcaaatatgctaagtctaactgtcatatattagaaccctagacaatcttatatgctaagtcttattacaaatctaataatcttatattaaaactctaataagcttgtattaaaactctaataatcttatattaaaactgtaataatcttgtattaaaactctaataatcttatattaaaactcaaataatattgtactaaaactctaatagtcaaatatgctaagtctaagtgtcgtatattaggaccctagacaataattatatactaagtctaattacaaatctaataatcttatattaaaactaaaataatcatgtattagagctctaataatcttatattaaaactcaaatagtcatatatgctaagtctaactgtcatatattagaaccctacacaatcttatatgctaagtctaattacaaatctaataatattatattaaaactctaataatcttatattaaaactcaaataatcttgtattacaactctggtagtcaactatgctaagtctaagtgtcgtatattagatccctaggtaatcatatatgctaagtctaagtgtcgtatattaaatctaatagtcttaattgcattaaaaatctaacaatcatatatttacatcacttgcctgcgtgaattccttcgagggctagctaccactccagcttgagggacgacgacgacaacgtcttttctgcaacatacaaaaagatgtattaggataaacgcaaagtaacatatattgtatttcatgttcgcgttctcgttaagt

SEQ ID NO: 25387 - DNA, 164 bp, Oryza sativa
tcaatcactcaacccaactctttccccttctcaaatccctctcacaaagaggcaccacaaaggatggagtgaagctcactagctctcaactcctcactctcttaacccaactcttttcccttctcaaatccccctcacaaagaggcaccacaaaggatgggaaa

SEQ ID NO: 25388 - DNA, 451 bp, Oryza sativa
ctctctctctctctctctctctctacttgcatgtggaagatagaggacgtcagttgggccccactgtcatataggatgaaaggtggattttattgctgaaagttcaagtgccattaatttggttttggtgattaatgacaaatccaattacatgagactaacattgttataagcatttctttgtctactagtctcatatggatatgaaagtggaatatgtgagaggtgatttccggactttatatgagtaaagagagaaacgttcattgatggtgttcctaaatcacaaggatgaaatgcatagagatcaaactatatatgtatcactctttctctccatgtacatattgatgtgttcatatataatatttttcatgtgaataacaatatacatgtgagactaatgttttgtttgagccatatcttgtttagtctctttacattgataaca

SEQ ID NO: 25389 - DNA, 1217 bp, Oryza sativa
atgtaggactacgttggtgggtgaaaaaggaggatggaagaggaccatatatatgcatgtgtaacaagcacaacgaatagatggatggatgcaaaatgcatatatatgtatggctctgacctaaaaaggagctcccactagatctctcttgtgctggtccagcatgcatatatgcaagcttagctagcccacctgggcaccaatgcgaccagccaaccattgcatgtattgcttttgctacctagtgggagatggaatcccccaggccccctgcacttgagcattacgaaagaggaatggctttcccaagagcaaacaacatccaaaaaagaaaaaaaaatcaattgtgcatcatatcaaagaggaaccatttcttgtacgatcttttttttttaatttggcagaaattctgagacttacatatgagtttgtatgctctgccagcaggtggctaggaagatttttttttcatagtttttaggaacataaattggggtcatcaattagttctgtccctccatgtctccaagaatgattttgaacattttgaaaacaaaaaacttctgcaatggtatacggtagaaacaggtgataaaacttaattagtggtacgtaattaaggaatagataaaataatatacccttcgtcttagaaaaaaccatcttctagctatgagtttagatataagctgaagttggttttttttctaacacagatgatgtacaatgtaaaatggtcgaacaagaagaaatcacatggttacaaattaaatacctttctagaaaaaaaaatccagggccaagtaatttaataaaaggcaagcatgtaattttatatctgtacaactaattaggacagtaatgagtacataaagtaatcaaattaagttgcatcaccatcggttagtacgtagctagattcatttgcagaccgaaatttgaagccaacttgctagctgctgctgttgctgtgtgtacctacatggctacataacctgttgctatcaaaaggtgaacttttgcatatgttggacatgccgtggttgggcccaaccaaagcccccaatatatattcgaaccaggagcagctttttgttagtgattctatgtcagcatcatccttttagactcccttttgacacgaactaatcctcgatatgatcttgttaattagtgtgagagaggataagcaattccacattttccactccaccagg

SEQ ID NO: 25390 - DNA, 1501 bp, Oryza sativa
ctttattattatattatttcttcttttatattattttaaagtatatgcgatgattgactcataatattttttttcgtgcccctcacctccttctcttttttttttctttataattgtataaaacatgaaaaaaaaaggaaattactatagaacgtgtatcgaatttttttagccattggattagctccaaatttgtgcacgcgagatgagagaaaatttttggccattaaattcactccgaaatttatgcacgcaagatgaaagaaaatagtagagaatcgctacagagataaccttttatacaaagaattttaaattgtgagaagcagcttgtacttctgatttattttccgactacaactatctataattatagtctatagattcttgtaatctatataacaatctcaactatttcaaagagcttcggacagctaaatatcctacgtgaggcaataactatacgcgtgagaaactctctaaatatggcctacttatagaacgatgggtcggtagctaggattaagccaccggctttcatggaccacaagctgcttagcgagctgtgccaaattaccaaccatagtccagcaactaggaattgagccctcttgaaaagaataactagggctgtgtttgagaagaggagattggaaagatacgcaaaacgaggtgagccattagcacatgattaattgactattaagtattttaaacttaaaaaatggattaatatgattttttaaagcatcttttctatagaattttttttacaaaaaacgcaccgtttagtatttcgggaagcgtgcgcgcggaaaacgaagcaaaactcactaacaatcacttagatcacctaggaaagaacacagcctaaagcatccattctttttctcaactccaaactcgtacttttaaaactattaaatggtgtgtgttttgtaaaaataaagtttctatataaaagtataattattaatacttaattaatcgtgtgctaacgaggtttctcgttttacatgcgttaaaatctgtcttcaaaagtgaagatggaacgcaacctaaaaattgaactgattgaatcccctccattacaatagttcagttttatatacaagtcccttgcatttctatattactaaacagactaaaattcggaaatatacaatttcttaggaattacacaatttttaagggattgtctatgagacgaatggctgaaaaaatttgtgttctcggcccgtttgtctgactctctatgatccaaacacgcatctcccatccacctgcgcaaggaataagttcaccggaggtccctcaacttaacagcgagattttttgaggtcccttaacaacaaaatcagaaatgtctacccctaaattcacttaaaccgttcaccggaggtcactcggcagtatttttgtccggttttgctgacgtggcatcctagtcagcaaaaaaaatttaaaaaaaaaacttggggctcacatgtcagctgcatat

SEQ ID NO: 25391 - DNA, 339 bp, Oryza sativa
cactagttggataacgcaagtactcgtctccaaaattctcaacaatagtggtactatcagcaatttgcagatattcatcttgagtgtcggctgcgactccattggttatcattctaagtgtggtggcaatctttaccaatggtaatatacccatagtacttgcagcatttctttttagcacaaaataatcatcatgggctaccacatcattaactatgcgcaagaaaagatgacaactcaatctaaacctgtgcaacaaaatgcgaattaataaagttgcctacaaaacagaatcaaccaaaatatgtaaattaattgcaaaccttcgccggaataaga

SEQ ID NO: 25392 - DNA, 419 bp, Oryza sativa
ctaatgatgtatgcaacatgtatgtgctcacaattaatcataccattcttccatacaacataaatgtcacatacctacaacttaaaagttcacaactcatacagttcttacaagcatcagtacataattgacacatgcctacacggcacacaacataaaagttcacaactcattaggaaatagcaatacgtatcacatatccatacatcatgaactcaatccatatgagcctttatgatctcctcttgcaaacgcaagtaataagcttttcttggcccatccatagcacgaagatccatgttcataattctctcttctctttcatgggtttctaaatctaactttcatttttctattttcaacctctctttctctagtgaaataacttcacccaaccggtcatttctttcctccctaga

SEQ ID NO: 25393 - DNA, 1012 bp, Oryza sativa
tgtattatgtctgtaagaattttattctacactagcatcttaacctttactcaaggacgagtaaagagctaagtgtggggggtttgttggcagctgttaaatgccaattctatgctgcaaacacctacataatacatagttaataatacatccaacatagtggtaggacttaattctaacaaattccatgagtgttggtgtatatttggatgcaggtaataaactgccgaagttgggatgaaaatcagacttaagtgaaggaagaattctatccataccagagtgggccttaaacttcatctaaacgtcagaaaatgggcccaactagggtttggccgaaccccaatcttagtcattcaggctgaggtttggcatgggcgttccagacgctctactgatggcggttgcggggcatttcagacattttgcgttttccgaccatcatgacctacctatttaaggaccctctctccctcacttcacacacacactccaagcttgagctgaattataagaggctctattgtactttattgtatactagaattagggagaaagtagagtagaagaagtcggaggaatttcggagttgtcggtagtcctctcttatttcttatactttgttaattactatgctttaatagaattatcattctgagtaattaagatttactcggtgataattaattcctggttagttcctaattaacgtgcaggataattgatcactatagtccagcaaaatatagtggttgctttagtgtttagctagcgctaaagtagatattaattgcgtagacgtggttgtcgacgtttgagatcatgactacggtattttgcatagtatggggatcgttggtaccagggtatatgcgagattgaggtaaaagagatggagatagggatttttatacatgtttgggccccttatctaacaggtaatagccctacatcctgttggctgaagccggtgttgctctttattcatctggatcacacaagtacaatattt

SEQ ID NO: 25394 - DNA, 1501 bp, Oryza sativa
gcatatagaagtgctaatactaattttatagtgtcatgtttcatcctgatgactggtattgccatgccaccattcattaaggtaattttggcagcagtacgttgtaaccccagtagttgttgtcccttgatgatccgactgtcagtctgtcacacgaggatcccttgcaatggggtcatccattcatcttatgaccattgtttttaaactaaaaaacaatgtcggataccaatgaggaacttggtatcaattggatagagaagagataaaggtgaacacgcgtgccgaagggtgctgaatgcgggcaggcatacgtgcgtgaccgcgccatgtgcagtttccatcttataacctttcaaaggaacatgattcaataacaatatggcagacacagaattcctcctgatgcaagatcatacaagcaaacagatgagttggaaggtaagatcctacgcactaaccacatagacacaagagacgaactagctaatcgaatccagtgcaacacggacgagttggaaccaacaagtaagaccggacgagatgcaatcaaacgcgaggaaggagcatcgacaaatcaacaactagaaccttacagccacagcgagtccctagcaacagcatcgaaaccctagcgagtgtttcacggaagtaaaaaaattacgcggcagaattagggcccgcagccagcgattgagatctcacggcgagtggatttgggaaaggtaggagaaggagagagcttacgatcccgtccgccgcggacgccgcctctcgtcgggtggtacatctccgcccggtcgcgccgccggtggggtggggaattcggcggaggaagacgacgacgatttgcgtagtggaggtttttttccttttttttttttttttgagattgagatgcgcgaccgccatatgtggaatgggccctttatgtttcggcccacgacgaaaggaagcccaccggcgtcaatctccaccgtccgatccgatcggacggtcgaaacggcacagagcatgcagccacaaaaaccctaggtcgggagcacgcatcctcactcgccgccttctctcctctcgcgccgtttcgctccctgaccctccgccgccgccgccgccgatcatcatgaggtgattcccgccgcccaatctctacttcccttcttacggttaacgaatctcttctattgcttagtttctgtcgctatggccttctgtgattctgcgcgcttgctttgttagatcaaagctcttattaagatgtaagaagatgatatggaattcggacgatttgtttagtttatgtctcattaaagcgatggatctcgagatagactgggatcacgtagctgtacaccttgcatgatctagagttttctgcttctcgctagagatcagtggcgctagctagattatgtctgaatataggttactgatcggtataagaaatgctcgttctttgtttcctgaacaaaattcacgtgctgagcttgcgtgatcaatt

SEQ ID NO: 25395 - DNA, 604 bp, Oryza sativa
ttatctgcaaatgagtatgtgactaagaaactgtaagcagggtcaatatttaacgactgggactgatcaatcttttaaaagtatggtaatctcagtaatgtctcaggcaattgagccaacaagatataaagagatcatactagcgtacaatagtgcgctcgaagagtttcctcctctactcgtattagtacaatatcccaaacttatagtagatagtataagctgaatctaatacattttgtatcgctatcttaaatgacagatatatgaataatagccatgtgcgtgattaacggttcttcgatcatacatataacccaagtcaaagacacggaagcatagcacatcacgaggaggaggaaaacttgtagcaagagatcatttcattcggtcacgctaacttgtagtaccatcatgcgctgcacatgctacatacaacaaaagcgatcgcgtgtgttgttcgcgtcgcctccctctcacgacaagcaaacccaaccgaaaccaaacacgagccggacgagacggagcgctccctccctctctgtcgcccgcgacgccgcgaagccgtgggcgccaccgtcgccgccgacgtcgtcggcggaga

SEQ ID NO: 25396 - DNA, 1501 bp, Oryza sativa
acttggaagtcctagatgggagaaacggactgtatgtggtatacattgagcgagtgattggaagattggcaagggaggtagctcctgctgctcatcaggggaagctggacctagaagtcctctccaaactcctttactgagaacatgctgcctctgactcgccaatgtattcacccacatgtcatttggatggcaattctcatgaattattagaggcttgtactctacaaacttggaaactacatatcacattttgtatatcaatttcagattttcaggatgactagctaagggaagatgatgtagcaagaaggtgttttgttctcctttgaatggctgggaaaccaactaccgaagcatgctcaaaagtatgtttcattaaccccatgtgttaatgagtagttatcacaaaccagtctgctataatttgaaattgtatttcttcaccaagacccttacatgcctacattatggtctataacacagaccttagaatctattaggggatccaatattgtgataggcattgtttggtatgtttagctaattgttttactctttactccaatttacttatgtcatatttatatatgcatgttttatgtctgctctaaaaaaggaagggagtttttcttaaatacttaagaggcaataatgcatcagccccttttgtcatgtgtgtgtgccgtgcaaagggcagttttgtctattatgctttcatgtactgtcgttttcttcatttctagatggtgatgtttaaattacggtgtgaactctcaataacaagaaaataactaagcgtgttctggggtggtgactttactcaacaagtcagttgctttacaaatttgatctcgtaagtgcccccttgggctatatgatgacgttctggaattaggattgcaaataaactgcctaaaactttgtgtagctgagataatatagtacacagcctctctgtatgtattctatacgtgatattctcaaatgtttacacaatgtaagtttatgaaacaatttttaattgagaaacgttaagaaatcaagtattctctgctatttcagagacatatgttaggtccttattctgaagggttatctagattagaaattgttaacagggtgttggctttaattatatctcagcaacatggtgcagacaacatgcaccatggaagattagggatgagtttaaagtcttaatagccaaagaatattagtgttctttcactctcgttttggcaaagaatgagcttgcactcttcaccctaagaaaagagatagcccttcctagctctagttaccaaatcagtgtttgagtagttacatcaccttttagtcagcagctagcttagctccgttctcaactggtataacaacaactctcatgagccatgaggggagatagtagttaaccaatcccaggatcttccgagtttttatcttggttaagctcaactgatctcttcatcccattgacaagacctgtatgcttgatcaa

SEQ ID NO: 25397 - DNA, 1501 bp, Oryza sativa
gcgctttttggattgcatgtgtcagaaacatcctaaagggttgattacagatagtgataattccatgagaagagcaattgcaactgtcatgcccaactcggaacataggttgtgcacttggcatattgaacaaaatatggcaaggcatctccgtccgaaaatgatttcagactttagagttctagttcatgcaacttattctgctgaggagtttgaggaaaaatgggtggagttcaagctgaaacgcaaagtggcagaagataaccaatggctcgggaggatgtacaacttaagaagaaatgggcggctgcatatactaaaggtatgtatttccttggtatgaaaagcaatcaacgtagtgaaagcctcaactctaaacttcatagacacttggatcgtaaaatgagcttagttcttttggttgagcactatgagcactgcttgtcgcgtatgagacatagggaggcagagcttgattcgaaagcttcacagtcagttccattcacagccaacgatgctagtctaattgaaaaggatgctgcccgtatattcacaccatcagtttttaagaagttgaaaatggatattattaaatcgaaagattgtgaggtgatagactgtatagatgaggaaaatattattaagtacatcatttgcatgaaaggaaaaattgacaagataacaatcttgacttgttcatatgttgaatcatcattgaagaatatgagctgtacatgcaagaaaatggagtgtgaaagccttccatgtcagcatatgttcacaattatggactatttgaaccttcaagccattccagatgtgtgtgtagtgcctaggtggacagttaaagccaaaattgcatttccttcagataggtatggtgaggtttatacctggtctgatcagatggaaagatatcgtagaatgcgtgcaattggatctgaggttttattgaagtgctcgatgtcagaggaatatactttgaaggtgatggagatgtttgaaaaactggacttagagacaaatgcaattgagggggatgaatttgatgtaacattgtgcggtcacgttgtagctcaaagtttacgctctgacattgctagtgtacagaaggttcatgatcctatggaggtagtacctaaaggtgcaccaactaaaaggttgagaggttttttggagaagggtaaccggcgttgtggttattgccgtgttcgtggacacacggttcgttcttgtgccatttacctaaggtaaggttctaatatattttgggtaatgcttttttttgtgttgtttttttgtaattggtgacaactgacaaggactagttttgttgttatttcagaaaagttgcagtagatgtatgaagtgcaaagtggaagcaatcaagctccatgtcttatccagtgggctattttgtgctatttgaattctgtaaatcatgagtcgtggcaggactcgtttgttgtgtttgaaaactgtattggagctgtgcttggtc

SEQ ID NO: 25398 - DNA, 447 bp, Oryza sativa
ctgctatagttaatccattattcaaagtgtgctatacatgctcaatctgggaacgtgtgtgcttttcagtggtgaaaatcatatgtgcgggaggagatggcatatatacattttgagatatcatgatcgagtaccaaagtttaacaagggccaagggccaagagatagcatgcgaaatataatttcattcatagttgtggtccaaatacttcatttagcacaaaaggcaacttgcaacaagcagcactcatacatgcaattcacgaatagcacgtgtgctcacatatagcagacactacacaactgacggacagcagacatgctcacatatagcagacagtagactatagtaaggttgcagttgataatctccttcagagcaaatcaagacagtagactagaaggttcagtagacacttgtacgtcggacctgatatatgtcataga

SEQ ID NO: 25399 - DNA, 1501 bp, Oryza sativa
ttagttactgagtgaatataacacccactccctctgtcccacgaaaaaccgatctagaattagatttgatacaatctaatacaacgaatctggatgtacaagagcttaggagctagattatgccaaattcaattctagatttgtgtgtgtgtgtgtgtgtgtgtgaaggagtagtagctagctagtatgatggcaaagagcttccatcgattgattgccaatatgtagtccatttgttagcttaattcagacaattttgtctctacaatgggttagctacatattgccgcttttatcacaatcagagtaatgacgtactcttccattattgttccgtacaagcaacatacaaggtgttatggactggtgaaagacattatattagacatcggtcaaagtgcggcaacagcaaaaataaaacattacttgtatagaataatggcgcgcatagattaagaggaggttttttgctatggcaaaagtgaggatgtagtgtgctctaatcggtagcaaaaggaaaaaaaatctccttaattattacccattatccatgtgataccatgtaatgcatgcttagtcttggagagcatgcctttaattgcagagtcaagatggacatagttatttacacgtaacaatttttataagaacttcaaaatttgcttacgatatcttaccaacttgtcttggactagctagggaaacgttgggtatcatcttggataatatcctggttttgtgtctagctagctagctagtagtaccagttgggagatatctgttgattaaagtccccatggattagctgtgtacattttgttggtgtagaggttaagtctcttaatctattattaaaaaaaaatatcattggcagaaagattggtaatactgttactgttttcgagtgtcgaattaagtgatctcagttcccaactcacctccttcgtcttcacacgcacgcttttcaaactgttaaatagtattttttttacaaaaaattgttaaacggtatatttttgcaaaaaaaattctacgaaggttgcttaaaaaaatcatattaatccattttttaaaaaaaattagtacatacctaattaatcataagaaaatacatcactctgttttgcgtgcgtgggaggtgagttcccgcagccgtgtacatataatatgtagctcaaatgtaacatcgattattattcaaaaatgaataatcatggaatatatttccattattgacattaatgattaattgctagtgcccaaccaaaacaacagcgccgtgtggccgtaagcactagagggccgacatgacaataatccccatacaagctaagcttagctagtcgatcgcctagctagtcctccaggcttaattggactttcctccttttatatacggccgcctcgatcgagctcgcaccacactatctttcttacccaccccgacaattacattttgcacatccataccaagctagaaactaattgatggagaaggaga

SEQ ID NO: 25400 - DNA, 183 bp, Oryza sativa
ggcttaatgcatcgattagtataataataaacaaaaaagatacgtatagaggcggatgaggtcctagtatgggaagaagatttacatacttccaagagttccctcgggatgtgatccaaattacattggttaaaacaaaagaaagaaacggcaagacaacaatcttcctctttggtctccagc

SEQ ID NO: 25401 - DNA, 344 bp, Oryza sativa
tcgtccggagttcagcttatcgaagaaaggattatatatgtgaaagcaagaagtctgtacatgcatattagttcttcgttgtcagtgcatgtatgccatcttgtatgtagagagatgaacctgagatatggaagggtaattaaatacagattatccgccatgagcgaatagagataatgtaacatcagtcctgtaatatgtgtacagtaaaaaatcatcgaatttgcaaggtgtttttactccattcctgccttgtctgcaaatatcttgtctctgtcgcaactgaagtctgcaaaaagattgttccttcagaaatttgaatgatgaactctggtgtacttttt

SEQ ID NO: 25402 - DNA, 516 bp, Oryza sativa
caccacagaccacacttttttgctaatattaaagcacaaactaacaaagtcagcagtactactccatccgtcccaaaaaaagacaaaccctaattttcgtgcccaatatttgacgtccgtcttatttaaaaaaattatgaaaaaaattaaaaagacaagtcacgcacaaagtgttaatcatgttttatcatctaacaacaataaaaatacgaattataaaaaaatttcatataagacggacagtcaaagttggacacgcaaacccagggtttgtctttttttttttttgaaggagggagtacttgtcaaacttggcccatctgggggtaagagccgcgcctatttagcatgccacagttccgatcgtgcggtaggaactagtagccctcgtccccacagtatcgtcgacatgagttcttgaggatataggtcccatatgttagtgggcccatgtttctttttgtgtgaatgactaatgggtcccatgcatattttttaattctaccgccacgtagg

SEQ ID NO: 25403 - DNA, 165 bp, Oryza sativa
aaactgccgacagaagatataaaaagggtcactgtgtatgcacagcacaacaccaccatcggcatcgatgcaaagcttcgagtatacttatatcacgggcaggggcaggcaggttcctctctatccaccgtcggatccatgctaagcctcatccaccggcccagg

SEQ ID NO: 25404 - DNA, 1501 bp, Oryza sativa
tttatcgtgtatgccttaatttgtcgcagcattgttgttatcatcgattgattcgattcatccttccattaattgacgagataattgcgttccggccgtcggtgcaagcggaagatggaatgaactgccgcctttcaagtgagttcctactagatttggttagaaatagagaacggaattcatgtagtaacattttaaatacttgtatagatcactcttatcagtgataaaaactgtggagaaggttaaacatgcagttatatgacatgaaagagagtctagctgcatgcgccttgcagaatggttttcatcgaaatccacagtttgtaatttgccctgcaaatcaaagtttggcacaggccagagcctagaaatgaagcgaacgactcatatctggccgtggccgagtttagttccaaactttttcttcaaactttcaactattccatcacatcaaaactttactacacacacaaactttcaactttttcgtcgcatcgttccaattttaacatgaaaacacactggctgttatcatacaggagtatcaatggtgaacagtggagtggaatccttgtcaacccaagctgcagagttggctccaaaatttattggcagatcgagctagtccaataaatactagtattactagtttgatgactagcaatagttcagtacagctcagctggagactatatttgcatatagtgatattactaatatttttgatgtggagtaggggtacaaaagccgtaatgaaatgaaatgaaagtcggtcccagctggaagaacacatgacatgaatacagtacaattgcacattcgttgtgcattcatatatgcgtatgaaatacgctgcacgcatagcttttcattttagtaattagtttcgctcctacgtactagtacatacgtacgtcatcccagtccatgtgtagtgctgactcgatcacttgactgcatggaccatacataatactacatgcatatgcaaccgcgggcgcgcatgcagttggttggttaaagatgtgcagagagaaaatccggctgcacagtgcagtctactccagctgatcgagagcgcgtgggcataaatgccaccggttcacaaacaccaccaacccaatcccgccgcgccgcgcgcatctcgccggccatccatggcctcgctcgctagccgcacgtcaaatcgatggtgtaatgtaaccttcctttctccgatcctattcctaccgcgttatccagctcctctcctcatgcagcagctgtcacgcactactagtactcactgtgtcggccggcctcctcatccaagctaagccgccaccgccaccgccatagcccacagctcgatctcctctcctctctggagtgtagataggcaggcataggctccccaactaactgcatttactctactcgacctacactgcacatgcattgcgcactagccttccttcttcttcgtacgcttcatatgataggagcagccttccccttc

SEQ ID NO: 25405 - DNA, 1501 bp, Oryza sativa
agttcaatacctatttttggtcttctccaacaataagacctaaaagagaacccttactgcaaataggtcttcagaagagaggatactcaaatttaggttatgtgtcttatagcacgtaaaataggtcttctgtataggtactctgttggaggctgaaatagtactatcagagacccattttgggtttgggtgcccttataggtcacttgttggagacagtctaagctgggatggttctgttgtatgacgatcagataattaataatcgctgatttcccatttttctcttcttttgctgtatcatgtgaaaccaaaaaccacatctctgcttatcttgttatggtcttatgaatgttttttcagttcattttgtttgaaagcactgccgcgcgtgactgtgctgattggtataatacatgcaaaactatacatgaacacgaggagttaatttccacagtctcaaattactattattttagtttttgtctcaagtcaaacattataaattcatatttatatgatttacgttttaatagatctaccatgagaaatatattgttcaacaacacggatttttagaaatcaatagttaaagataaaaatttttgaattaaaacaaagttacaatagcatgtactttaaaggattaattgtattcataccatcataatttttcctgttttaatttggaaaatcctattacaattcactaactcaaatgatgccattataaatctgttgataccggagatgatgcactgacattattttttttaccaaattgccccttatcttgtaccttcgtcctctccactcattttcctcttgcatctcttgatctggtttctaagcattggcaggctgcaaacctacctcagcaaatcgccgccattgtttaccggttcgtcttcccttccaacctctgttcctccctcgcgtataccattgtgtggcgtcttagaccacgtatagtagcctcagccagcgaccccaactgcctaagatggtgacaatcagcagcgaccaacagccgagctgtggcctttggctcgttttcagaggaaagccatttgtggtggatgcagctccacttgttgtctctactacacaaacatctacttctcaccatacccacgtgtatgtggatttggtggttggggccacttcagtgtgccttcttcgtcgtggcggtagaagggccgtgcgccaggcctgtccctctctcctatggctacagccgtcaagcccgtccgtgtcccgtccctctccaccgccatgggggtatccaagtgccgtggcaaagtcgacctcggggcatcgcctcctccttagtcctctcgtcggtccgcagtgctaatggatggttgtgttggaggggctccatgatttggatgtccaccgccactagaatagtagagagggggatggaggaagagattgccaagatggttatttttttttgttagaaaatatgtcgaagggttaaatagcggcacaaatt

SEQ ID NO: 25406 - DNA, 1501 bp, Oryza sativa
atatatatatatatatatatatatatatatatatatatatatatatatatatattcaatatgatgaatagtaacagcatcacgtataaaaaaacagtcttatcgtccagagaagtgattatatcctcatgatcacacagaatatctgggatcagggtggcacgtgtggagagagccccacacgtatgattagcgcagaaagtcactttggtcacctatcaaggagagccgaaagagaggagacggcaccattgttgacaaaagttagaagattcttccttcctttatttagtctagctatatctatatctatccctcgcatgcttgtgtaatcttcgatgctaatttgattaatcaacttgcaactatctcataataaagaaatgccaaaagctccaaggcaaaattttaactactctgtataattgtggtatcaagctcagttagacctgatcgtacgtattaatattccaaggctccaaaatctagaacatcatcgcacggtaatgctgcttaaagccaggtaatgaaagagtgtgtttgagaatcaaaattgcattttctgctttggctgaggtaatcatatatcatatcatatctagtcgcaaccggaataccagagcttttactagatttcagcagagaaaagaaaaagagcaccagaaaagatggagacaggagcttctttgtatcgcttgggatgtacggcttaaaataagtcaaatggtatatttgcaaacgaaaaaaaaattgtaaatgaactttttatgtaagtgttcttaacgatctaaaagcgaatgctgaaaaataaactacgatgaaaaaacctcaaaattaactctagatttaagttgaaaatttaaattttgatttataagtataaacagaagtgaaaaagatgaggcaagaattgtgtgctgttgccaacaaaagaagattctagataacgcagaacaaagaacttttgacctagaacattcttgggtccttttttatgtaccttaccattgttcatctaaaagcttgaaatattgtgtcaaccatgatatttgaactcaaaacatcatgattataatatcatattgagctgtatgtactagttaattcacctaaaaactaaattaagctggtagaaaaagaagaacagatagcttataccacaacgcttttgactgttcctcgcagtacacactcacttatatctttcaattcactcaccttattcatcgcggtacacactcacttatatctttcaattcactcaccttattcatcgtggtacacatttacttatatctttcagttcactcaccatattcatatatactttcgcagatccttatcgtgtgtctggatgtagctaggtaataaaaaggtggaattgttatagggatatggaagagatggataattgggactatttcattctcaatcccaatcccaaccctatccacatatttataaagtaacaagacatcttttatactattatatggagtttg

SEQ ID NO: 25407 - DNA, 866 bp, Oryza sativa
ccccccccccccgaaattttttatttttgttttatttgtttgatatttttttcacgcttagagatacacaagaaccaaccatagaaaaattaaactcaaatagacgtaatatgtgacatgtagaatttttcctctcctctcctctctccgaactagtgcagaggagagagatgtgcaacttttttatttttattttatttttttgatatttttttcacacttaggaactcacagaaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagctagggagaatcggatgtaactttttctgtagatgtccgtgcatatattatttgcctgattccgagtccgtatgagaaagttacgcctattttaatagatggcatattttgtccgtttcggtagagttttggaaaattctacatgtcacatattttgtccgtttgagtttattttttacacggttggttcctatgttctcctaagtatgaaaaaaatatcaaaaaaatgaaataaaaataaaaaaaattgcatctctatgtactatttaacttacatatgtcatttcatgtggttatatttttaattagattaagtaatttcatatagtggtagagtgtattatgtttaacatgctgatcaaaaagttttactaaaggagttatggtctaattttagtgaaggtgcaaagtaaactaagtggtatgctagatattttcggacttagctaagtggtagttcgagtttaaattttttttgccatgctg

SEQ ID NO: 25408 - DNA, 299 bp, Oryza sativa
ccccccccccccgaaattttttatttttgttttatttgtttgatatttttttcacgcttagagatacacaagaaccaaccatagaaaaattaaactcaaatagacgtaatatgtgacatgtagaatttttcctctcctctcctctctccgaactagtgcagaggagagagatgtgcaacttttttatttttattttatttttttgatatttttttcacacttaggaactcacagaaaccaaccacgtaaaaaataaactcaaacggacgaaatatgtggcatgtggaattttccaaagc

SEQ ID NO: 25409 - DNA, 386 bp, Oryza sativa
ctccccctagccacctcagcatcgccccgccacgtcggcggtgggacggcgccaaagaggctggcgccatcctgttgaacgacggcgccagccactctggcgcccccaaaaggaccatttttgggataagtttttctagggatctacttgcaaaataagttttttaaaaggacaaaaatgtgaaaaatccaggactctcaagagtccaagagaaggccggcacgccgggctccgacccggccaaaaattcccaaatccaacctgtacgcgcctctctctattctgatccacaccaccccaccacgccgccaccacctacccaccaaataattccaactccaactacttctccttccttctcctcctcctgggcctccgctgccagc

SEQ ID NO: 25410 - DNA, 1501 bp, Oryza sativa
gtacgacaaaattattttattcttaacaatctcacaaaaaaaaaatattgccataaaggtggtacactgtaactgtgaaaacaaaaatttaaaaaaatgaaacataaccattgtcataaaggaggtaaaacaaaaattaaaaaaatgaaacataaccattgtcaaaaaggaggtacactggaactcccaacaaaaacaaacaaaaattcacgacgcctgagagattcgaactctcgcggggaaaccccatgtacttagcaggcacacgccttaaccactcggccaaagcgtcgtctgtgctaaaggtacaaagcgcttttatatgtcataaagcaattgcttttcacaaagcgagactctgaagacatgaagatatctgaatctgatcggatatccatctctcctgctatctgcactagaagaaatgagacgctagcaaaggacttgggatttgagaagcaagcatgacactgacgttataagccactgagcacttgcttggcttgcaagagctaacttgccttggaatactgcgtccagattaacctcctggccgccacgtgaactcacgctgtcctgccgttgggtttttgttcattctaaagctccagcagtccagcctccagcgcacaagaaaaaagctcaaaaaatggatcacctcatttcctttgccaattccagcttccttctgagaaaggtctaacgattagacgcaagagaacacttgcccgcacggaaaacggagcagcgattagcaggtgattaattaagtatttgcttttttttaaaaaaatagattaatttaatttttttaagcaactttcatatagaaattttttgcagaaacacgtacgcgtggaaaacgagagagatgagttgagaagatggtctggctctgctctatcaatgcatggcgaatagcatatcacctgacgttaacttcctgaaccaagcaaagtagtacaatagtacatgtcttcacacaatcaaacacattgacacatgtagtccctctgtggactagctttagtttagagcactcgcaataataaagtaagatgctctctataaaacatgtacatctcagcaatagactagattaatagtaaaccacctcaatagtatatctacatcggtatctatagctctctaatgcattgcctcgtttttctctatagactatctccaagttagcagatagctttgctctctctctttatttaatatcttccaagtagaaaaatatgctgacatggatctcttgtagagagcctatagataaccattacgggtgcccttagaaaaaccgaaatcttgaaccgccccactccatgtagtaaggggttgtttggtttacaactaaatttgctacatctaatcttaaggcaagccacactttttgatagacagcgtttggtttctgccacaattttactttacctaactcctagctacttggcatacatgtcatatactctatggtactcttttttttttttgc

SEQ ID NO: 25411 - DNA, 584 bp, Oryza sativa
gctttttatcacttttgtttttatttttccaaacaccaaaacattttttattggtttgccaatgtgttcatcaagggggagattataaaatcaaaggtgttttttattattattctgtgatgaataattgggtattagagattattggttttgttcacgaagtggttttggagatgattggatttacaggtgaatcgcaggttcgttattttatgtgaccgatcagaccgggcagtgtgtgccggtcagaccggcggtgatcgagcggtcggaccggccagcccgcggtctgaccggccgacgctgtgtcggtttcggttttgggttgtttgtttggatatccgtgattatttcatgattatggcttctagatggatgctatacgtgtgtaatactgttgtttgttactaatcagtcaagttggagatagcttggtctcggaatatggtttttttgtttatttcatgtgtaggtgactcgatgcctcgggagagtatttgcggtgatggaccgggagtcggcttggggataagacgacgtccgtggtggtcagagatcatgcgggatacttaggctagagttga

SEQ ID NO: 25412 - DNA, 1501 bp, Oryza sativa
ttctagacagcaatctagctaattcccttttttttatgtatggatttgtctcagaattactctctccattcacatttactcgtcgcttttaacctatagcatgcatatttaggcaataatttgcttggatatatgaatggccatgctatacccttcaaaactaaccagaacatcccaaacccaccaaatatgtgacggataaaacagtaaggagaaaattgatagggtaaactgggtaaaatatatattggggacaagtatttgtgggtggataatggtccaaaagtgaccgagtaaacacgaatggaggaagctacctttataatatgtgttatttcggtgtaactatttaattatttaatattatctatgttcacagatacttgtaattttaattttaggtcatcaagcaatattttgccaatatttttctttttaaaaaatcaaattatgcagcatcgaacttatagcattaggtctaaaatcgattttttttactaagtatatatatatatcctactttcagagctaatggtcgcttaaaataataattatattttatatatgtttaatcaaaaccgataaatatttatgaacagaagaagagtagccaaatttgtctccgagaaaacttgggctgtgtgccggtagtgtgttcattttgagatttataacattttacgtataatggagcaacggattaatacatggttaattatgtattaaaaacttgaaaataattaatatgattttctatagcaatttttatgttgtgtttaaaagaaacacgtcatttagcagattactaagtgtgtacgcgaaaaacgagagattataaattgggaaagtgtaatatataacacaatttaaccttaatactaatatcgctttctaaatactccctccatcaacttttgatagtcatatttcatcttgacacgtagaccaaggataagtaattctacttatcatctatttaaacatgctactaatcattcctcgtaaacaagcgattaattaatatttacatttctcaatatccatgtagccaatcatgtgtggaagaatggagagtcacgcattaaattcgagaaaatcattaagaggataggttgttagattgaaatatgcctatcaaaaataaaattttcagatttggaaatatgactatcaaaaatagacggatagagtattaaattactccgtacgcttgtggaccaggtctcccaaagtccagcctacaccgacttcagccttcttcggcagaggacttggcaaagcaatgtcgcagactcgcttgtacacggcccggtgtagattccaattttttttaacaaacttctaacttttccatcacatcgaacttttctacacacacaaacttttaatttttctgtcacatcgtttcgatttcttcaaactttcaattttgatgtgaaactaataacaacccaaacctctctggctctctcgctgagaattgcgtacatttcacatgaca

SEQ ID NO: 25413 - DNA, 406 bp, Oryza sativa
agcgagaacggcacttgtagaagcatcaccaaagataatcgattcagtcttagatgccttcttgagtgaggagaaccaatttttatcaccggtcatgtgccgcgaacaaccggaatccacgatgcacacgttctccttccttgccaccaaagcctacacacaagcagaagtcgaagcctcagtactgggaaaaacatctttgattttacaaaattttcagaaatactaactaactacgaaatgtgattcatcagcgatttctccctgaaactgtattattagttgagtaattgcaaaacgtgaagggacatgttcctttaattagttatctcaagagtcaagacaattcctcaaaagaaaaaaaaaagagtcaagacacaattaagatcgggtctttatttcaaga

SEQ ID NO: 25414 - DNA, 536 bp, Oryza sativa
agatcaaacgtttctcaaaaaattaacagcggcatacattaaaatacggagggagtatttaataacctactgtctagaacattctttgctaatcacatgcaccgcaactgcaccatccaaagctcagctcatgattcagctagcgcttaattaattataataggagtaattagattgtcttcttagacagatcccatgcaggcactcttatcacaaaaaccgctggtccgatccgttactgtttgtgtggcccggtacagtgttttggtgagtggttccttttcaaagattggatctttttcaggtgtctcaatcttaattatgtcttgaaataaagacccgatcttaattgtgtcttgactcttttttttttcttttgaggaattgtcttgactcttgagataactaattaaaggaacatgtcccttcacgttttgcaattactcaactaataatacagtttcagggagaaatcgctgatgaatcacatttcgtagttagttagtatttctgaaaattttgtaaaatcaaagatg

SEQ ID NO: 25415 - DNA, 1501 bp, Oryza sativa
cttaactctctcgtggggctatcaatgagtccatttctaccacacatccaccgccgagctcgagccccttccatgagcagctccctctcccatgtagcttgaactaggagcaacgctcctcaaaccagcgacccctcctcgatcttcccgaacctccacttctaacgaccaggggagcttgcggaggagagtgcgaaggtggagctcgttgatataatgatactgagggaggtgaaggtggagctcgacaatgtgatgatactagggatggtgatggtgaggtggtcttcatggggcagcgtcaatttagtacacaaaggtgaaggtggaactagagctcaatcaagtagcagggttacctcagccggtaaagcttccaagcacagacttggctcgtccaattcctcatagtatacatacaggtaacttttttggacatatccgatgaaaacgagctaagtgttggaaactcgtgaaaatcatacataaaagttttataaattcatgaaaaaaaatactagagatatgtgtagatatgaaatgcattctcaccaaatctcaagttcaaactcaacttcatttaggagtaacaaaaaagacaaattttaggtaaatagtaacatgacactattcatcataaatttgttttttttcctcttaaattaagttgaatttgaagttgagatttggtgagaatgtatttcatatctacacctatctactatttttttcatgaatttatgaaacttttaggtatgattttcacgagtttctcatacttagctcattttcaccggatatgtcctcaacttctttaccttacattttgagatatctgcaatgaataacaagaaaaataacatcaccatacttccaaaactgattttttttctcaaaccaaccattatctattctatgatccaaaatataaggctctatttgatttatatttttgagcggattattgatttaattataggaataaattattttttaagaaataaacttagcaaatactccctccattccaaaatataagacgcacaaacacaaaaaaaattattaacttcttgtttcgatcaccctaataaatagaatccatataaatcttgagggtgacgtatttttttaaaaaaaaggaaaggagatatgctagttaattgaatacgtgcttgcacgtcttgtattacaaaacatataaaaaattatttgctccctatattttaaaatggggaagtagtttcaaaacaaatgttttagcaatgcgttagaatattattttagaaaacatattttaaaatatgtaaaggaaataaatctattttaatataagttgttttagccttgttccaatgccaagagggtcttcaaaattgtaccaaccgtaactcaggtatgtttaaaggagtttctgatagctgcagcttttattataatctctagctatgacaaactccttcaaaatagttcagattttcattcggattatacgaatatatag

SEQ ID NO: 25416 - DNA, 1501 bp, Oryza sativa
tttggaatacatttaatatgcattaatttgttgctacttatgtattgatatggaaccaagtatgggtgttaacacccggagaggaagactatctggaatgatagtggaggtgagcccggactatctggaatgatattggagtcgtgccagggtggagcgttagacaatacatcatattatttttccttctaaacttagaaaagttcattgatcttggacattagccactatgccatcttatttttattctaaacttagaagttcaatcatctagaacatcaggtacttcatcatcttatttttgttctaaacttagcaaagtctgacataatggaaagcttagccactacttcatcttatttttattctaaagttagcaaacttgcatgagtaactgtcattgtatatattatttgtgccttaaatggaagatcggtctagatatggtggcatattatgcatttatgcttgatgactagtttcaagttaatttatgtacatgttaaaaatcaattgaaaaatatgtatatgtttgtctacatatgggatattaaaaatgtcttacacgatttggttttgcttttcataaatgttcttatgcatggatgacattatcatggaaaactatagtcatttaatttgtagttattaatttttaatgaaacgattgttaagaatgtcttcgacatatcatgttctagaggaaatatattggttgtgcttgtttgcaattttgaatggtgtataattcctgaatatgcggtattagcgaactagtggcaaaagaatatcttctatacttgataatatataatgttgatgaattaactctacttattaccacttgattcaattttaactttatttagtctaacaatattgtgttggtcatttgatgtgatttactaagaatgactaagaccaacattcagatattaggacaagtagatggagcacaatttattaatagaatctacttccataccttcaagatggataatttctatagcatagacatgtaattaattatatgatagtatgctagtcgttagcaatattagttaggagacaatcaacattatacacagtgattgtagaatcaaccttttggtagaatatagatccatataaaatgatcttaattttgagccgttaaatgttaacaactagctatcaatgaatttgaaacattaaattattcacctttaaaataaataaaatcaccgcggttgaatttttttttctaaaagtggcgttgtgatgaatcgtttcatatgtacttaatatatatgtgtgtgttgtgatgtgctgatgtgcctttccttttaatatttccatttattaaagtgttgtgcttcactttttctttcttttaagttataacataattttcttttggttatggaaacatatcattttggacattggcatggtcttcaaaatataagtttgaccactaatttttatttcataatatctaaataactagataaaactataa

SEQ ID NO: 25417 - DNA, 181 bp, Oryza sativa
tcaaatatcaaaaccaataatctccaatgccaattgttcatcacagaataataataaaaaacacctttgatttcacaagattcaaccagcaattctaatggaactacgccacccataatgggataagagacccttaaggcaaccgatgatatctaccacatgaaccctagggaagcaagca

SEQ ID NO: 25418 - DNA, 601 bp, Oryza sativa
ccactcaatatgtactgcgacaatgagccaacaatgtttatgctcacaacaataagtcgagtggtgctgccaaacacattgacattaagttttatgttgtgaaagagaaaatccaggatcagaccattagtctgagcatataagaacaaaggaaatgttagcagatctgtatacaaaaggcttaccgcccagtgtgttcagagaacacttaaccagcatgggttttataggaaagcttatgatccttggattacaaaagggcctagtgtttatttctagatgaggaggtgcattgtagtcgttgcgtttgatggttcaatagtgactatcggatgaagcgtgctctatgcatcaatctattgagaagtaaatgttaagtaagagaagtaagaaaggcggagatcaaaggggagaatgttagttgcgatctccgggggaatcgggaaaccgatttcccactccgtctacgcgccctgatcgggggcgccagccgatctattggtagtgggcccctctcacgcagcacaatataaagagggggtgccgctgggcgcgcgaacaaaacattcgctgcatacacggactccccacaaaccctaga

SEQ ID NO: 25419 - DNA, 1501 bp, Oryza sativa
aatggagggagtatctatttagtattgagcctgttcggctggttgggttgtgggtgtggggtagtatttcactcacaaaatcagcagcagtgtgccgctgtagcctggctaccaaacaagcccattctgtttttactcagcacaaaacaacacatccacgttcgcaagcgtgatattcaatcaagtcatcgtcttctagatgatagtaataaatctgagttgaatttgacgcaacgatactgtatagctattcattaaagcaatgctaataatacaactgacttattggctatgagaattttttagcctttttttagcccacacatataatatttagctacttacaattaatactcacaaaatttcttggttcttgtgtccaagttgaccgtaagtttacagcccgcttctcctctctctcctctcttctatcctccacctcaacatttaaccgacttacaccctcctgttatacttgctcttagagttatagccaattgttggctctaaatcatctatagtcaacttaatagccaattcatataatagttacatataaacatatactacacaatcaatatctggtcccacctgttatacacatatgtgtcttagagtccatgctgcagctggctattaatctgtagtccgctactcttatatctcatcttttatctccttaaaatatgtttatatctggcttacagtctgctattgtgcctgctcttatctagcagttacatgctaacattaatgtatgtgtgatttcctttctgtgataatgttaacgaccaaatttgttgcactagagtagcagatctctcaggccagtgcgtgtttttcgcgtcaagagataccaggtgaaaccccactcgttgctgcgggagttcagtatgataacaataaataaaaataatatgtagcatagctaaacaatataaacttacataagcactggaaacaattgatgtaatatgacttaattagagaagagagaaataacattaaccaagtgatgatgaactacataggtacataagatattataagaaaataatgaagatatatattgaaatattatatgaattttgtgggatgatgatttaacatgctttcattttaaaagctctaaaatataataaattttaaattatagataatataacgtatttgcatgatattaaatgtattgattgttagtggatgatgatgtgtcaacttgttagtggatgataatgtggcatctttgcatgttaagctttaagagttagtgggttataactttatagtactattgggatgatgatttaacatgctttcattttaaaatatctaaaatataataaattttaaattatagataatatagcatgtttgcatgatattaaatgtattgattgttagtggatgatgatgtaacatctttgtatgttagtgtgttataactttactgtaagataggatttcagaagtatgatctaccgttttgaggttatctagt

SEQ ID NO: 25420 - DNA, 1501 bp, Oryza sativa
gatggtttatatgttagtcactgaaagttaaaaagacattactataggatttgtttggataagaagtcatcctttcttttatataatcgataaagttgttcgtcataactcaaatgtaaaggtaaggatcacaaattcacaatatgtagtattattttttaaaaaagtatgttcatatctattttcgagagacataaattgaatataagttatagttaagaggaggaaggtagttgggtaaactgacccggctttgtgcacccccatctgtaatactgctgatgcagtactgctgatgcaaattctctgcaatactgctgatgcagtagcggtggctaacatatgggtccagacccatacgtcagtgtttgctgcggtactgtaaacaatccccactgacatcagatagggctcattaccttaatcccaatcagaagtgatgtctagatctccttgttggttcttccatgaagcattaaaacacgtacctgaacttctttgctcaactattgaaggactcccttaggtcaatgggaaaactcgctccgtaacaacacaatatatagctggctttatttatatatcatgaattttgaactaatatatacaaaccaacaggcttaaggctatttatctaaaggagcgtttgaacctccataaaatctttgcacatgcgtaatctacgggtctttgcctttacacaaacaacccgaaatataaacttaaaataaaattattccatgttattgttgaattttactaaatcttttgagcaccaaaaagtaagagacttgtgctgaagtgctgggtgtacaattgtagggttagttggatttacgtcattataaattttacggtttaaaaatatatcattactatttaactatttagaatcatgccattataatttcataagtgttaatttatgcgaacttttttttttgtcaatcacaattctcgatgaaactgctgggaagcggtttttgtgacgagacaattttgcgaaccccgcccaggatttagggcctgtttagttcatgaaaagaaaatttttatgtgtcatatcggatgtttgaccggatgtcggaagggttttttggacacgaatgaaaaaatataactcacctggaaaccgcaggactagcacatgtgagttactgtagcatttatggctagtcatagactaattagactcaaaaaattcgtctcgcgatttccttcttcatggactaattaactgtgcaattagttttttcatttatctatatttaatgcttcatgcatatgtctaaagattcgatacgatggttttagggaaaaaatttggaaaactaaacggggccttagagcgatacagacagatttggggatttgtaaacccacgctacacactgacattagctcgcccacatccgcaagcagcatgcaaatgacgatcatcgattgctcatggaacaaaacggaacaacacagcaattcatctggctcataggaacagata

SEQ ID NO: 25421 - DNA, 1501 bp, Oryza sativa
aaataagtctcgacctactctagatcgcggcttaactaagtacaccagctcgagcttagcttgcacacgcgcacgcacacacacactacactacactctactctcactcactggccagccagctactgcctccgtcccggtttagttgtcgctttgactttttctttacaacgtttgattattcgttttatttgaaaaatgagtaaaaatataaaaaagaataagttatacttaaagtactattgataacaaagcaaatcacaaacaaaataaataataatttcataaatttttgaataagacgaatgatcaagagttacaaataaaaactcaaagcgatgagtattttgggacggggatagtacctagctagcttgtagctagtgtatctctgcaacatctccctgtctctgtctcttgctatagctaatgctaataataactgcaccacatcaagatcaaatcagaattgatcagaagaaggatgaagtgttttgttggagtggtagagacgatgtctggtcaaagattattggaggaaggagaggggggaagagatactagcttcatgtgtatatatggatagatatagtttggctaaatttgtgggttggagatatgggtttttgggagcgtttccggggaggtatcttttttgggggtttttgggttggtttttgcttggagaatatgtgtacgacagtattgaatgaggccttaaatttgccatactgttgcggcagcgtagagctcgtagttgtcattatccctgcccatcttttcagtgctttctggcccaaatttttgtccgtgttcttaaatgccccgcgaattgcacaacttgtatataggagtatgtatgtgtatgtagctagaacgttagtatatatacggaatgccataaaattaaaaggtgttctagctatctattagctgaaatttaaagtgtaccagtagtgtgtgctcgctcggctgctgctgctctatttccggtctaaatgcaatcctctcatcatttatttgccggtgttactatcaaaattaatcatgttttgttctcttgcccctgtcttttttatttatatatcttgaccattccttccttcctccttggaacgacgacgccataataattaactaattgattactagcttgtcatcatcgatgatcataaaagaaaatctaaggtagttacagcttcgttttttctaattaagatacaagtattaccgtggttttttgttagcacgtttccaaattactaaacgatgtatttcgtacgaaatatttctatatataatttgttttataatatcagataaatatatttttttaattttaaaataattaaaacttaattaatcatgtgctgatggttttctcattttacatgtctgcacttaatatttatctttagtgaactcaaactgggcttatagttgcattatgtcattgtgcgcgttgaacaagagagatcatcgagagagtagttaatggcga

SEQ ID NO: 25422 - DNA, 1501 bp, Oryza sativa
gtatcaggtaactaactacagcgtagaatacttcgatatactgagcacactactcgcaatctcatcgatctacatggaggcacaggctaccgtcgccgtcgccgtcgccggtggccacaacgacggcgaggaacgtcgccgtcgacgggtccgcttctgccgccgtggcgaaatgcggaatcacattctgaagcgtttcctttgtgcgctctgctgctgcggctgctgttcaggtagcgagtgatcgagcatcgggcagccataggaagagtcaatcatccaacatatattcagatagtactattttcatttctggtcataaattactactcctcgtttcattttttttctaagtcaaacttatcatcaagtttaacaaaatatagcaacatttgtgacaccaaactagtttcattgaatatattttgatgatatgtttgttttgtgtcgaaaatgttattatgtttttctataaacttgattaaggttaagaagtttgatttagaaaaaagtaaatagacttataatataaaacggaggaagtatttatatttactagtactaagtagagattgcatgatatggtgtcattcgtatctgtaagttgttgtgtccagcatggtgtggcaatgggattatagtatctgcacaagaacatcacctgatcgatcacacctttttttggcactttatttttcccctttttgctgctgtagtgggtggtctttgtttttgggaagctataataataatgtaatctgaatatgcgtgttgtctcttgctacattctgcctaactatatgaggacactcttgtttgatgctcagatgaaggattgccctaaagggtttgttccatttccagctctaattaggcaataagcactttcggcatcaatgcattttgcggcatccagtcaaaaaaaaaattgtggcagggatgatggaatttcgtattgccgccttttttctgcctggagaatctgcagcctgcaggtacctttataaaaggagctaattgggctcatatcaggggaaaaaaaaggtggctattataggatggtaagtcacaaagaatgaataagtccacttgtcatccctcatcttgacaaaaccgtccaagtgaggttccatggtaatatgaatggtagttttgcctaacgtggcatcttagttagaaaaaataaataaaaacatgtgggacccatcctctcttccccaggagctcaccaatggggagaggggcgacagcagacgaacctgtttgcgggaggcggcaacggcggttggaggtcagcaacaaggccaatgaagcggtgagggaggaaaacccgggctagcatgtccggcatggacaaggcctccctccttgccgaacgccgcagcatacattgacgagctccttgccctcgaggcctgcgcgaggcaagctactgcggtaaggtgggcattgagctctgacaacggcggaggcaccccctcctaccacggtagcgccgcct

SEQ ID NO: 25423 - DNA, 1501 bp, Oryza sativa
ttttgcacgcgtgacaaagcatcgtgtctgaggcatctaaggtgatcacgactaccgcagcactaccattttgctacatatcaaatcatatatagagatgatgcagcgagagaagaattaagcactgtgggttgtgtttttttccaacacttggctttgtttaagctgaaaccgagagttgattacaaaataattataatgtattgtgttatgtcgtatttggattttgtactatttgtttgtatagatgaaagaaatcattatgttataaatgtgagcacaatattaacgaatatcaatagcactcttacaaagactagggtgttataagggagtttaagatcctctttttttttccgattccatagtttgtaaatggtgtcttttttaaacaacattttaactttttagaagtcaatttattcgtttataccctcaaatagctatcacataaatcagataattcatcaattttagctgtcctaaaccctaagtagtacatattttttttatgcaagtcatggtgatcagtaaattggggatcaatggataatcaaagtcgtaagatgaatatgtaagtgctactatgaacaactgtaaataggtgtcaaaattaattgctactaattagacatctaatggcttgctagccacataattaatttctctcaacatgtatataaacatgcacgaagctggaacaaatattaccatatgccctatacatatatattaagcggttaatattctaattacacgtgttaagtcctttaaaatttcttaaaacgctctcaagctgtcacgtattagaaattctaaggggaaaagagtatcaattacttgatttttcacttaatcgctacgtccaatattataaaccgttagattaaattgatcttagaaaaaacaaaatactgtaaggtctcacctctcgtcccatggcataggtatgcacctacatacatgggtacgtacgcttcccctcccttttttcatttttccctttcttctttttttccatgcatacacttccctccctttcttactatatcatacaccttcttgagatgatttaatcataagaattttgagtatcttgctcttgtatttttcatttgtggccatactacacggtatgcatatagatggactgtatgatacttaactagcaatagtttcttatttactcgagaaaaaaaatgatttaaaagtcataccttaagaaaaagtttgtaaatggttttttaagataccttaagaaaaagaactttagtttgcccttcatctataagataaaatttttgaataaacaataattttacctttcaataatataagtgcccgcgcatgtgcgcgggccaccttcctagtttatatttaatgctctatatatgtgtctaaaaattcgatgtgatattttttaggaaaagtttttggcaactaaacaggacctaagtactccatggccacaatatacatgtgaaaacgtccggcggagaaa

SEQ ID NO: 25424 - DNA, 1501 bp, Oryza sativa
gggaggccttgtccatgccggacatgctagcccgggttttcctccctcaccgcttcattggccttgttgctgacctccaaccgccgttgccgcctcccgcaaacaggttcgtctgctgtcgcccctctccccattggtgagctcctggggaagagaggatgggtcccacatgtttttatttattttttctaactaagatgccacgttaggcaaaactaccattcatattaccatggaacctcacttggacggttttgtcaagatgagggatgacaagtggacttattcattctttgtgacttaccatcctataatagccaccttttttttcccctgatatgagcccaattagctccttttataaaggtacctgcaggctgcagattctccaggcagaaaaaaggcggcaatacgaaattccatcatccctgccacaattttttttttgactggatgccgcaaaatgcattgatgccgaaagtgcttattgcctaattagagctggaaatggaacaaaccctttagggcaatccttcatctgagcatcaaacaagagtgtcctcatatagttaggcagaatgtagcaagagacaacacgcatattcagattacattattattatagcttcccaaaaacaaagaccacccactacagcagcaaaaaggggaaaaataaagtgccaaaaaaaggtgtgatcgatcaggtgatgttcttgtgcagatactataatcccattgccacaccatgctggacacaacaacttacagatacgaatgacaccatatcatgcaatctctacttagtactagtaaatataaatacttcctccgttttatattataagtctatttacttttttctaaatcaaacttcttaaccttaatcaagtttatagaaaaacataataacattttcgacacaaaacaaacatatcatcaaaatatattcaatgaaactagtttggtgtcacaaatgttgctatattttgttaaacttgatgataagtttgacttagaaaaaaaatgaaacgaggagtagtaatttatgaccagaaatgaaaatagtactatctgaatatatgttggatgattgactcttcctatggctgcccgatgctcgatcactcgctacctgaacagcagccgcagcagcagagcgcacaaaggaaacgcttcagaatgtgattccgcatttcgccacggcggcagaagcggacccgtcgacggcgacgttcctcgccgtcgttgtggccaccggcgacggcgacggcgacggtagcctgtgcctccatgtagatcgatgagattgcgagtagtgtgctcagtatatcgaagtattctacgctgtagttagttacctgatacaaaatgtgtgtgatcaaggagatgatcttatatagggttcagagttgagagttcagagtgactgaaacagcgtaactgaagtctgaagaccgaataaaggcaataggacacagaaaggtaacaccctttcggcagt

SEQ ID NO: 25425 - DNA, 1501 bp, Oryza sativa
aaaatgcaaccatggtgatagtgggtggttggttagcgtatgaacatcgtggagcattttttctctaataatatatttttttcaggaggtgatgtttaatcagcctcttctgatggatttcctagcgcctacagtttctagccatttgtagattttttatatcgattctaatgcgcagtcaaacgcatgggcgaattttcactcgcttccctatgcggtgctctgaattttcagtttccagttgctgcttgctgcgctatcaaactaacaccttgtgttctgcgcagcttctcagcacttgctgtcaagtttgccggcaattggttgtggtaaatattagtcaagtctgaagtctccatctctcggagataattatcttttaataaatagccctgtatccattcatttttgtggttctaattgcagccgtcgcccttgtccttctgaattggttatgtgagctggggatgtgagtgacaaggcttcgtcctggattggtggttcgctagttgctgcagttcttgttttttttggggaatactggttgctgcagttcttgcatatcctgataggtgtttgtgcctctttttgcctgtttcgcatgaatatttgtttgattagtgattagtgtcgttggtatggtttgagttaccgcgtgtgtgcttttagctacggattcagaaagtatttttgatataagtactgtttgagatggagtgccttttggcttttaacagatttacctgctgaagtatgaccgattttttcatgtgtatgtcgttattatgctttatgtagacagttttcagtctctcctaacgttctttttaagataaaatgacatgtgtactctgtgtttacaccttttctacattttgctttagtttattatggttatccctttcttgggtcttaatgtagattcaagcaaattggataaccaatcttacatattactctattttaccaagaatgctagagcatgaatggtgtcccttgtatttaacaacttttcctgaagaagctttataaaaatctgatttgctgttgttgagtgcgactgaaatagagcaagaatttgcttgtaggaatgcttatcagagtaatcttttaaatttaagcgcataccttctgtatacaagaatattatactttatatgcaagtaacagagatcattttacttatctacttcagcacttaatgcaatgtcatctaatgcagtggatgttgggttccgtgtaaggaaatgtctggccaagagagagatgatgttccaatgctagagctacaaagatttcctactagaagtgtatcgatgtgtatacctgtcagggatgatatatatgaagactcaatcatatcccacagtggtcctattttcaccccagcaccaactcagtatacatccgtggctattccatcaggaaacagagacatgctcgataagctgcctcgtccaaaggttaagagcaaaccacatgttgttacgccggaagaagt

SEQ ID NO: 25426 - DNA, 709 bp, Oryza sativa
ttaacgaacgcgaacgagcgtgaacgaaacgcttacgaacgtgaatgaaacgcttacgaacgtgaacgaaacggttacgaacgaacgtgaatgaaacgcttacgaacgtgaatgaaacgcgtttagactaatacattttactcgtaatacatatatgattatatatgtaacttggcccgtttagactaatacattttcctggtaatattgtagagaagacgtcgtcgtcgtccctcaagccgaagtggtagctagccatcgaaggaattcgcgcaggcaagtgatgtaaagaagtgattgttagagatttaatataagattgttagacttagcatatatgattattacaattttaatataagatttgtagcgatttaatataagtttgttagacttagcatatatgattgttagagatttaatataagattgttagacttagcatatataaatgattattacaattttaatataagattagtagtgatttaatatgagattagtagagatttaatataagattagtatcgatttaatataagattgttatacttagcatatatatatatgattattacaattttaatatgagattagtagcgatttaatataagattgttagagatttaatataagattagtagaattttaatattacggttagcaaatacatcctatatacctaacaaatattttttgtatgcacaga

SEQ ID NO: 25427 - DNA, 1501 bp, Oryza sativa
tcaggaccctgatacctaactgatatcatcctattagaacgggattccgttgtatagcagccccactcgtggtttactgtgaaatgctataatatgaacaagttgtatattgtagcagcagactcattttattgtgcgcttcggattttttttttaagaccaaacgctttggattttaacccactaaatcagaggatccattatcttcgtagattcgacccaatctattgtatacgtaaatttaaagcactaattaatccttccatgccacaatataaacaatttagactacatatttacactatacatagccagaaatggttatattttgggatcgagggagtatttgtttccgatctaatagagatgagaaatccgctaatcagaataacaccacggataagtacctagaccattagttgggaaacgaataaaatcattattgcaaaaacatcatcttcttcttcatcttcttagtgtacacaacaccaactcgatcatcatctcgtcgcactaaacccatcttccccaacccaaagacaacgaactcgctggccacaaatccatccaaccacaattaaccactgctaagctacggtcccccacttcacttgccggggacgaagttggtggcgtacgcccaggcgttgttgttgacggggtcggcgaggtggtcggcgaggttctcgagggggcccttgccggtgacgatggcctggacgaagaagccgaacatggagaacatggcgaggcggccgttcttgatctccttcaccttgagctccgcgaacgcctcggggtcatcggcgaggccgagcgggtcgaaggcgccgccggggtagagcgggtcgacgacctcgccgagcggcccgccggcgatgcggtacccctcgacggcgcccatgagcaccacctgcaccgcccagatggcgaggatgctctgcgcgtggatcaggctcgggttgccgaggtagtcgagcccgccctcgctgaagatctgcgagcccgccttgaaccacacggcctcgccgaacttgacgccgttccgggcgaggagctccgggaagacgcagccgagcgcgcccagcatcgcccaccgggagtggatcacctccagctcccggttcttggcgaacgtctccgggtcggcggagagccccgcggtgtcccacccgtagtcgcccgggaactcgccggtgaggtagctcggcggctcgccggagagcgggccgaggtagaggacgcggtcggcgccgtaccacgggctccccgacgacgccgccggcttgggcttcgcggcggtcttgcgcatggtgatccgcgcctcgccgaagagcgcggaggaggtcgacggcgccgcgcgggccatcaccggggaggagagcgccatggtggccgcggccattgatgcagtgagctgtgagagctgagagagatggcgatgagcgagcgagtgtgagttgggagttggagatggcgcgggagtttaaatagcgcggga

SEQ ID NO: 25428 - DNA, 1501 bp, Oryza sativa
gtaattacttctaatgctatagcgagttacttctattgcatagctaagttacttctacaatttaaataaaatgcttttaaattaataagatgtttgaatatattcaacatggatctcttttgtcaaatattttgagtggagtacacggatgcaaatatatcttaaaaataatatgtgatttaaaagatttaagtcattgaaaaggttaacaaaagatatgcacaattgtatttcttttaagctaaaaggggatttatacttgagatggtgtggtcactgctctaaaacaaaccaacgactagtagtttcgtagttgtgtcctattaatttcttaagtccaactttctctaccgtcagatctcgcctagggatggcaattaccctgtcggatccgaagttccccaccccctatggggccggggccaaatatctatccgcggatcgtgcggggccagggctagggtggcatcttcactcgcgggcccctgaagtattgagcaaagggaggcagtccactagcttttaaatgtcaaaagcccattaaaaacagccgaagtactaccagccatggaaagcccatcaaaccatcacgtattagctacttgaaataagttcacccgtatccttgattccataaatcttcacccgtagctatacaaactatgcaatttagatcccatagctaggtcgttagaaaaaaaaatgtgggacttacatgccagctaccatcttctttcttcccttttcttcccgaacggcggtggtggtgggcttagtgaaggcggaggcggctgaggccggtggacggatccggttcccctgccgtagggagcggtagctatgcgccttgggagtggtgaaggtggagacgaaggcggccccatcagcttgcggcagtgcgtcgtcgacgataaaggcggaaaaaagatagcaacagaatatttttgtcagtttgaatattatagcgtgcaaccttcagttaaaagtggcattttaattaactaatcctattttcagcatggcatttgagcgaaagcgaaacccttttgaagacggcacaatctcaattttctcccctaatccgaaccgtccgttgtggcccctctttcccggtggcaacttgacaactcgccgagcagccgccgccggcggccatggaccgcgaagcgctccgcatggtgtgctcgcgggagttctggcgaatggccgtcctgtggaccgtctccctcctctactcctacatcctcctcttcttcctccgccgcggcgcccccgtccctcgcctccgacctatgcccgagcccgacgacgacgccgctcgtcgccgccgccgccgccccgtctgcgtgattactggggtaaccgatggctctcgcctccgctctttcttgcttgcttgcttgcagatggagtcgcttctctctctctttcgagtctccccgtcttgtgatgtgctcagctcatggtgggtggggtgtgtgtgtgtgtatgcgtgtgcaga

SEQ ID NO: 25429 - DNA, 1501 bp, Oryza sativa
agataccagcaggacacaacataccacaataagctactttgtaaaatgcatcacattgaacacctaatgccatgccatccttatttgatgtgcttaatgttctaaaagtcagccctaggcatggcgtgctaggagctatgtgccatgtcgcagctgtgattttgcatttggtggtgcaccttccttgggggctctagtgctgatattttaattgtctttatttatgtgatatgtttgctaattgctaggaaacctcttgtcaagttgatcttaggcggggttaggtgtctgtaggtgctaaccttgctgaccacctagtcaccttattgaacattgtatgcgctatgatagccagcaatgttgtgactggcttgtgtgcacctgtggtttagtgtacacctcaccgccttggctgcacagcatgactcattagttatggtgcacatgccccaaaccgatgttcgtactttcctcacaggcctagatttgtgtgtggttatttggtttctgtttgtgtgatttgcatgcatgatttcagggagttacactcgggcagggatttggatgtgggatttaatgcctatttggtttgtgggtaggcgtaggccctctttgtttaggcttataagcctacttataagtcgaaaagtctaagtcaaaacaaacaagcagctttttcatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccgtagtgtgattgcataattccctaggtcatggtttaacttgaactttgtatcacagtgtggagatatattcgttttgatgtatagatcatgatatggtaatctgtgtgccttttctgtctgaaccatattgaatatcccctgtgtcccaaaatataagcatttctggagttctgcatggtgattaaggaagtaggtggaattaaatgggagatggttttcatttgttgagatgaggaccttgctgtcatcccagtctcagctggagaaattaaacggtagatggttgtgatttgttgagataagggagtagctgaagttgctatattttggcacggagggagttactaagtggagaaaagaggtatggacttggcttgcatataattgatttactagggtagtgttcttgttttcgtttccaggtaagtggggtcattctggcacataatgttttcagtgaattttgcctgatttcttatcatgtgtggtcacatttcttaattccgaaaaacatattataaccaattgcccttgcatatgatgaatatgatcttactggatgtgtgttcatttatgctgtgatgtttactgattccttttacatatctgaagggaca

SEQ ID NO: 25430 - DNA, 1501 bp, Oryza sativa
cgacatccggtcaaacatccgatatgacacataaaaattttcttttcatgaactaaacaggccctaaatcctgggcggggttcgcaaaattgtctcgtcacaaaaaccgcttcccagcagtttcatcgagaattgtgattgacaaaaaaaaaagttcgcataaattaacacttatgaaattataatggcatgattctaaatagttaaatagtaatgatatatttttaaaccgtaaaatttataatgacgtaaatccaactaaccctacaattgtacacccagcacttcagcacaagtctcttactttttggtgctcaaaagatttagtaaaattcaacaataacatggaataattttattttaagtttatatttcgggttgtttgtgtaaaggcaaagacccgtagattacgcatgtgcaaagattttatggaggttcaaacgctcctttagataaatagccttaagcctgttggtttgtatatattagttcaaaattcatgatatataaataaagccagctatatattgtgttgttacggagcgagttttcccattgacctaagggagtccttcaatagttgagcaaagaagttcaggtacgtgttttaatgcttcatggaagaaccaacaaggagatctagacatcacttctgattgggattaaggtaatgagccctatctgatgtcagtggggattgtttacagtaccgcagcaaacactgacgtatgggtctggacccatatgttagccaccgctactgcatcagcagtattgcagagaatttgcatcagcagtactgcatcagcagtattacagatgggggtgcacaaagccgggtcagtttacccaactaccttcctcctcttaactataacttatattcaatttatgtctctcgaaaatagatatgaacatacttttttaaaaaataatactacatattgtgaatttgtgatccttacctttacatttgagttatgacgaacaactttatcgattatataaaagaaaggatgacttcttatccaaacaaatcctatagtaatgtctttttaactttcagtgactaacatataaaccatcaaacgagtccatattaaaggataatactacgaagaattgtcatcccacatttttacactgccactatcagttaaaactgaaaaccagctcaccccaagctcaccaagaatcttcgagaaacttataaactccgccgaaaaatctcggacaaacccgcggcttcacacgcctccacgcacccaaaccccaccctagaatatcctctccttggccaccgcgccgccacatcagcctccccaatctccccgccccacgcgcgagcgccaatcgcgagccgcctttagatttcccaagataaggactcgatcccccctcacttcccgcgctatttaaactcccgcgccatctccaactcccaactcacactcgctcgctcatcgccatctctctcagctctcacagctcactgcatcaa

SEQ ID NO: 25431 - DNA, 1501 bp, Oryza sativa
ttggccaccgcgccgccacatcagcctccccaatctccccgccccacgcgcgagcgccaatcgcgagccgcctttagatttcccaagataaggactcgatcccccctcacttcccgcgctatttaaactcccgcgccatctccaactcccaactcacactcgctcgctcatcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttcccaactaatggtctaggtacttatccgtggtgttattctgattagcggatttctcatctctattagatcggaaacaaatactccctcgatcccaaaatataaccatttctggctatgtatagtgtaaatatgtagtctaaattgtttatattgtggcatggaaggattaattagtgctttaaatttacgtatacaatagattgggtcgaatctacgaagataatggatcctctgatttagtgggttaaaatccaaagcgtttggtcttaaaaaaaaaatccgaagcgcacaataaaatgagtctgctgctac

SEQ ID NO: 25432 - DNA, 1501 bp, Oryza sativa
gaaagatgtagtgctagatattttattagtcaattatattatatactccctccattcacaaatattcatcatataaatttttttgatgttttaagaaatgatcagcgtattaagtatttcttctcactgtcttttcatttctctatgtaaagtaaatgtttcgacgcatgcatgtagagcatatatagttgcatcccttcatttcgatcagatgctagaatttatatatattttggaacggatagagtactagatattttattaatcaattatattatatagtcccttcattcacaaatattcattatatagtactttttcaatgttttaagaaatgatcagcgtattaggtatttcttcgcagcgtattttcatttctctacgtaaagtaaatgtttgggtgcatgcatacagagcatagttgcatcccttcatatcctgtagtgaatgatgcgttcaccaaagcaacattttttttctttttcttcaatgcgttgatcaaatggattagggatcaatcttctcctccttgtgcagtgtaaacatggaatgcggtgatcaattcagaatagagtgagtataccctgtaaacacctcccccaagtctgtaaacggtactccctccatcccaaaatataaacattttttaactttgacatagtttttgagatactattttaaccaacaatatttataaaaataaaatattttaaataaaaagcgttacatattatgctagtttgattaatgataaatctaataacatcaattttacatgattaaaatggttgacttagtacaatgataaaaatgcttatattttgggacggaggaagtgcgtcgcctaccaggctaccacggccatctgttgagggatgtgcattttatgcttctagcaactttatcactctaaaaaaaactcttcgaattaacccctcggtctagaaaaaatagctaaaatgcataaaaatacaataccgcctgattaaaataatgtgctttcaagttgttttagcgacttcaaaattattgtagtccacttccgtcttttcaggctctatatgcagttggtagtaacttatgagaatttataaaagctagattttggcttttactttgttttctcatttttatagttacatatatattctcagaatatatgtgagaatttgcgctgtttagtggagctggatattttaaaaggtaaactcttctaaacagggtgtacatgtgtgaattagaggatgtggccctagctagctttgtaattagctgttcttgatcaagcgtgtcagtttcgcctaccgaaaattcgtcaaattaatgcacacagattatttcgccatcgttttgggcatcccatggatcccatgtttctccctcgcagaaacattctggcgcatgcttggcaaccgccatgcctgagctgtagtacactagtgcttgacttgatcgagagatttttctaattattggcacgttccagctggtgtgtgtgtct

SEQ ID NO: 25433 - DNA, 1501 bp, Oryza sativa
ggccgttgaaatacatttgaaacttttttactgctctttaattaccattgcgcaatataatggagaattaccgcggccgatcgaaatgaccgggatataacggttatttttacagtcacgccttaggccgtatttagttccacgtcaaaattgaaagtttgactaaaattgaaagtttgaagaaaaaagttgaaagtttacgtgtgtagaaaaaaattgttgggatgaaaaaattgaaagtttaaagaaaaagttaggaactaaactcggtcttatctaactaaacacaggattaatccggtggtgattaatgaagagtgtgctgatcaatgcgcaaaattagagcacattgtattgacatggtacacgaatttaagtgcaatctagtatataaacttgtaaaatacttattttttatatgaatttgttaggtgtgtaccaaccaaaaaaaataataagactaattttgctaggctctcatcggatggcctgttcagccaaagaaaaagttaaattttaaattttcaaacttaatttggaggttgattttgagatattttcaacgtaatttcctttttatattagcttttaagtcaccaataacacatatataaaagttttacctacaaattcgtttttattccctaataagccggcttattagggaaaaagccaaccgatggggaccctaatttaagtgttaacatatcctctcttataacccactaactctttaagtttgacatgcaaagatgccacatcatcatccactaactatcattacaccatatcatcatccattaacaatcatgacatttaaacatcatgcaaacatgttatattagctataacttttaaatttattaaatttaagatcattatgtttacataatatttcaatgtatatcttcattatgttttataatatcctatgtatctatatagttcatcctcacttagttagtgcttaaatgattaatgtatgtacaaattatctatatcatttcttctctaattaagccatatcacctcaattgtttatagcctttaaatgattaatctacgatgcaaactatcttcctacttttcctctttcataaattcgtaccaccttacgtttacatttgaatcatcaatctacatactatttaaatttaaattatcataaaccacactaacttacttaatctgatattatctagctattttatatgttatttttatttattattgttatactaaattcctacagcaacgtgtgaggtttcacctagtgttatatgataagaatgctacctatacatataaatgttaaatagagatgattaattagctggtatagttatgggcacacggctgggccacatgtatgtaacccccaagttggttaatcaaataaatagtatgcgtgattaattggctctatcaatcatatggtctgatcctacggcgcagatatatatatatatatatatatatatatatatatatatatatagga

SEQ ID NO: 25434 - DNA, 1501 bp, Oryza sativa
accaactgcatatagagcctgaaaagacggaagtggactacaataattttgaagtcgctaaaacaacttgaaagcacattattttaatcaggcggtattgtatttttatgcattttagctattttttctagaccgaggggttaattcgaagagttttttttagagtgataaagttgctagaagcataaaatgcacatccctcaacagatggccgtggtagcctggtaggcgacgcacttcctccgtcccaaaatataagcatttttatcattgtactaagtcaaccattttaatcatgtaaaattgatgttattagatttatcattaatcaaactagcataatatgtaacgctttttatttaaaatattttatttttataaatattgttggttaaaatagtatctcaaaaactatgtcaaagttaaaaaatgtttatattttgggatggagggagtaccgtttacagacttgggggaggtgtttacagggtatactcactctattctgaattgatcaccgcattccatgtttacactgcacaaggaggagaagattgatccctaatccatttgatcaacgcattgaagaaaaagaaaaaaaatgttgctttggtgaacgcatcattcactacaggatatgaagggatgcaactatgctctgtatgcatgcacccaaacatttactttacgtagagaaatgaaaatacgctgcgaagaaatacctaatacgctgatcatttcttaaaacattgaaaaagtactatataatgaatatttgtgaatgaagggactatataatataattgattaataaaatatctagtactctatccgttccaaaatatatataaattctagcatctgatcgaaatgaagggatgcaactatatatgctctacatgcatgcgtcgaaacatttactttacatagagaaatgaaaagacagtgagaagaaatacttaatacgctgatcatttcttaaaacatcaaaaaaatttatatgatgaatatttgtgaatggagggagtatataatataattgactaataaaatatctagcactacatctttcctaaaatacaaattctagaattcaaaatttgctccaaactataataaatttttcacccacactcctttctgaactaatcacaacatttcaccactttctcttatcaatcaatcataatctttttatatttaattctatttactttctttaatactgtgtccattaaaactcttcatattttaggacggagaaagtatcttataaaagaataatttaataaactataggatatatgacactaatgattgaagactaatcgctttcaagggccaggacaacgctgataagtgattagatattgtgccttattgtttggcatattcatatgcttatcaaccaaaatttaaattttcaacgttaaatttggagttgattttggagtattttcatcgaagtttatttttcagcctttgcttttagatcgctaag

SEQ ID NO: 25435 - DNA, 502 bp, Oryza sativa
agtattcaacaaatgttcgccacctatatgtcaatgcaagcaacatattaactgtgtatgcaagccttgaagaaaacatagaaataaagaaaaatttgagaagcttaataatatgcaaggcagatgttgcctcctggagctggacccgcacatctaatttcaactatgctctggaagaaacactgaaagagttaggaagcttacgggtattagtgctccgccatcctgctggtgttctgccaaacaacatccagcatatggtccaccttaggtatctggacatcaaagaaagcagagaatttacctttctgcctacatcgttatttggactctaccacttgcaagcattgagtctgcagtctcggtatgtgaatagactaaaaataggactcgaaaatggcatcagcaggttgacccagttaagatacttagatgctccaccaggaataatttcaggcataaaattgattggcaagctcacattcctccaggaattcaacca

SEQ ID NO: 25436 - DNA, 229 bp, Oryza sativa
gcagtgccaaattttggtaaggttaccaaaattttggcaagatttcatatgtacttactaaaatttggcaacaaactaaatgtagttatttttttggtaactttgccaaaaaaaaggtaaggttgaaaatagtaacaaagtgaaaaagcccaacacctgctaggtctcgacctattgccgctgcaggtgtccatcgctcctcctgacctagcgccgccggccgccacca

SEQ ID NO: 25437 - DNA, 1501 bp, Oryza sativa
acagcgagcaccacaatggcactggttgccattttttctcgttttttcacaccgggttgtaagctgtttttcttaatttatttttctgggttatagataccactgacgggtacatcaccaacctatggaccgtttgagatgtggtcatttgcgacgggttctgtaagcagcccatcataggggttggtcaccagcgacgggccttcacccgtcagatgtgaggtggagtcatcactggtcactgatctctgacgagagccaaacccgttagaggtgatagtatgagtccgtcagttagcgtagtgattaaaagttcatttcctctagataaaatatttcctagttcttgaaagacaaccgagccactcgttgtgtcattatctgcatagcaagtttgcccacaaaatgctaattctcatactttagagcaatataattaatactttattagtttaatattataagatgctttgttaaactttcttaaatttaactaaatttatagagaaacatagcaactcttataacacctaacttgttccattgagactaacattgaatatagtttgatagtatatgtttggtgttaaaaatgttactatatttctctataaatttgtaacttataaaagtttgacttaaaaacgtcaaagcgtcttataatataaaagatgaagtacccagtttcatatcactggtggagaaaccatctttcgtcagtcggcctaattgcacaatagtcccggttgcaacaaaaacggggactaaagatcatctttgtcccgattcaaatgctgtcagctgtgccaggcgccccagagctcattcctgctgcccggtgatatcaaccggggctaaagatcccgacgatctttagccccggttcataacaccaaccgggactaaagtcccacccctatatatatatatgtcttcttcctcctctagcccgagcaagcttcaaaatttcttcaaaaaagaggggaggtcatgccaaaatttctagtgaatttattttggtgattatatacaaatcggaggtacctaaaaggttagcaacttcatcctccaatgttttttttgtcatattacatttggagctatgttttgcacacttttttgtctccaaaattttgttgttagttgatgagagagaaaatttgtgtggggaagaaagaatatatagaaatttagtttatttgctaaagaaggttttataaaatagttgagaaggaaaatatagtgaaagttaatcttgaataatagaaaacaaactaaaatgaaaaattaaaataagtacaacacattaatagtagtttaaaactttataaatagtaaataagaattatttggtgtaatatttcataatttttgtatgaataatgatatgtcattattgtgtgactgttgaaagagtttgtaattattttataattattgtattactgtcattattatacgaataattatttgtgtacgattttttttcatgtcatgtaga

SEQ ID NO: 25438 - DNA, 1501 bp, Oryza sativa
gataaaagggaggactggtacacgcaccctagtgaaaccggcctgtccaaagacaaaatcactagcagccaattatcaccaaacataaaaaccaatcatcacaaaataataatccaaacacactttgattacacatattcaacaaattaaaatgagatataatttgatgggacagagcccccaactcctccttattattaactagtgttaaaccacatagtttagccaacaaattttaatgaaactatgccacccatattgcattcagagaaccatggctaccaatttcaagagtatatatagcaccattgtgcattgtactatgctcttttgatgatagcatagtaaaccaaaaggagagctaataggaagacataaagataacttgcatcgggttaaacaattgtttacaattgagaactatcattgcggcaccaccaaattgaccaacataaagcacttgttccaattaatatcatatttttcatggacctaggtactcttctaaaccatttagtgttgatatttctttactaggaagttaatcccaagcaatgttgctagaaatattaaatggtaatataatggattacataaataaatctgcaagcgcacggatatactgctgtagcgtttcacctagaagtacttccaagttatcgtatttatttaatcccaagggaagatatggtaagagagtgatgtgctataaattcatattacacttatgcaaatcaaagtcttacgcatgggtttatcaattgaggataaggatagatttgacacatagaaggttcagtttagaatactctcactaaattataagtctaggctaagtagagaagaaataagaaaagcatcatttatgtacttctagtatatagtccttttgcgatacacttgctattgtacaactatgtggtacatcgagaaaccacccctaattgccgagtaccttacgacaatccgtcatgactatccaaccagttttacatacggaggagtacacgaacaggaacctttcttagccctatatacgcacgtggaggattactcgtactgaactgtcagcatcagcggcctacctctatagatccatggcatatagcaccacttaatgatacttaataatctaagcaccatgcttacattagtaaatactactctacacctctgcagatgacatagaacaatcaaataagtgaacactatgccaataccgttgcatatctctggcaagctaaccatataattaatacgagataagtgtaaaccaaattaagttggtacttgaataattatgcaaatatagaaaaggacctataaagaagaatatttcattactggataaagtcttacaaaaaagggaagagctactagaaccatacccaaattctccgtaaaacttgaagaactaaggaagaccattctaattctaaatccactagcactagagcgaaatatgtaaactaaagagagcttcttcacttgatttccttca

SEQ ID NO: 25439 - DNA, 255 bp, Oryza sativa
tacggcgtggaaaaatatcgcctatatttgttgcgttgtccaatgctaattactatataataatatctgacaggtactaattacacgttaattaggtggcgggatgcatgctaattctgtaattcagttgggttgccaccggctgagatccgttggaggtgttcgtgacggacgaatgctcgcgaactagactcgtcccttgctctctagctttcccagccatccctcctcactctgtagtccaccctagatcca

SEQ ID NO: 25440 - DNA, 1501 bp, Oryza sativa
ggggaagaggggtcgagagggagggtttactgtagtgctaccttatagcctatcgagctctccagatgtttgagtctcgttttcttttacaaaatataatatcaattattgccaaagatgctgatagtaaaactctaaataaacccatgcctcaaaaaaaagaggtgtcaccgagccaccagtatcagtcataggaaacataacccatgtgaccatgtctacagacaactagtcattgtctcctttttcttccggtcatagcttctaataactgtcactttgcacaacgattaaggtcgtaaaatatatatcgtatttttattttgcgcaatgtttaacgaagtcaaaagattgagaaactaatgttacatgacaatttttaaattatttcagtacgatgatatagacaaccataacacccccaagactctcctttttgcaaatatttggaatgctagatctaattgtaaataaattggacctagttataatagtactactttataataaaaaaatgaaaatattagccaaaatgtatagtttagttgcgtggaagttaggatgtgaaaattaattaaactaatggtgtatgattggggtcatacggatttgcttcttaggtgcactatttaatcagttatcagagcttatagcaaaattgtcacctaaaatgatattggccttctagctaggatcaatatgtcttattttttgggctatattaattattatcattttttataacatagaatttgaagcatattattgtagtaaaattatactggatagcacacctgaagagagcattataagaagcaaatatgtctaaaaattgatttaacacaagaaacctgatgaacttttgttcctcaggaacaaatttaccgctagatgaaccttgctcatcactaagaatctcttctttcagtgaaagcttttggagttttgacgactgtgtgcacagctggttcgtccctcttaagttatagttttacttctcaactcattgaaaagcatattgtaataacacatggaagcagtatattgtagaaggattctattaagaatattggtcgtaatatcatgatagagaccaactatagttaggagtgtcctggatatacctttttaaagtagatggcttagaacttatacgtttttcagaatatctaaagatataaaacatggtaattccatataattacactcaattgtgtgatttttttatcgaaagtaaaacaagcatgaagtgtaagaaattgtgaagaacaattaccaaatgtgtgaacttttcaaaagagtacacctcatggacacttgtcttttgaacaaaggcacgtattattactttccctgtttcaaggtatagtgctgctgacctcatagtacggaatacataatttttaatgggatcggtgtagtgctgcaaaagacaatgtttaaaacccaagtgcattcaaagtgaataagaataattaattgcaatcacatacctggtctc

SEQ ID NO: 25441 - DNA, 1501 bp, Oryza sativa
agatcggccggtccaaagacaaaaccaacacttcaccaattatctccaaatatcaaaccaatcatcgcataagccaattgtttatcacaaaataataatcaaaacacactttgatttcacatgttcaacacatagaaaaaacataatgtgatggtacagacccccccccaactccatgttattattaactagtgttaaaccacataattcagccaacaatgttaatgaaactatgccacccatactgcattaagagaaccttggttaccaatttcaaaagtatagcaccattgtacatagtactttgctctttctatggtagcatcgtaaaccaaaaggagagatactaggaagacataaagataacttgcatagggttagacaattgtttacaattgaaaactatcattgcggcaccgtcaaattgactaacataaagctctagctcattttaaaatcatatttttcatggcctaggtacttttctaaaccaattaccaaaaatatttatggcattacgaggtgggggacaataaaagcaaacaacacatatctctaaatagaacgcgtaacaagacagctaaagaaaagatgttggattctttgttgtgcatagctgaaagaaacaatagtttttgtctacccccaatttttttagccaggttatccttcgtcagggttactttgctattaaggagccacataacttttagtaaatctttaaatctcatgtaatccacttgtggatgctaactctagagttcatgatcgcgatatacatagagctaactgaaaattgtgcattttctgaagcgatcatccaaattaatctttttaatttgcagggttacgtatggatctagcccaccttgtatttctagtcagatatgtaggctgtttgactatctaatacatgtattgttcacaagagggtagaccacatttattatattgaaattacacaacggaaattgctcttgttcttctcctagattttgtacagccattgccaaatgagagagagggattgggaatttctgtcgtagattgttcttgcatttccttgtttatgccatagtttgggaatttcttgcattcttttatttgtttgcaaggaattgagggggcaatagatctactcttttgtgtggttgagtggatcgcgtgtggtttcacgaattcatggtgctgcacgggcactgtgtttgtcatcgagtttatgggatttcatggtgtatccggatcctacatcgagaaggttgggcatcccagtatcaataatattactcttagatttgttaaattttggaggtgacattggatttaattaatttgattgttcatagtacgatgcatggttacaatgttatgataaattgtataaattaattttttatttaaattactaccaggtcaggcctagtagtagtataaattaatttggaaaatatatgacagttggcatcagatattattctatctagaacatatcttaaccaaa

SEQ ID NO: 25442 - DNA, 1501 bp, Oryza sativa
agacaccggggaaccttttaaaggggctcgaaggcgacggcgaaggcccacggcggctggcgacgagaaggaaggtttagggttcggaggagagagacgaatccgattcgaactcgattccaacaatttccaaaacgaattagccgatgtttccaaaggagaaaaggtagaggagatcccgaggatcatttcccctctatcaattcggccggagaaggaaaggagcggccggatttggaaaggaacggcggcggcgcgaaactagggtttcgggcggcggcggccggaggttgacaacggccctgacaggtgggccccacctgtcagcgggcggacgcacgcgcgcggctgcggcggactgggccggactgggccgaggagagagagagcggttttgggccgacttttggcccaaagccaaaagagactttttaaaacctttttcaatttaaattatttcttaaatgcaattccatttattgaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacacagtctccttcggctcaggctcctgcgcgtggacatggcgttcgccggcagcacgacgctgaggcatggctggccgacggggagaagaaacgaagagaagaggaaggagatgagaaaaagagacggaagaagacggaagtgatggaaaacatcacggcgatggcatcgttctaaatttataaaatttcagtaatacctaaacaatagagggctgctatataccggtataccgttcggacggtacaggcctacaagcagttagccggacgattccttccgttcaattagtatgtcatgtatattgtcatcgtgtctcaaaaggtgtgtcatgtcacccccattgacccatcatttgtcattttgtccacgtgcatacgcaaaaaaatcttcatgtgatagccaagctagtttagtatagcaagtagtagcctacctagctaccaggtatcaaatctgttactgggtacgtatcacatctgataccgagtgagcattaagtctattatcaggtatcacacctgataccgagtgggtgccatgcctcataacaggcatcgtgtgtgataccgtttggtatcaagtaccagataaccggatggccaagtatcatatttgatacatgctgggcatcggtcttgataaacgatacctggtggttatcagtcccagtatcatagctactatataccgcaattccattcaaaaacgatatgataccggttagatatcaagtcctgatatctaaccggtatcatgcgtttctgccacgtatcaggtgatacttgtgaggtatcagatgatacctatcaggtat

SEQ ID NO: 25443 - DNA, 1501 bp, Oryza sativa
atagtagggtttcatttgcaaaagcagcatttagcaaatatttgagaatttaataaaacagttgagtaataattaaacaatattaatccaacgctatacaacataccctgttgcataggcccaaccattctgaacaaccatcccggctgcacagttctatctccaaaccaggaatataccattccaaaccaggagctaatcaaattattaccaattaaagcatcacttactatggtgagaagggtgagactaatcacgaaagatattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccactacagcgcacctttcctggatcataatcacccccttataaataaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccaacaaaatcatgtgctcacaacccacctttatcaggttttagttggcacattaaataattaaacaatcacgattgaccatcgtgaactatcattaagccatcattaaataataatgagtcataagttatcccaatagtgagctaatgtttctaagcatggctaagcaattatatctaatatctagttgaaccaatataaataaagctcaactagtcaaattgtaataacccaaggtatcaaggaataaagtaatcaaatacaaaagggctatagcaaagaataggttaattccacccaatgacattcgaaaataaatacaatagttgaatagaaacaatagctttaaataggatcaacatgctcaaagggttgtttgggatctgtgtgacttgccttgctggccttggaactcttcaaattcttctcctgcgaaaacggactctccggaaacggcggaatctaagcagaaagaagcaaaatcaccaaaacagcatataaataagcatgaacagtacatgtggatatttttaacatgtagatctcaattttagaaaaatttagagacttgaaccaactaaatccgagctaagatgaattagttatgaatttttgaagatttaatcggattaaaacacttaaattgattttaattgaattatgacgcaataatgaattatttttgaaaaggaaaaaggggtttattgcgtcagcggctagggtttcggtggaccgggcgcacgggcgacggttcacgcgaacggacggccgagatcgatccatccaaaacggacggccgagatcgatcggtctacgaccggctcacgggagagggcgacga

SEQ ID NO: 25444 - DNA, 445 bp, Oryza sativa
ttggaattctggccctctttagggtgtgtttagttaaagtttagttgaaattggaacgatacgatggaaaaattaaagtttatgaccgagtttagttcaattggaagtttgaagaaaaaaattggaactaaactcggcctaagatttcaacttttttcttcaaacttctaatttttccgtcacatcaaactttcttacccacacgaacttctaattttttcgtcacattgttccaatttctttaaactttcaattttagcgtggaattaaacacagccaaaattggaagtttgatttataattggatctatgccactataaatttgtttgtttagaaaaataccactacaattcacctaataggaaaagggaaatgctgaacaccggtataccgtcccgacgggataggatagacaccaaccaatccactcttcttctacctagc

SEQ ID NO: 25445 - DNA, 315 bp, Oryza sativa
cgagctcggtaccctctttgttaccaaatttgtgaggggactgaaacctgaagtcaaaatagctttcaaattgtataaacctagaactgttgatctggctctgtctttggctaaaacgcaggaggagttgctaggagaattgtcagcatcgaaggctcaacagaaagtgattgtgaaagaaggattcaaaggaggcatcaagccagcatatgttgccaagggaatattgggggcacatcctgaggaaaacaagaaaggagaggagaaacccaagtgggaagacatatatgaatcactcaaagctgctaggcgagc

SEQ ID NO: 25446 - DNA, 1501 bp, Oryza sativa
tgaaaaatatcactacaattcatctaattggaaggatgccattgcaatattttcaaaattagatccatgccatcttgcaaccttaatacctgttttgtaccctttttttgctattgtattttcgtatggaccgaaatacccttcatgtactttacatgccatatggatcaaaatcccaaattgaaatagttgctgccacatatgcatttcattgccgtcggactagagacaaagaaaatctaggataaaaataatttatagagagaaaaggcaagaaaaagaagaaagaagagctggtgtggagggctcgccattggcgaccaccgcctgagccggccatcgcctccacgtcgtgacccgccatcctccccgagctcgtgccgccgctgaacctatcgtcttggaccttgcttgctgccgccggatctgctcatcgtgccgcagccccaccttgcattggcgccgtcgtatttgttcgccacgtgtgcagaggttgcgcagccgaattagctcgcgcctgccgccaccgtccctaacctcgccgccagttctactggcgagctcgcgccatcgccttgtgcccttccgccagcattcctccgcggacctcgccgctgttggctgtgctctccgagctggtgctgtggccgctcgctctctctctctctctctctatgatagggtaagggctggagcagctgaatttttctctttttttttaaccttttttactcagcaggcaagtttataaatcaaattgacaagggtatgttggtaaaagaataattcaaaacgagtataagtgtacaggatggcatgaatgtaaggtatttgtcatgacaactgtagttcattaaggctagcctgtgtgggccagttatgggccaagggtgtgtgagtgaactgacgtgccgtgttgggtcggcagacgcgtcaggtgggtgtgtgtgctgtggcatgtgaccatttaaggggaaatcccttgtctgtaaacggtatcgaaaaaatgaaagaaatcaaatgccactaaactacctttccctcctcaattcatccctttccccaatctctaatccaaatctctagcgaaatcctgattcaactaggcgaaacgctggaagagtcatggaattcgtgacaatctagtattagagcacttcggttctcgtgcgcactggcgaggaagaaggcaaatccaaccctaaccgagaggatgggggcagcggaagaagaagcagaggtgttgggcgagaaggtggtggagctcacaacaagtatcaacaacatcctcggatcgcttcaaggtctggagaaatggatcccatgcgtggattcaggaatccgggagctgaacaagccggtggatgagattgcggtcagggtgacgcagctagaatcggtgacgccaacgacaccatcgcaggcggcacaagcgcccgtaggcacggcgtcgaatcgactcaccagggtgacgcatccgaagccttcaaggctaaggagc

SEQ ID NO: 25447 - DNA, 1501 bp, Oryza sativa
gagttggttttccagagttttgggttatctccatcaaactttgggaaatctgtcttaggcagtctagggctggcggatctaacactaaagctggacccccctactcccttctctgatgtttctcccaactcaaaattaacaggcgaatggtggaattggggcttactcttgaccagggtttgctccttagccttgaaggcttcggatgcgtcaccctggtgagtcgattcgacgccgtgcctacgggcgcttgtgccgcctgcgatggtgtcgttggcgtcaccgattctagctgcgtcaccctgaccgcaatctcatccaccggcttgttcagctcccggattcctgaatccacgcatgggatccatttctccagaccttgaagcgatccgaggatgttgttgatacttgttgtgagctccaccaccttctcgcccaacacctctgcttcttcttccgctgcccccatcctctcggttagggttggatttgccttcttcctcgccagtgcgcacgagaaccgaagtgctctaatactagattgtcacgaattccatgactcttccagcgtttcgcctagttgaatcaggatttcgctagagatttggattagagattggggaaagggatgaattgaggagggaaaggtagtttagtggcatttgatttctttcattttttcgataccgtttacagacaagggatttccccttaaatggtcacatgccacagcacacacacccacctgacgcgtctgccgacccaacacggcacgtcagttcactcacacacccttggcccataactggcccacacaggctagccttaatgaactacagttgtcatgacaaataccttacattcatgccatcctgtacacttatactcgttttgaattattcttttaccaacatacccttgtcaatttgatttataaacttgcctgctgagtaaaaaaggttaaaaaaaaagagaaaaattcagctgctccagcccttaccctatcatagagagagagagagagagagcgagcggccacagcaccagctcggagagcacagccaacagcggcgaggtccgcggaggaatgctggcggaagggcacaaggcgatggcgcgagctcgccagtagaactggcggcgaggttagggacggtggcggcaggcgcgagctaattcggctgcgcaacctctgcacacgtggcgaacaaatacgacggcgccaatgcaaggtggggctgcggcacgatgagcagatccggcggcagcaagcaaggtccaagacgataggttcagcggcggcacgagctcggggaggatggcgggtcacgacgtggaggcgatggccggctcaggcggtggtcgccaatggcgagccctccacaccagctcttctttcttctttttcttgccttttctctctataaattatttttatcctagattttctttgtctctagtccgacggcaatgaaatgcatatgtggcagcaactatttca

SEQ ID NO: 25448 - DNA, 1501 bp, Oryza sativa
ccatggccaggaggcacaggttttcgacggcatggacggcatcttcctgcgcaagaggaagaagctgagcgacgcgatctgggacatgatggagaaggttcgatcctccttcttgcaggatggatgctggcaagtctcgccggaggcatcagcatcaggagtccatgagaccaccgtgctgatgatgaactacatcgcgcttctctggcgcaacgacgacgtcctcaccttcatcctgcaggatcaccacttcagcgtgttcgtctctcacacccagggcttcagctcggtcgtgaacctgatcaccgacatcatctcttgccttggccacaaattggaggaaattgcctcctccctttccaattccatcttggacccagcgttgcgttgcattttcttgctaaacaattggcagcttgtgttgcaccgcatcgaatccctggacctgccatcttgggccttgatagacagatgcaggacacggaggtacatagacacttacattgacgtcttctggtcgcctctgttgtgctgcatcttcatcggaaattcttctgatactcctcgaaagaaaacctacagacctgctttcggcttccgaagatacctgtctcttgaaaattttgagatagaattcagaaaaacctacgcgaagcacaagtttttcaaggttccagaccctaagcttcggcagagattacgtcaagccatcatccagaaaatcattccgcattatagcatgtatctggaggagcgagcagcaaggggaatgcacaatcgacctcccaaaattactcctgagcagttgaaggagctattagaagaattattcgaaggttgaagcagatgaatttcagtggaataaatggctatatatttaattagcactcaccgttttgtcaccctagcttgggtcgtaggtttgaaggtttgtgctccggccagcaattaaggtgtggtttgtcttctttggactttggtgattatggtgagagtataattcaccaagttcctgcaaacagaaacttggttagtcttgccttattcgccggagaccttacttagtcttgcctgcttgtgaagatgggggttactaaaactgttgaaatgagttttacttaaatgttacaaatttaattatttccgttgtacagataatctattatcatcttcgtgtactctctttggttttgtcgtgcatctacttgtactttaatattgtggtgtaccagtaaagtaataagaagtaatacgttgtgagttgtggcatcccaaaaataattttcttgagatgttagcttacacttacagacgacctgttctcgacttctagtatatactttattttgttgtctaggggcaagatctactgtaacaaaataaatgtaaaacatgtaattttgacagtttatacaatgcagtaggagcatgcatggaagtataaatcaattgttaacaattggaaacatcaaacaaagcgtccaattaatggtttcagacg

SEQ ID NO: 25449 - DNA, 200 bp, Oryza sativa
  unsure (1)..(200): unsure at all n locations
cgggcnnnnnnnnnattagatacactnnnnnnnnnnnnnnnnnnnnnnnnnnnnnnnnnnnnnnnnnnnnnnnnnnnnnnnnnnnnnnncgttatcatctgtgtgattctgtttgaaactctgaactcatgatcatgtcagttattttcagaattgaagattagttgctacttactatactccatgttgtgtgctgcagg

SEQ ID NO: 25450 - DNA, 1296 bp, Oryza sativa
acatatatccaagggtagagggtataccttatccgtaaccctgacaatgaacttcattttttatttgattatttgaatctacgtcgaacctatagccgattgatcaaaactctatcgacattggctggcctcgctgcatcacatcggcctattgtccgattggctcattgatcttgtacagtcaatttattcatcttgttagttgcaggatcaaactaactggcacgccctgaacctgattaatagggcctgcactagagataagtggatctcccaggccttcgtgtgtcgtgatgaatttcatgttaacacctctatgtggcgctgaacgttgtacgtgaggtggaacagtgaggcgtcccctcaagcggaacaatacagtcgtcccctaacaaatcataaataaatgtgaggtagaacattacagtcatcccctcataaacaacttacacagaaaaggctgatcaatgcactctgtaacaacccactttagttctttgttgcataaaaacttttttcatgtgcattgcaccgcatgccttatttcgtgcatgaaaaatcatagctgagcagattaatgtttgtaccatcgctctaaacggttcccactgccctaaccaaccttcagttttgaaacttctccaaaagttatggttaaattcctaaaacttccataccttactaccaaccttgactccaagttacattcagattgaagcaagtctgcccatctaaccatttagtcaaacgctcagccgaaattggagtcctttctctcttcttctcgttttctcttgtttcgttgacctgttggtccccacctccaattcgggcgccacagcacagccaaacacgagctgtttcctcctgcgcagggttgcgcaagccaggctagccctcgtgcgtgactgtgcgtctcggctgggccacgtcccaccagaccgccctggagaccacacgccacgctgcttcagtcgcattgcactcgccctaggcgatattggctgatctgtccttctccaccataatttattgctgccaacagcacctcctcatttactcgagtgtgcacgagagagaggcctcctgcctcaggacctcgcgagattccctctacgagcctctgcaacaccctgccctgtcccatttgtttgccgcatgcttgcccgcacacataccatctcgagaccgagggtgtagagcaagcaccggccccatctctccccttccttccctggcttccgccttaaccgagaccttgtcctcctatctccctatctcccccttgttctcagg

SEQ ID NO: 25451 - DNA, 221 bp, Oryza sativa
ttttactcatgattgaatttgcgagtaaaatttttattgtttggtgacatgaataaatcttagacgttcatatttaaattcaaaggcagttttctagatttcgaatatatatatatatatatatatatatatatatatgtgtgtgtgtgtgtgtatggtttgcactatatattttcccattgacattcgttgtagccgttggtaaaaaaaaaaaaaacagt

SEQ ID NO: 25452 - DNA, 1080 bp, Oryza sativa
  unsure (1)..(1080): unsure at all n locations
ccgtgaacggtggaataatggggcaaattgtgtggtagttcctcacatttctcagattcgcggtgttgtggaaatttggaatttcnccnccccccccccagtgtnnnattgtttgtgtcggattgaccnnccnnnannnaggaaanngaacccccaggaacccggaccggcnccaaccgaccccgcccaggcggacccaactattggcttgcgaggtttccctgaaccgactaggtacttagccagggtgtcccattccaccttgtggttgcactttgattatgctcgatgcgtttcccacaggaatcggtccttatatgcgaatacgggacagtgccacataggcacaacccccgcatcgcgagttttcacaattcattttatttttaaacacaccgacaccacatgtcgggttttcaaggctttacaaacccatttcccaagttttcgataaacaacggtgtatgtgggatatttggtatacgcgctcagagagcacggataccgtggtaccacaaaggtggagcgataaggagtcagggtagtacagcctacaggaattagtgcgactactaggtaggtctgtcggtttggcatgcaaaccgaggccaagcaagttaaacgtgagtgattctaataatgcaagttgcaaacaaaataataatgactttccaattataggagaaattgatcaaagggtgacttgccttgctcaaggtcttcacgaagcttcacgaatctccgagaaaaccacgattgacgaaaatccggtaaccgcaactatacgcaaacaatcgaaaacctacacaagacccaaaagaaagatcctatttagcctaattaatagtgccattaaatagatctcaattttacggaattactggaagtggaacggagtcaatcggatgagcggttgggaatatatggattttcaaagtttattggatttactaatcaaaggaaaaaggatttaataatttattaaaccctttttggaaagaaattggagggatgtgatttagactccctcgggcggcttgggcgtggcccgagaggagaggcgcggctcggccaaactaa

SEQ ID NO: 25453 - DNA, 279 bp, Oryza sativa
  unsure (1)..(279): unsure at all n locations
aggatcgggttgcgggttttaagatgttgttgtttgattcttccacctttctgatatnttatagattttggacataatttnaaanctccccctccccccnccccatgtgttgatggcacntggcttgcnagcnccncnanacnngaggaanagggaacccccacacgcagnagncaaacaaaactacgctaggaatcacctcacatccgcccatgatcgtgggcacggctgttcgaacagtggtggtaacctctgcagagggggtacactttacccaca

SEQ ID NO: 25454 - DNA, 230 bp, Oryza sativa
gcctggcccaaatggcctagaaattggtcagtgcgctcctcgttgattcctcggtctagttgtgtagtgattgggccctttaatattattttaatgggtttagagtcctatctaccataagtctacctctcgatggattttgattgattgttctgttaatttccatcgattgtcctctatttgtgttaatctctacaaacaaataaaatccaagtacaagtggagataga

SEQ ID NO: 25455 - DNA, 214 bp, Oryza sativa
cattgtattaagctaaaagtgtgatattgggatgaataatttaccaataattgtagcagtaagttctaaatgatgagtggactgatgatctgatggctcaatgtgttatacagattcactttggaacagaaaatttccccataggtttagagtttgctataatgattatttgttttgttatagtgattatttgttatttttgaagccatggagc

SEQ ID NO: 25456 - DNA, 1501 bp, Oryza sativa
gcaaacctaaagacgtcatcgccatgttcgcctccgcggacaggctctgatcgacgtcatcctgcggcacgtacggctcaagcgctagtgccgggatgaccaccggcgtctcaggctgcccgcgctgctggacatcctcaatgtcgacatctctacaacgacaacaaggtactcggaatcacatgctaagaaaacaaaggaaaacagctgcatacataaaagaggtccgggccaatagaagtttttatagtgtgttgattaaggggtacaagggaaacagaatcctactcttcaaaaagggggagaacagacctcctgatccagaaccctcttgatgtcgaggtcagggtatgccagcttcacgcatgcgaggacatggcacgccccggtgtagatcccgttacacgtctccacgccgattctggccgcatgcttggaggggatctcctccatcgccacagccaggtccgcgagcgaggacgtcagcgagaactcgtcaggggtcgccgggatagtggtcgtcacgccgcactccccgacgagttggtgtaggccggtgtaagacacccgcagcgagctgcggatctccgacaagttctcgagctctgacatccggtgctcgagcccttgtcgccgccattcattaccagccaccaactccctcatcttcaggaggtcctcgcgggcctccgccagaccacgcgccagctgctcggcgctgtggtttgccgacgaccccgccgccctggcttccttgatctcgcggcccacgcgcgagcaccagcctggaggatgcgctttatctcggcttggagctccccctaggtgagggcatcaacgggcgggccccgagcgggcacaaggccgccgacgggcccactcagcgtcgcctcccagtccctagtcacgaccacgacatctgtcaaggccgccacaggggacatgctggaggccgcaccggacccgtcttgcgtcacctttgcccgcaccgccctgcgaatgatttccacgattttcataaagtcaggcggccaaggttttgcgaattaaaggacctcaaaatcatctacttactttttgctgagcgtcaccagcctttgccgtcgctaaggcgggggagacgcgtccgaggcctaagtatgataagcatggtgtgaggtcaagatcttccgactacgtgttaaaggacaagagaggcttaccgatgggttaggcgccttccagtgggtcccgggcacggaggagaacttcctccccttcttcggaacgttgctgccactcgtcgtggcagcagcagcaacgtcggacgcctctttggcgacgccctctttcaatgacgccgccgcctgatggtccgcaagcggcccgatgacatccgtcagagggagagcctgcatacatgaagtcacgacgcgatcctaggatgacagaaataaaggagtcatcaagtatactcacgttgatcacagcctcgcattcggccacccccttctggcaaagg

SEQ ID NO: 25457 - DNA, 638 bp, Oryza sativa
gagtaataccgttggagacctcgacaccagcgccatctgttcctgccactcacgcttcacgtccctgctcctcctcgcatgtgacccgactcacgcacctactaccttgttctggccttgtttagttctaattttttttcttcaaactttcaacttttccatcatatcaaaacttttctacacacataaacttccaacttttctatcacatcgttccaatttcaaccaaactttcaattttgacgtgaactaaacacaccctctattcttctattgatttccgagccttacagaatgtgcttcatttaaatcctcaaatgtggtcgtaggaacctcgttggtgctatggcagcatagcacacatccgctcatgcttggcgaagctgcctgcaatatggctatgttcggttactggggttaggaaccctctcccacacgaaaaacagagtggtccattagcacatgattaattaagtattaagtaatttttttttcaaaaatagattaatttgaatttttaagcaactttcatatagaaattttttgcaaaaaatgtaccgtttaacagtttgaaaagcgtacgcgcgaaaaacaagagagtgggctgaaatgaacacagcggcacggccatgcgtcca

SEQ ID NO: 25458 - DNA, 1501 bp, Oryza sativa
ttgtatcattttgatggattttttttaaatgtaatttttatcgaagtttttcatttcctcattgtgatttgttcatcaggagagcaatgatgaagcattgcattttgatcatgatggaacccaggtaattttaaccattcctacctatcgttagaacaaaaaatgatatgccgttcctgcgaatgttcatccagtaaatcacaaatgatatgtcgttcatgcgaatgatattgtattcttccccatatttcccaactcacctccctcgtatcgcgcgcgtacgctttttaaactatcaaatggtgcgtttttttttgcaaaaggtttttaagttgctttaaaaataatattaatccatctttaaaacagtttaataaatacttaattaatcgtaagaaaatgcgttgcttcattttgcgtgcgcgggaggtgagtttccaacctcaccacccgaactaatttagcttgatgctaaaaaacttatgttttttttcctttctggtgccaggagagggtgaacctgagaagattgtcccagcggccgaagcactcttaatggcttgtgtcaaactgtcgaatacacgtgtgcctcttgccatatgcgctaatgttgaactgagaggaactgagaggttgtttggttgatggctaagtttaccacaccttactttatggggttgtttggttgatggctaagtttaccatatctcactttgtcacaagtgtgttatgccacaaaaagtgaggctaacaatttgttggccacaagtgtggctaagtttggtaagaatttgagtctataacgtgtaggcccaatgattttgtaaagtgaggcatgatacaagtgtagcaaccaaccaaacactgtactaacaaattgtggcatgcctaaggtttggcatggcaatctttagaagccaaccaaacagcccctcaatccgatagttagggtctaaaatgttttatgaactcatgagtaaccccatgtgatggtacatttcaacccactcacttgggcaaattcccatttgaattgctgtttgtgaggtccttgatgtctaaattttggacatggtaagaagagcatacttcctccgtcaaaaaaaaactcaacctaggaggggatgtgatctagattctagataaagggtagccagatttgttgtcttagaagggatcacatgactcatattctcttaataggttaagttttttttaaggacgaaggaactcttataggttaagtattttttaaaggatgaaggaagtatacgataatatgaccggctccaagaactatcaggatttgaacttttttaaatgcattgtgttggggtaagatttcacatttccatggaaatttggtgattttcatctgcttagcaggggacccctccatccgccgctcggccccaccgtccccgcgcgccacgtcagatcaccgcggaggtgggctccacccgcagcgacccatcgaggtactcctctcttcaactgctac

SEQ ID NO: 25459 - DNA, 966 bp, Oryza sativa
aacacaattgtcctcttcattctcattaaacccaaaccttcttattacttcatcagacattaagtacctctgtctggagtgtctggaggcttgttttaatccatagatggatttcttcatatggcatcccatttattcttttccttccacaacaatacccttgggttgtgccatgtagacgttctcatataaatccccattaaggaatgacgtctttacatccatttgatgtagttctagatcataatatgcccaagtgccattacgatccctaaggaatctttatctgacacgggagaaaaggtctcattatagtcaattccttttctccaagtaaacccttttgccacaagtcgtgctttatatctttctacattccctttagagtcacattttgttttgtagacccatttgcagcctactgttttggctcctttaggaatttcttctaagtcccaaactttgttggtactcattgatcttatttcatcttccatggcttcaagccacttcgatgaatgagcacttctcatggtttcttcaaacgaggtgggatcaccctgtgtttgaacttcttcactagcatagacttggtagtcactaagaatatctgtctttctttctctttgagattttctaagttgtggtacatcttctatttggggctgatgttgctcttcctcttgtgtgacaactagttctgtaggatcctgaatctcaggttcctcttgctcattcgttgttgtcacaggagaactaacatcaggtgttgtcacaacaacattctgtgttgtcggtgttacatcaacaggtatcgagaaaaagggttcttgaatcatcggagtcggtagatgtacccgcttctcctcaagactaatttatcggggtaccatgctccccctgactatctcatcctccagaaacaatgtgtctcatttccacgaacttggtgtgtctatcaggaca

SEQ ID NO: 25460 - DNA, 1501 bp, Oryza sativa
ggtgatctgacgtggcgcgcggggacggtggggccgagcggcggatggaggggtcccctgctaagcagatgaaaatcaccaaatttccatggaaatgtgaaatcttaccccaacacaatgcatttaaaaaagttcaaatcctgatagttcttggagccggtcatattatcgtatacttccttcatcctttaaaaaatacttaacctataagagttccttcgtccttaaaaaaaacttaacctattaagagaatatgagtcatgtgatcccttctaagacaacaaatctggctaccctttatctagaatctagatcacatcccctcctaggttgagtttttttttgacggaggaagtatgctcttcttaccatgtccaaaatttagacatcaaggacctcacaaacagcaattcaaatgggaatttgcccaagtgagtgggttgaaatgtaccatcacatggggttactcatgagttcataaaacattttagaccctaactatcggattgaggggctgtttggttggcttctaaagattgccatgccaaaccttaggcatgccacaatttgttagtacagtgtttggttggttgctacacttgtatcatgcctcactttacaaaatcattgggcctacacgttatagactcaaattcttaccaaacttagccacacttgtggccaacaaattgttagcctcactttttgtggcataacacacttgtgacaaagtgagatatggtaaacttagccatcaaccaaacaaccccataaagtaaggtgtggtaaacttagccatcaaccaaacaacctctcagttcctctcagttcaacattagcgcatatggcaagaggcacacgtgtattcgacagtttgacacaagccattaagagtgcttcggccgctgggacaatcttctcaggttcaccctctcctggcaccagaaaggaaaaaaaacataagttttttagcatcaagctaaattagttcgggtggtgaggttggaaactcacctcccgcgcacgcaaaatgaagcaacgcattttcttacgattaattaagtatttattaaactgttttaaagatggattaatattatttttaaagcaacttaaaaaccttttgcaaaaaaaaacgcaccatttgatagtttaaaaagcgtacgcgcgcgatacgagggaggtgagttgggaaatatggggaagaatacaatatcattcgcatgaacgacatatcatttgtgatttactggatgaacattcgcaggaacggcatatcattttttgttctaacgataggtaggaatggttaaaattacctgggttccatcatgatcaaaatgcaatgcttcatcattgctctcctgatgaacaaatcacaatgaggaaatgaaaaacttcgataaaaattacatttaaaaaaaatccatcaaaatgatacaaacgtagaaagtcgcagcagtgcaacatataatatctacggtattgtatagcctcagtt

SEQ ID NO: 25461 - DNA, 570 bp, Oryza sativa
gatggaaaaacgtgatggctataatatggttccaattttgtgcgtattcggatgatatagatatgaatagacgaatagtaacagtagtaatgacatgtatccaattcaccttttcggaatttcactccaaatctactttcgtcctcgaaacctcaaaattgcatggttgtggatcaatgctctgtactccctctgtcccaaaatataagagattttagatagatgcgactgtctcacgtccacccaaaatctattatattttgggaccgagggagtatactacctacctagtggctatatcttggggtacccgttgcaattagcacgctctctttctctctcctcatcatccctccgggacaaaaagcggcacgcacacctcccctcctctccctttctctctcctcctcccctcaccacgagagcgagcgcggggagctccccacccaccaccaccaccgacggcgactacctccgccgctgccgcgatgtctcgcctcttccgcgagtcccgccgcgactcctcctcctccaacggattctccgccgccgccgccgccacgggctcca

SEQ ID NO: 25462 - DNA, 649 bp, Oryza sativa
tgttttggcttgtaattcttgatctgataatttttcaaattcagcttctaatttattaatgtgtaccacacgtttttttaaacgttttaacgtgcgatcgttacttgaaccgaaaatagaggtaataatttttgaaatcataataaaggatctttaatatttaaataaaattgcgcaatagtgtcctatcaccttaatgcgatgatgaaatattgattaatttagatttaaataaaaggaccgggctcgaataggtggttgataatcgacctcaaagcgatagcatttagttaaaaaatcttaaaaaatgaccgcttgtggcgcaatgttatgaatgatttgttttaattcaacaaaaagtgcttgctgttcgacttcatctacacttaatgcagattgcatagccgcttgattaataatagtattttgctcatgctgactttcacttgctgctgttgtttgaaattcaggtaacgttaaaattgccattactccaaagactaattgcgaccaaaaaggtgttttgtgaaaatgtttaaataaattcattaatatccgcgtttataaggcaaaaagagtgtcaattatactctaaattctagtaaaatgggcaacaaattagcatatattgaatcaatgtttagataac

SEQ ID NO: 25463 - DNA, 938 bp, Oryza sativa
ctaagtacgtttgtattgttttgatagattttccttagttaaattttattaacaatagttttttctatttgatccctagttaaattaactagggatttttttatgttatttagtcgattgaaaatttggattgattttaaatttcagttgaaggatatcaggaaattgacactggattagttttaattactgtaattgatttaattgcaaactgcgatataccgttgcattttgcacttcaaaaaccaattgattattcactaaattaattaagcgataacagccaagatattctgttggtaataaatgctgtagttttttatctatactatttaattcattagcccgtaatacgatacggcttaaacttgagctttctaaaatatcactaatattttttatggtattatttttcatcttttacgggttgttatctaaacattgattcaatatatgctaatttgttgcccattttactagaatttagagtataattgacactctttttgccttataaacgcggatattaatgaatttatttaaacattttcacaaaacacctttttggtcgcaattagtctttggagtaatggcaattttaacgttacctgaatttcaaacaacagcagcaagtgaaagtcagcatgagcaaaatactattattaatcaagcggctatgcaatctgcattaagtgtagatgaagtcgaacagcaagcactttttgttgaattaaaacaaatcattcataacattgcgccacaagcggtcattttttaagattttttaactaaatgctatcgctttgaggtcgattatcaaccacctattcgagcccggtccttttatttaaatctaaattaatcaatatttcatcatcgcattaaggtgataggacactattgcgcaattttatttaaatattaaagatcctttatta

SEQ ID NO: 25464 - DNA, 151 bp, Oryza sativa
  unsure (1)..(151): unsure at all n locations
gttttccgtctctctctttctcttctaatatttggacgtctttgtcttcgcctccttatctaaggtgtgtttccacttattccatgcctctctcatcactccccccccccctgttnttttagactgtgcttagagacccacnnnnnnnnnn

SEQ ID NO: 25465 - DNA, 1501 bp, Oryza sativa
atatctgaaagtttagacagaaactaaactgtcgtataagctaagagtcaatatggtaaaaatcttgtaattttgtatgaaattgtagaagttggtcacatacgtcctgctcgactgtctttcaataccgatgctacggtgcatcatctgagcttgtgctgctctgtgtactgcaaaactaatacggaattaacatgaggtagttagttgattcccaaatgaacctacatgttggagagagagagagagagagagagagagctatataattggaaaggtaggctctagcaatttgaaccatctgagattgagaaagtcattactgtcagaaatacttcaatagctgtctacaatgtttaactaggttaaataatctaggcaaactgtaggtaagtggttttttcatgtatgctttcattactatgcaaaataagaatcatgagtgtcatgatagtacctgtagctatatgacacgcatcaatgcagttctgcttatgattggcaatgatgaatatcgatttctgatattgtcatgcatgaataagcaatcaagaaatacagtactaaaattaggggactcataaggttaggaaaatgtatccaaacgggataccgttctgtatcatccccctaaggttactccatgcttaagaaaatatgcatgtagcactactgttttccttcaggcctgtaagctttctttgaaataaaaaatgatttgttggtgctatttgtttgtttaaatgtaagttttcttatgactcatttttcaggacgacaatgttatattttctcttctacaattggatgttaattacctagaaacatttctaaaaatatcgagaactaaaatgaaaatatgtaagcagttatttcttcgcaccaagatctattgcatttttttggtcgatccaagacaaataaaaaatggggctgtctatatagaaatcgaatgatttctgaagctccaatcatgcagattttatctaccataggatgcacatccaacaactcagaaaaagtgatacaaatagatattacacttaaaaacagatatattatttgattatttgaacgccatttttttaaagcccaaatctagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacacaaggaaataaagcccaaattataatccaacagcctatccaaaaaagtagtaggggccaaacttggaagccaagtagatgaaaaacatgtcacatgaatcaaccatgtatgggaccacacttttcaatcccctacttttcaacagcactattagttcacaaacagatctagcacgaatcaaaca

SEQ ID NO: 25466 - DNA, 377 bp, Oryza sativa
  unsure (1)..(377): unsure at all n locations
aaaagcgcctctctctctccccagatctctctctttggttttctctcgctctctatcgcccgcgctccgcgccgccactttgtcgttcaaacccgccaccgctttcgctctttcccgcgcgcgcgcgcgcgtgnccgaccggccggtcgctgccgccgtccgccttgccgcgcttgcgccgcgcagccacccagccccgctcgccttttgccgacgtcgccactgtcatcgcctggttccgatgcccccatgccgcatccttccaaaaccaggagacagagctcgtgctcctctctctcgttctcatatcctccttcctcccaaaatagcaagggagcaaagctcgtttctctcctcttttcacctttttccttagc

SEQ ID NO: 25467 - DNA, 392 bp, Oryza sativa
ggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaggtgcaagccaagttttggtcaagatagggtaggtccccacccaaaagaaaagtaggtagaagtggtgcatgtggtatccccttgagatataaaaggaggaccttgcccaccaaaaaggggggaaaaaaagaaaaaagga

SEQ ID NO: 25468 - DNA, 303 bp, Oryza sativa
ccttaaatcataatatctgactgtcaatacctgcatataatggaataaaatatgatattcaacttagtggtagggtttattactaatcatttctactagtgttggtatatatttggatgcaggtgactaccaaagttgaaaggaaatatacatgaagaaggaggagaatcaaactcatatccaaacttatggagttttggacccaaaaacccaattaaacaccttcaaatgggcctaaccaccatgccaatggactgagagcctcaaaatcaatgtccatgagttcggccgaaccctgacaga

SEQ ID NO: 25469 - DNA, 578 bp, Oryza sativa
  unsure (1)..(578): unsure at all n locations
ttgcgacattttccagtttatctggtgtaagtcggcgttacnagtttcgtttgacatattttattttttgttccgtagaaaancatttccctcccncccccccagtgtgatgtcagcgcntgacancnacgcnccnnnagacgcgaggaaancggnaccccaaactcangnaagaaccnacacaggtattcttattctatttcagaacaattttttcattacagttaatttgtataaaaattacataaaaaactgtaattccaatactaaaaatttcaaactggaatacaaatttactctaatttttaatgttgaatcaatcaatctattgcaggcataacaggtaatgaggtaggaataagcaatgctctggatgaaccaaacacaggtaacaattcaaaatggaattgaacaaatgcataattccttcagtaaaaaaacacaaaatgcaaaaattacagtcaatttgaaacagaataagaataattttaaacttcaacttgattgttatacagtttgactggaacctatatataatttgatcacaattactttaattgcaaatataacagatcata

SEQ ID NO: 25470 - DNA, 642 bp, Oryza sativa
tgaatttagctacaggagttgggtctgaagtggagttgtgtagcagcctaaacccagctccattcatctagtttattttgtgagagaactctacccaactccgcttctatttttggtggagttgaaactatttgacatggagctagaactgtgctaaactagccctcaacacgaaaatcaccatttaattagtggaataagttcatatgaggtcccttaactgtcaacaaatccgacatgtcattctcacccctcttcttcctcctctctccccaactcccatgtattcatctctctcccatctcctttgtcctctctccaagcgtgagtgaggaggggtggtgcacagcgactgccatctaaaatgagaccaccggttttaacagttgagggacccgttgtatctggttttccggttaaaggacgaaaatcggattcgttgataagttaagagacctcagataaacttattccttaattagtcacatagctccgctggcccataaaggaaaaggcccaaggctcattcaaagctcctacccaacccaagtcacctcgcctttcccctctcaaaaaagggaaaaaggtcgcctcgcctcacctccttccacggctccaccgccgctgccgcgacggcgacca

SEQ ID NO: 25471 - DNA, 493 bp, Oryza sativa
ttcaaaattgtatatccaccagtacctcgccaaaataatctgtaagttgtttttcttacctgtaactttaagtccaataatatttttaattggtttttttttgttagagttgtacagatgcccaattgttctcttgttgacaggaatcttgtatgttttgttggtcattcagaaattcttgactgttctgtttttctaattgttgcataacctgtttgttttgttgttaatgcacaattttagtttgtttgttatgattatcattcaaaaaatttagttcctgtttgtcaattgtttcattcagaattactagatgggataagagcctgtttcttagtacaacatggactagaactgcaatagatttcattagtaaatttacagagtaaatagtatgaccataactgcattagctttttttaattttttttgtttgttttattttttatgataagtaactgtggttacttatgtcctttttctttttcctagt

SEQ ID NO: 25472 - DNA, 711 bp, Oryza sativa
ttgcagttgcctgataatgctttttcgtcaaattgcaagtacatccaacctaatgtgtgattcctctaattaaaagaacttccaacttatatgtgatcggaatgttgaattacaatgtacaccctgttataaaacgttttgactaagtttatagataaatatagtaatatttatattattaaattagttttatcaaatcaataattacatatatttttataacaatacttttttctacaaacttgtttaaacttaagcggtttgactttgtaacggagagagtagtcatgttttttcccatcgtcaagttcctctgaaaaggaatttcccaacttatatgtaatcgaaatattgaattgcaaaatgatcatggttttcccatctagaaatctgagaaatacgcaaggaaaatctggtggaaaataagtgtaaagcttagttctgggctggtcttgtcctcaaacctctaagatccgaagcccactcaatattttctagaaacgttaccacgtgtcggctcagaaaggccgggaaccttctagaatccgctggatgcttctcgccctatccctaacctatccccgttcccaaatcccccattctagacgcgctttccattctctggaagcaaattgcgctctctggatcttcttctccgtctcctccccggtctcgtgtgagcgctactcccggcccacaggttcttcatgg

SEQ ID NO: 25473 - DNA, 246 bp, Oryza sativa
tttcatccaggtccatgaacttacaaacacggggtcaaggtcactaatcttgttttattgtatcaatccggtctagagaacgctttgacccgtttcgtgcatacgtggacagcaacgtgttgcgacacgtgtgatgccacaccgcaccgccccgcaccgtgcactttttaaatctaagcccctcagttccctcgaattctccaaaccttagccctctcttctctactctcttctcccctggacagc

SEQ ID NO: 25474 - DNA, 1501 bp, Oryza sativa
ttaattacacgagcaaatcggagtgatgcatcagcgacgctcccgtttgcagtaggcctaggggatctatagactagggacctagagctgggagatttattgctcatgcaggcactgcacagttcacctattgggggacaaccaaaacgaagaaaaagaaagaaagagaggtggtagaaaattatactactagtagtactccactaacatgaaagagagaaaaaaatataggaaaaatgagaaaaaaaaagggcagctgggcaggcacgcatgagcagcagcactggaccagtggcagaatcgtctggagtgagagggactgtggaataattaatcagaagtgacaagcaaaattttgcagcatcaagaactaaaaagatgcaattttgatgcagcaattaggcaaaaggaggtggtaattgtgcaggcagtacataattgttcttcttctttactacttgttctttattccccactaccagtactagtattttttctggtataatttttttagcagaagtgaattaccagaattaaaattctaattatcttgccgcttccaaatctggcgatggtgatggtgacgaggaccccccccccccaaggccgtctctccacgacgtcctaataaatcgctcccatctccatttttttcttccagctttctctttgatttctagccaactcgacgaatccaatcccttctttaataatagagctgctccccgttcgcgcgatgatgctgccgcggctgttcttgcgcgccgcgaccaccagccaagaacacgcgcggggctcccggcggcagcatccctgagggggcgaaaaccgaagccttttcttggattccagagcgagcgtgcgcgcgcgcgaattccatctcgcccaggtgagtttccccttgccgaggaaaaaaagatatctccttcttctttattgtttatccgcaacgttgccaaatccttccgagatatgatctggtgaattcagcgcttcctcttctcgggccaaaatttttattcctaatttttttttttcgttttggcaacgtttcttggctctgctgttgtctccccgctttaataatgggcgcgcggttggtcggatcgccatggccagatgcattgctcggggcgattgggccatgcgaggtgcgggatttgagagattcgggggggaattgaatagttggggatttggtgctaatttcctcttgtttaatcaatcgatcaatcaatccctgctagtttagtttccctctcccgtgctccccccgcgtccgcgctttctttctcgtcgtcacccagttgccgctgatgcaattcatcgccctcctcttgttagcttactgttatatatataagcaaacgactccccggacatggctctgagatgtgtttccctcttgccgcttctctcttcttcttcttcttgcagcggccgtgctcgccacaacgatccatggaggggtgccaattggtagcgaggtgtagtagtagta

SEQ ID NO: 25475 - DNA, 1501 bp, Oryza sativa
cccatcgaggagctatgctacagtgctaagaactcttcaagttactaactactccatctttcccaaaaagaatataattctagcgaaaaaccttgtagttactcctgtgaaactatttgggtacaatgactagcaattttcctcagaaaccaacgaaagattggatgaactaagtttggatccctcaaatcctcaattatcatgcttaaggtagcaagcgtgcttagccagcccatcgtggctaaactagccctagtagacgctaccatcaacatttggttgccttagagcaagtttaatagtatagcccactactctccaaatcatttatagctaatgtaatagccaattcatataataattgattactatattattaatactggttccacctatcatacacacattatgttttggagtccatgctgcagctggctacagatctgtaacccgctgctcttatctatcttcctttacctctttaaaatatatttatagctggcttatagcatgctattgtacctgctcttagggcacgtactatggacatccaagcacaagccccaagatgccacataagactaaggccatgtttggttccatgggctaattattagcccccaccttttagccctgaattagccctcaatgatccaaacaggtgggctaatttgaggctaaagtgaattagcccccctcaaaacattagcctctccaaggggtgctaatggggctaattttgtgtggggaagctctctctctctctcctctctttctactctctctccaccttttagccttgaattagcccatagatccaaacataccaccctaggctaatgtttagcctaccaattcatgactaaacattagctctcaaaattagccttgggctaatattccaaacagggcccaaatagtaaggtggagaagagaagaaggatgagaaagaaatagtcacctctcatgcaaggggcagcccctacacaagcttcaataaacatgtgatagtgttagagatattagggattatatggtagagatgactatcatatctaatttcatacatatctaaattttatacatgatatacataaaacttgcccttagcgcaacccgaactaacgaggccacctgcacgcgcatgcatggttgcgctgaacgcctgcccgcttgccctcgaagacgagcctgatttggctctccggctctccgcgctggccgccgggcgagtttccgtgccggttaccggttagaggcaaaagctttgcctagctgccagcagaagcgagtttcctcacagaaaggcaaggaaagtcggcccaaccgatactacaagtgtaggcccatctaaaaagcccatccgaattctgtaaacagaaacacaggatagcgtgccatcatcttctaaaacaacttttcccgaacttatgtaacaaatcgaatcctgtctatatatcttatataattggaactaaaagcttaacatgcatagaattac

SEQ ID NO: 25476 - DNA, 433 bp, Oryza sativa
actatagggcgaattcgagctcggtaccctgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttttatccttcttagctctgtaccaactaactcttgtcatatccttgtgctgttttggggagcttatagtatttacgtaatgatattgtcca

SEQ ID NO: 25477 - DNA, 185 bp, Oryza sativa
gactatttctctctcatccttcttctctcctccacctcactatttagtcctatgtggcatcttagggcttgtgcttggatgctcgtagtacttgccctaaggagtaaagcactaattgcagtgccaatggtttgtcgtttcattaaaagaaattagtgtacactctcgttagatttggctgaaga

SEQ ID NO: 25478 - DNA, 1131 bp, Oryza sativa
tttcctatggtggaaggctagatctgtgaaagattagtgtaggattttgtttttggagatgatgatttgtatcagaagctgtttctgaggacgggccaatggctctcccagtgctgcaaagaactgatttgccgttctgatccaaaaccacttcgtagattgctgtttgcaagtagaacctattttagatctgaggggggagtggtaccagtttgttgacctataaagtaattggattttggattttgtttttgctttgttcatgttcttttggagatgatgatttatatcagaggctgtttctgaggatgagccttgagctcacccagtgctgcaaaagaactgatttgccgttctgatccaattctctttctttatttgcattttctcccttaaaagatctgcctagttttttttggtcaaattaagatggcgttgctatctgatgctttcgaatatgtgctcgagaattgagagcatctactgaaaggcttagctcctattttagggatatgacgaaaaacttattccagaggttgtttctgagggtagatctcttctgcctgtgattaaaccttgcacgtcagtccgatcccattctcagtagatctgagaggacaacctggtctgatttgttcctccgcagttctttggagatctagtgatatttcactgctttctgaggaagattcctattccctatttctgaaagtattgcgggtcagaacttatcacggaagacaaaataagcttagcatggacattgaatccatattccatctagtcttttgctgtttatgtacctgtgtaaccttgctgaatctaggtctgtttcccaaggtattgtcatacaagtaggccctgattgctcatcttccactgaccttattgaatctatcatgtttgggaaatgatgaacaattcatctcagatatcctttatggatttattttcagaatgatgaaaatttgcacgtcagtctgatcccaaagttgtttctattctcatgtttagtcaaattagagtttgccttgaaggcaatttaagcttaaagattcaccatgcatcttaatatccgaatatcgttcacctcaatcagtcatgacacgcttttgatgaaatttctgcagg

SEQ ID NO: 25479 - DNA, 1501 bp, Oryza sativa
catctaatagcaataaaaatactaatcataaaaaaatttcaaataagacgaacggttaaacgttgaacgtgaatagtgtaaaactacacttattttaggacggagggaataatttgttactcttacgtcgcttgttaggactaccgatcggtagatcaaaaacgggactggatgcggaagtggagatggtgaagatgtgaggtcaggacggtgacagttgaagacgcggtccgatccggtgttgaaatttggagcattctgtcgggcgatgactcgttggcttctagcgaccaaccgaatggtggagtgctgagattaattaaaacaaggaatatgttcttctctagattgcgaatccacggtgacttgaatggtaaacaaacaaaatacgcaccattagccactctcgtggacatttgattcgtcatatacttttacaattgacagttccattaatgaagtctgaatatagtgcgcacaatttctcctgtaaattcagaacgtttgcatcttactttttccaaggaaaaaaagaggaatatttctcctgcatcctctccatgtttggaacaactcctttttttttttaaaaaaaactctagttatattcatgaagtctgaatatagtgcgcacaattttcacttatcttctgtaaattcagaacgtttgcatcttactttttccaaggaaaaaaaaggagaggaatgtttgtcctgcatcttctccatgtttgagacagttccttcgaaaaaaactcccacatgctactcaagtacttaatttgaaaggaaaatactctaatagtgaatatgtttacagaaatggttggtgctgctttgatcttttctacccgttttcatcagatcatcagacttctcctaactaccgctaaaactgctgattgctgaaaagttggtttcagaaatgaggtcgctcaaagctatatagttgattgagccatcaccattttgtccttgttaaccagcttcggtgcccctctaccgctctggtcataagcccatcatcatactttcactaattaatcccctcacctttgcaaccgcacgcacgcatgtgagttcattcttgagcctgttcaataacttcaactactcgttcagattcagattaggctgattggtgcaactagacaccgagtcatgacctctactttctactgctactttccagtttccactaggaacattccgcatgtctaaaagcatagtttctctcttttgttttcgcagaggatgcaatccgacttatcgcgcaaatccacccaggcacggcaaataaggtctttttccaaacattctcctttcccaatgatcggacgtcattgtgccttgctgctgcttccctgttgttttgtgcggtaaacgcagcttcctgaactcaactgaaagctcctaatctcctatacgaaacagtggcgcttatgtatcttcagatcgaccaacttgcccttcggcgctcgaccatcacgtcggaccaaac

SEQ ID NO: 25480 - DNA, 1501 bp, Oryza sativa
tctgatatgtttatagcgatctcttcggtctctttttttttatctttatgctgcactaatttggtcggaataatttttttctcagcttcaacgagtgttcaatgataattggttatctctaagaacgtacttcatgatgatgacgtggatgtgtgttgcaaacaatatatttctatttttttcacttaataagaaaaactaatttgatagtgattctttttctacttaagccaaatcgtcattagatggataagtaaggtctcatcttgtattttgcatcgggccaagatagatagggatggctgctaaattgaggtaagtttgccctttttcaattgtttatatacatccagttctacatacaaatgtacactagtaattaagttagcaaaaatctgttattctacccgtgatgttaaaaacccgttattctatatttctacccatgatgtaattctgactgcgctctctttccacaagtttttttctgaccctgcccctgttgctgctcccaccgttcatttccaaggacaatgtccaacggatcccactccgattgaaatctctgagtctcatatgggcccatatatcccatctcccggttactgttcaagtttaacacgacgatggtagtacaaccaccttcggtgtgggcatatgcactgcaatcagagaagaattacacgagccacaactgtacactgaaaacaaagaggctggtgccctgtcgcacaacaagaaaaggcacagccgctgaggtgggggagaagtagaagaagaagaaagaaagaaaaaaaatggaaaacggaaaaaaggtgacaccgcacagtgacgcccccatggaattataaaaagatggccgcggttggccgcacgtgccgcgccgtcctacgcacgcgcgacgcgagagcccccacaaaccgccattcccagggcttccaccggtggctttcctcctcttttcttcggaatccctgaccgaacgagcatccatccatccattcactcggtcgcatacccctgataataatactcgcgtgtgccctgtgcttgagcaagaagaacatcatcatcatcagcggccgagcttaatttgacagaaatatagtatatagcgcttcaaagttttggagtagtagctcatctcgtctctgccgagtttctggtagagctggaggagcggaggagtagtagcgaaatatatataataaaagaatccactagcagcttggctatttcagcaaaacgtatgtgggtagagagagagagagagaggagggtgcagagatagggaggaggcataattccactcactgccccaaccacaggacattctcttctctctctcccttctgctcaagaaatccaccagctgctgcatcaggaggtggagctcgctcgtcgtcttcgtcttcgttgcgcttcgtctcctcaggtgcccggaggagcaagaattgttgggggggcagcgaggtagacgcagttggagagccctcttgca

SEQ ID NO: 25481 - DNA, 314 bp, Oryza sativa
tttcttcgttgcgtctgctgactcttgtagcttgcagcagcagtagcatgcgaccccgtgtggtgtgaaaaagctggcgcgctgcaccatcgtcgcccatcctctcggcgtcggtccacgtgccacaccacaagggcggcctattcgactttcctccaccatggcttgggcggagtaggtacccagccggcgccccttctctgactaccctcgccgccaccgctgccgccgcctgtcttcctctgacaggatatagagaggaggaagaaaaatcaatggaggaggaggaagaaaaaatgaggtagcgcatccga

SEQ ID NO: 25482 - DNA, 723 bp, Oryza sativa
agcgacttccttgccgtacttgcgctgaagcctggaatggatctgaccgggactgacataccaactgcaggagttagcacgccggctccggctagggacgagagccaagaagctcttatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggtgcgctcgtccaaccctgctataaatgcggttaggtgagccccgctgtgctcacctaacccacacgcgtggcgccaaaaccacagggggtcggggcgccccagccttcggggccgaaacgggggcgccccagccctcggggccgaaacgggagcgatccgacccctcggggagacagagggaggggtggccacgtcatccttgggcccgaccccccccgagggggtcaggccacgtgggtgaccgcggctacccaagcctctagtcacgatacccccggccccatgtcaccgacagtagcccccggcgttacgccagggcgatcgcccccctcgagggaagcgctcgagcgtgacgccactccttaggcccggtgacaggtggggccggtccctacaggcgggcagaaacccagcggtcgcaaatcgcgcgcatcggcaagggaaaaccgaccgacaataa

SEQ ID NO: 25483 - DNA, 1501 bp, Oryza sativa
tcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcaccgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggtaaggggaagagtggcgagaggaaagaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagattgtgcgcgcattaactacgatcgccaaccgtgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgctcgagcgcttccctcgaggggggcgatcgccctggcgtaacgccgggggctactgtcggtgacatggggccgggggtatcgtgactagaggcttgggtagccgcggtcacccacgtggcctgaccccctcggggggggtcgggcccaaggatgacgtggccacccctccctctgtctccccgaggggtcggatcgctcccgtttcggccccgagggctggggcgcccccgtttcggccccgaaggctggggcgccccgaccccctgtggttttggcgccacgcgtgtgggttaggtgagcacagcggggctcacctaaccgcatttatagcagggttggacgagcgcaccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 25484 - DNA, 427 bp, Oryza sativa
tttgcttatcaccaagcacgtgctaaaaagcgtgtagtggctgaacaaccatttgaaatgccagtaagcaaaaacgcatttgccacagaagcggatattgaagctgaatttgagtttgttgcagatgaagcgacccaaaatttagcggcattattaaatgcgacagatgaagaataagcgatagcgtttatttgaaaaagaaaaaagctaggtaatttacctagctttttttatgtctgaatgtaagcctaaatatctctttaatattaatttatttcatttgaaatatagatcgcattaaaaatttttcgcaaattttcctgatttagtgggcaatatctcttacattgctgtaacgaaaggggtacactaatcgtctaatataatatgcaaacgattatctattaatataaaaaggtagtgatta

SEQ ID NO: 25485 - DNA, 198 bp, Oryza sativa
tatatttgattatagattaactaaagataaatcaagcggtgcaatataaattgaggcataaaaacaatcgcattttcgtcacaatgttcttatttttacgttcgcattatccgattactctgtggtctttaatcggtaaaagctgtggcatctttttgacacaaacggcactccttttttcacctgggagctcaggta

SEQ ID NO: 25486 - DNA, 1501 bp, Oryza sativa
tatctatgggttggttggtttcaatataaatttttcaataatctctttggcgttccaatttttcctacataacaggcatgattcatgcaatacactgactgaaaaaatagtatggcttcaaaagccattaaaaggaagccttacactgctgatattgatagaagcgaaaaacagatggagacgatcataccagattctgtaagagaacctcttctaggaaacagaactcatgaaagcaaatccgaggttagtgaaatttctccaaatcatatgaatccaggttattaaccgcattttagttcttcatgcgccttaccccttttctcgtactttttttttatagagacatgagcctaatatgcagccaaatttatgggatggaaaaggacaagagcgccttggttggatgcatgttatatcgacttttattgctcaatctgtaagaaagataggtaactatcatgaatatgattccagagaagtggattttttagtgtcttactgccctcttgaatgtacacagcagaatgcttaaacttgaccttttagaacatttactatctgaaaaatcttcttttttttccaggaaatgcgctctctcagtttggaccattgctagcaaagttctttagtaggtcttgtgcttcccatggttcacatgatgaacaggcagttctacttgatctcagtccactacaggtataatcagtgctggcacatgcagatctcctatttccatttaaaataccatatgattgatgggttaagtttcccatcaaaagcatgaattcttatgagtatcagatgtgacatgttaatttcatgtaaatattttgagatatttcaaaccttttactgaagtatgaaggaaaatatattttcttcctcagtagtttaagcatttgaatgagttgtttcgagcatactctcgacatctttgatgctcaattcatctttcatttattttttatcgttttttacaataataaaagttcttgtttgcttttgtgattattcatggacaaaaatgttggtatatccatgaacaatatcatggtaacatccatgaaacttgttatttcttccacaacactcatttagtagttgaattgcatgctttaaaaattcaaatgaattcttgacttggtttattaattccaacccttctgttctacaggagcatcgatggcatctttatgttattcttgactgtttcaagtttttacatttaggaacttttttacatgatactatggttttgacagttccatgtttactttataggaagagagactgaggttcttgagacagagattaaatgtgccatttgacagttcctctgtcaagcatcaggttccgcttctgtacctaactacctataggcctttggtattcttgttctattgttctcaccaatgggacaccaattttcttgctcagaagaaatgataaactgaacaattcatatactaacattcatgatagtaaaatatttcatttt

SEQ ID NO: 25487 - DNA, 1501 bp, Oryza sativa
tttgtaagagttcatttttaaaattcaaaaaaaataaaaaggttcgaaaaaaagttcatcgatggccgacacgagacggcgactcgatgtcgatggtgtctccatgcaatgatgtaatgtttcccttcccgtgatctcctttttccgggatgcattcgttggcatcgttggatgatgaatcattttttgtagcaaccactttaattaatttggcagtgagccagtgaccgtgacgcagatacatgaggatgcactgatgcagcacagcagcgaggccggacaaacataccatttatcgatgacgttgataccggtaggccacatcgctgctagtagtactacttatattactccattcatccaagaaaaaaaaagttaaattctaattggacttaaaactgatgaagataaaagttacgttgatgtatataaaacgaaaaagttattactcactccgtattttaatgtatgacgtcgttaactttttgacaaatatttgatctttcgtcttattaaaaaattatataattatgatttattttattgtgatttaatttatcatcaaatgttctttaagcatgatataagtatttttatatttgcataaaattttaaataagacgaatggtcaaacgttgattaaaaagtcaacgacgtcatacattaaaatacggagagagtagtatatagttaattaagttttaattttaattattatagacttgatcgctcctcctcctccgtacgcccggccgtgcttcatgatggtggtggaggtacgtggtggagattacctacagtatccgtcggaaacagaatacgtatgacttttaaaagagaaagtacacgtgattgccctcctcgccacatgctgacatgcattatgtttacacacaacccctgcctgaatcgatgatagtattcccacacaagataaagataaaagatgatgatgatcaagtgtaaaataagttgatattaatatataattaattgagttttaattattaaaaaaataattaatttgatattttagagtaacttttatatataaaattttcgcaaaaaagcgtgtcacgagtatccaaaattttatctaattttttattggagaaaaagaacgggacttgaataattgtttattaatttcttcccacactgccctccctacctacccaccatctgcagcaaccacagggccaatcatgtacttcctcgctcgatcgtctctggccccgccattaaacggtagatggggagacctgagcatcatcgatggatgctttcttttccctccctgcagccttcttcaattcagacagctactaatatctgcaactcaaagtattcgtactcctgttaactccatcgatctccattgttgtgcactggagagctagctagctagcagagtagcaatggagaggacgacggaggatgatgagaggctgacggatcctctcctggagcctaagccggcgatcaacggcggcggcggagg

SEQ ID NO: 25488 - DNA, 1501 bp, Oryza sativa
gagaaaagaacgtgaccaacctaaatagacggcacgtgaccaacctaccaaaggatataagtatggttagctgcaggcgtgctagactggtgttactgctagtgtggctcgacgagaagagttgaatgaccgagacgggagcttatttggcagacagtgaccgaccacgacgctctgctgtgttcgaaccacacggttcggaacactttgtccctataaaaaaaacagagtaacccttatcacaagtgatgattaaaatgactttaaaaagtaaattaatataattttttaaacaatgtctttattaaaaaaaattaaaatacacaccgttttgccaggtttaaaaaacctttgtataaaatacaatctctgtcacaagataaaccaccctcatccaatacaagttggtttatttttctgttataaaataaaccattctcgtttggtacgtgttggcttattttgtgaagaaaggaataaatgtttaatttcggcggacattgaccgaccacgacgcatgcatcacgcatgcagtggccgattgcaggccggacaaacgtccattatattttattgacgaattaagctgacggcggcgggccagctactattccggccgcctacgtccgccgtgcgtggcctcctgtgcttcacgatgcagcctgctggtggtgccctgtaggtacgggtacctagcatctctatgtggcctcttccgacgccccgcattcgcaaataagggcctgtttgttacagctacaactcctaaatataaatataactctaggagttgagtctggagtggatttatggagttgcctaaacctatctccacaactctaatatattttgtgagagagctccacccaactccactctcaattttagtggagctgaaactgtttggctgagctccagctccagaagagatggagttggagctggagctgtaccaaacaggccctaagccgtcgtaccgcgtacgcgtacgtataacctcgcgtctttacagtctacaactacaggcagcaaagctatatacagtacacgttcttgccctcattgccacatagtacaatgtacacaaaaccccagatcgaatctcacccttccttcttactccacttactattgctaattaattctcaacatgtatatggatgatcctgaatattctcaactggatatatacattgatctgatcaactagactagagtcactattaattaataatcatcgattaattaagtcctgttaattcccgattctgccctccgccataccaagttaccaacccacggcttctcctgtacttccattcgactccctttatatatatcatcagtagctccatacttgagcatccttgatgcttccctttcctccagcagcgccattgctactgaatctgaagcaccaccactccatctccattgctgcaaactacaagccgccactaattaattagcaaaatggagaagccgggtgatgatgagaagc

SEQ ID NO: 25489 - DNA, 1306 bp, Oryza sativa
accctaagggatcaaactaattttcagtggcatataaaggattctctctatcaagaagggagtataacgaattctgatcagcagatcagaggtctatcaatactactactccatcccagaaaaaacgaattcctagctatgaatctaaacacatatgtgtctaggttcgtaggtaggattggtctttttttttttaagacggaggggatacttttttttgtttttttctcgaaggtcatgctcagacaagaaagggcacgtttggatcctaggtaagggccaccctagccttgcctggcagggctatccgtttggaacttgctccctccgtccttaaaaaaaaaagacaaaccctgattttcgtgcccaacgtttgaccgtccgtcttatttgaaaaaattatgaaaaaaattaaaaagacaagtcacgcataaaatattaatcatattttatcatctaataacaatgaaaatacgaattataaaaaaatttcatataagacggacagtcaaagttggacacggaaacccagggtttgccttttttttttttgagacggagagagtagtaaaacagcctggcttttaggggcgagttagctctgcagggcgagaaaaaccttgctggctagggagagccgatttggctcgctttcgatggaaaatttcactcgcgcgaaaatattgtctgcgggcgacgcggacttctccggaatcgctgatattctctccccaatcaggagacgaactcattggcagcagctcggtctggaggcgatctcatcaacgtagactcctatatttgatttctcctttaggtgtgtttagttcacgccaaagttgaaagtttagttgaaattagaacgatgtgatggaaaagttaaaagtttatgtgtgtagaaaaattttgatgcgatgcaaaagttagaagtttaaagaaaaaatttagaactaaactcggcctttatcgtcagcttctaaccccttctttctcagatacatggtgtgctgtcttgttcaatcgctctgtcaggaagtaggtagagttagaaaagaggatccccgatatcgtttgctttgtgctagatgcagcctttgcgttgccaagatcatttattatgatggtacttgattaaggaattctcttgatttctcatttgtgaatcctaaaatatggttgcacatagctttgaggtacttatagactactagcaaaagaatggctatggaaaaaaaaaccattgcaagattattaacatgaccagtgccttataatttttagacaaaaaaaggaagcaaaataatca

SEQ ID NO: 25490 - DNA, 501 bp, Oryza sativa
ataaaaaataattcccacctaaaagagtaatttatctagggactacaactcctacctttttcatgtcatccaaattgccatacaaaattgtgaaataattaaacaactatgttgcatcattatatattatttggttagcatgcatagctaaattggatctataacatgtaagtgaaaaagaacaaatttaacaatgaataacataccaattatgagaaaatagattgtacctttagtcggatgtaacaatatccaattacctatgtcttttggaaatgtgctcaactgacgaaacaaattaaatcggctgatttttaacgtaagcgctataaaatatattatacattgccattaatttaaggactcagagagttttttaacacaagttttagtacattttggatggaaacagatgaatgttgatatatatggcttccatacctttcatatataaatataaatttgtctattttatacatgtagacagttaaaaatatgaat

SEQ ID NO: 25491 - DNA, 1501 bp, Oryza sativa
aaaaaaactgacggataacagtccattgttcgcaaactaaagtgtgtttttttgctccttaccaaaaaaattttcaacttgttttttcacgttttgatgctcgttatatgtggagtagttggtagtggaaattttatccaagaaaactataccattgatttgaagtaacgtgtgtccgctcgaaaaattctaattacaatttatcattaataagaaatactttatcactagaaaaaatattgtccgaatgtttcgcccttcgagggaataacttacaccatggtgcatattgtattttttgatagaataacgtaaaacacattacgttatactatattttctactaagtggtataaaacgtaggagtatattacagtaatatattgggacacattttagtcctgttatagagagagatttcactgatcgacatccaagtacttttagaaattgccacaaaattcgcaaggattttagatttggccatcggaacaatgaattactccgttccgtaccgcatttgttgtttgccgatacatctacccccaccattgacaagtccatccgcaaggcttgttgttgcggatgtagctcaatgccacaaaccacaacgttggtggatgagtaaagagaaccggtataacccagcacataggaatgaccaaccaccttctcacactcgctactggcaccagcaaggactgcctttttgtcttcatgagtgaccttcttgactatgcacacttttcagtattgtctcgagatttgctccgacgtcatctactttgtcgcaggacgttgccacgagaagttgttccagtatccctgatgcgggactaacccatcatcttacatcttgacgacgaggggcgatgatctccatatcttccttgatggtgttgccctcctcgtccctgtttcatggctgctctagtgtgatgggcaagtaaagtgctaccgcaacggtgagtttctccaacggcctgctccatgataggagccgtgatgatgagctcctccaacagcctgctcctcgctaggagcatctgaaggaggttgttaagcacatggctttggtgtggcggttatgatgatagtttggtggatgaatttactagtgtggggtagactaataatagaatgatgggagtgataactaatagaaaatcatagtttctatagtaaaatccaagagccttacaaattaaatgggcatttctttaaggactgtgaattggatattttgatagtactaagtagtgaaatttccggggtggccactccgtacggccgacgccgctcgagtctcgacggcagccgtccgtgctcatcgtgggcttcaggcccaacagatgatgccccttgctcctcaaggcggcccacgcccgaaaaaaaaaaaaaaaaccctcccctccgctggcggggcagctttcccctcttttccctccaccgcggcgcggttttttcccctctcccgcgcatccgccccgcgccatggccg

SEQ ID NO: 25492 - DNA, 1501 bp, Oryza sativa
agttttgactccggttttgttctatgtggcagctgattcagtgtggaacccacgtgggtcttacatgtcagcctcttcttccactccacctctcttcctctctccttttcttttctctcaggtctcagtagtgtagccagcgggtgggggaggcgggagtctagtggcggcagcggcgacgggagacgaggtggcattgaggcgacgacgacgcggcgtcgatgacgagcaggagggcttccctccacgccaccgcctctgccgccgccgacgggtgcgggaccagcacacggtggcgagggaccggcacaccgcggctacaagcacgactggcacactgtcacatcctgattttcgtttcaggatttataaattatttaataaattattaatagaatttatattaaatgatctttaattttcaagtgaagtaaaatgtgggaaataaaatttcttaaatctaaagcatggatggatttaatttttttgttaaattctccatggttaagtcaattctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaacaatttaattgaaaaaggttttaaaaagtcttcttttggctttgggccgaaagtcggcccaaaacctctctctctctttccctcggcccagccggcccagtccgccgagccgccgctctcctctctctctcagccgctgacaggtgggccccacttgtcggtttcgtcttcctcctttggccgccgccgcccgcgaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaacttgtggattcgatctcgaatcggattcatctctctcctccaactccgaagtttccttcgccgtctccgtcgccgtgggccttcgccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccg

SEQ ID NO: 25493 - DNA, 683 bp, Oryza sativa
ctaggcgcgggcggagggagcggcgcatgcggcgggaggaaggggatgatgggtgggccctacccgtcagcgagggtggcgatcgggcccgcctgtcagcggcgcgcgcgcggggagaggccgagtgggccgcggggagaggagagagagggaaggaggatttttagggtttttctttttataaaacctttttaactttgtttatttcttgataattattatttgtgctctgaaaattccactaaaatttatttacacattttaggctttgaggaaatatacaaaaatcctccaagccttatttgacttttaactttgcacattttaatttttggaggctttcactaggattttaattattctaggcataatttaaagggtatattttaaggtcgttttgggacgtgacaattgggctcgatgaaccaagattgtgaccaagaagacaacaaagacgggaagactcaatggtgtccttttggtatttttacaaagaataagaagaagggttcaaaggttgaggagtagggagcgctttcaggaggttgagtaagaaatcaatcatcggctaaagaagacgaagctgaagcaggagtgacgtgttaagaatcaagttcctacagccgatgaagccgcagccgatgaagcaaagagattggctaaaggaaaaagtgttgtgactg

SEQ ID NO: 25494 - DNA, 673 bp, Oryza sativa
caaatggccataacttggtcctttgaactcggaattggaccattcaagtctctaatttttccttaagaagtcaagaacccatttttgtgctttgttcctgcttgttatatgaagtttattagagtaaaagcctttttcttcccgttggtcgtgtagacactgcagcttcggaagatccactctacgtggaggtcgaagccgacgtttgggaaagcgagcaaggcaagtcacatcatccttgaacatattgaatcccagtttataaaattattttggtttaaattactgcattatcgctttatttaaattcccgcgttatcactgttttatttagccatgcctatttacctttgttatgaccttattatcattgctattggtattatcaccttgcttaccctagggaaataaaaccccaactagtgggtactctattcatggttccactagtatgaatttaggtagatgcttcgctgattaattaggcaacattaggtggtttcataaccttagactttgggaatgctcatatcatttggacattatggaatggttggactatgtggaaatggacatacacctccccctctattcaaaaccctcaaaatggttttaggctgggctcgaggtgcatggttttgatagtagcacctcggccaccataaggaccggt

SEQ ID NO: 25495 - DNA, 203 bp, Oryza sativa
gagggctctttttagaccaaggagaatttaacaaaaattctccgggccacatttgaatttttcttgcacgtattttagtgtttgccaatttcttttcgaattttaattaattctattattccttttagagaatgatttttaattcgggatgaatttatcaggacgtgacagctcagaaaacacacactgagccccctacctgg

SEQ ID NO: 25496 - DNA, 1501 bp, Oryza sativa
ctgcaaattaattagcactaactaaaaaaaagagatttggagggagagacgtccctccaagaatttttttaacaagaaattgtgagcgtattgagattgaacacgggatcttggggttggaaccacacacttcttgtcactgtactatcaagtgcatctcaattagcgctaattaatacaaagcgtgctgagatagtgagatgtatgagaacaaactccctaatatagtaaataaaacaaaatatttaatgtttagaaaaaaatatcagaataacattatatgatagtgtaattttcaaggcacacgcatacttatttttctcaaataggctttttgagaaataactgtgatgcatggtccatgttttagaaattaaaatatattttgtgtgcttaaaaattagtactagatatttagtatgaccaaaaaagaatgttctagtattaattaattatgagataattcagcgaaggaacggccagctactagttggttggaaaaaaacactgcctctattaaaaatgtggatcagaacatgtctagatttcttatattgggtttgttcaaattcgctatactaaaaaaatattgaattatgtattaaggacacaatactaaaatattttaggacgaatgacgcatcgttttgtcatgcatcgttcagactttgaaacaaggcaccttaacgttacgccaaccacacatagttcctggaagtcctgagactttttcttttttcttgtttctcttattttcaggggaaaagacctgaactgtttgggctaagttacgttactgtgctgttccgttttagatagacaatgtagaagcacagtagcaaaaaaaaaaaaaaaaagagagtaacggcgtgttcgatcggtcgtccggtctgtgtcgatcgagcaaaatcctgaaacggtaggcgatcgattttggtgtgcacgcgcacacaccatcgtcacagattttggagaggagtatgggtggaaggtggaaggtggaaggtgtaaggtgcatgtgactcacataggtggtcgatgacgaggcggccgtcgcagaggcggcccgtggcgcggcggaagaaggcgcgcccctcggggagcgggaagtagtaccccatcccggccgcgatgccgcccgtgtccgtgttcgagtcgccgaacgcgaacaccaccggccgccgcgcgcacgacgccgacggcgacggcgacggcgacggctggtctccgccgtcgtcgctgatttctccggcagccaccgccaccgccatcatcactgctactactgccaccaccgcaacgacgacgccgctactagctgccatattgttgcctagctcgatcgatcacgtacgcgtgcaagtggtggctggacactagctggtaatagctgctttgcttacgcacgatctcgactagctggatgagacaaattaaccgagatgatagctaagcaaagatcgagcagcctggacctggagaaggcaggagccgaggagct

SEQ ID NO: 25497 - DNA, 356 bp, Oryza sativa
ttcaggggtacatagtgataaatttgcaacaccttgcgttttcgttctcacaacgcagaaagttcagacctaatgttatagtcatcagggctatcatcctatttaaactactatatctccagccaaaccacggatatggtactaaggctccgttcaaacagtacatgattaattgaatattatctattataaatttgataaactgatttatttattaatctttagaaaaaggttctatatagaaatcttttcacaaaatatatcacttagcattttgacaaagtgttatcaaaaataaaaaaaagttatcgtttaaagttacggaaaagaactcagcctaaaagctagctacagca

SEQ ID NO: 25498 - DNA, 270 bp, Oryza sativa
ggtgtgcggattatcctgatgccttgcaatttattgagcattttcattcacaaagcccagataataaaacaaactaccataatgtagtggttgatcaaagtttagaaaaattgcaacttgataatttatctgagcaacaacgtcagcaactgattgagaaggttgttgaacaaatagacaatgatattgctattttacctatgttccaatattatcgtagagtggcaattgacccgacagtcttaggcattgatctaaataataatagcg

SEQ ID NO: 25499 - DNA, 155 bp, Oryza sativa
attaagagcatcggttacaatgcatagcaggctatatcatattttgtttcagaactatgatcgtgtgacataaagtacaaagcgtgaaaaatgattttaaggcagaattatgccataataagcacaattttttaactctaatgaggatttaacta

SEQ ID NO: 25500 - DNA, 215 bp, Oryza sativa
ctggctaaactcggcgcaaataacccaacgttagaagatgttggttatcagcccgcataatatatatgcaagcggttggattttgctaagaatttgcagaaataaaccgcttattatttttttgtaacatatttgtttcgttttttattgtttttgcactacgcaaacgttttctttttttgtaaaatatagcgattcgccttttggggttttta

SEQ ID NO: 25501 - DNA, 296 bp, Oryza sativa
attaagtggtattgcacaatctgattcagtgatttggaaattatcagacgctgattttttgcttaataatgcgttacgtaaaatggtgcttgataatgatattgataccaccaaaaaattattattagaggcagatgccatattagcacaagtgccaaatgataaagtagcagacatacgagaagcgattagaaatgactgggagctactagccaatatgaatgtagtggatcaaaatagcttgatgcaacaactaacgacattagcaaatagcttagatgatttaccgatgctgt

SEQ ID NO: 25502 - DNA, 1501 bp, Oryza sativa
tgtctcattagtttcgtaaaatgcacatattgtgcactcaaacaaaattttcaattgcttttcaagcatatattcaaacctaaatcctcaagggcataaaagacatttgcaaccaaacttaatagtgaaataaaggaaaatataacgggaagggcatggaagggatcaaattgaaatttcaggggtagagaagggatcaaataaatttcaaggatatgaaagggtttgagtgagtttttaaggctatacagggaatttactctaatctctgtggagtgcgacacgccatcttctttcgtcaagcaaccaatcgtcctaccgaattggctcatcatctatcacgccttccattcctcgtcaaatcctattaaattaatgcttagattttttttaagaaaatcctattaaatcatcattatcatcaattaattaattaattaatcaatgtgccattaactaagaacgtttaattgttaatatgtctgtccgggacgggagatgatctcacttgattttttacattttaactctttttaaaaacttattttataaatagacacttaaacaaaagacaacttcgacattgggcaaccgcgggcgcaactatgacgtccaaatctgtattagtcccactctatactctgagtaggccttccatgcccttcacatagcactctatttatacctttgttctcgtttctaaaagcattaacctggaggtactatatatgcttgaaatgaactgggtatataagttgacccaaatctatctacactctccatgtggagctcttccaccaaacgaacacttgggtctaaaccggaacaagaagagtcacggaccgaaacagactaaatgggctggattttacactctcactccctcatgggttgatgccctagcaactcaccgctacccaacagccaaatttccaggatatcccctcggtgctacggcattgtgcctatgcgtcgtgtccccctccacgggctaacacacacgcacacttgtgtaacacgggttgaagttctaatattacatgtaacactcgagagacaaaatcaacaatagtccactctacccgctaaatggacccacattcacattacacccaacttacacttttcatcatcacttttatgtaaaaatgttaaccaggaggtactatggttatatacacttccaatagatgttgattaaatgtgctagtatcaatttatgatttaggtgtatatatatcatgtgtctgagctataatatgcatgtttaattgcaaggtagttattgtcgacgtttgatgtcgcgattccggtatttgcatagtatggggatcgttggtactaggatatacgcgagactgaggtaaaagagatggggacgaggatttttatacaggtttggacccctgaattgtcaggtaataaccctatatcctgttggtcgaagccggttgttgctcttattcatcataatcacaccagtacaatatttggggtagcc

SEQ ID NO: 25503 - DNA, 1501 bp, Oryza sativa
tttgctgacatcctgtttgtgtagtgtactcgttttttaacatgttgtaaattcagtttgctgtagaaaaagcccttccttttatgctaatcactgtgtttcttcttcgctgttaccctgttgccagcacgcatgatattttgctggtgtttcgtgtttgtagcatggcatacaagcgcgacgccataaatgagtagaaaacaaaacgctatgcctgtgaatgagggaggaagaagaagaagctgggttttagtaacaaccacacaaaattcccagattggaccggcttccaaagatattgatttcgtagttagtttgccgtatggtgatgtggtctctgaccattgggttggaattaatctcactcatacttgtctcagggagagaactttttagccactgagctgaattatacttgtattctttggttatcaagttcaattttccttttgcaaagaaatagtagtattctttaagtagcatgtttgaggtagaaaacagaaccaaagacgtacaaaaagtgtcattttcaggttttgagatcctccacttgagatatctttgcatacggaatgggggctcacatcgcatctaagggcatgtacaaagatagagactatatgagctctacactatatagaatctaacgttatacaacagttagagacaatatggtctctaccattaatgtatcaaaatattttttttcttactcttgttttctttttttaaccaccatgcaacaaaatttactctaataaatgctaagagtcgactctcaaccgttgtcatgcataacaattatatttttctctcctcctttctctttcttccatgtcatcaaatttacttgcatagtaatagaaagagaccactaataaaaaccgttgtacatgccctatgccctaatgctggctcctggctgcaactgaagcagcatatattgagcatatccaacgtcataatcaatcaagtatatttagctacacatatcgttgtccatcggttgaatttcttgacgttcattctttaacacggttagctgaaccaatccataaaccctcatcctcatgctaatgtcgtatttattttcgacgccttacgtggattagtacagagtacataaaaacagctccctccccgacgcgtgggccaaacctggcaacttcttctgctatgccacgtcacaccgccatgtgggccccgctaattgactcgtcggtcccacgtggcagcgaatcccctcatctctcatctctctcgcggagctcggagagacaagagagagaaccagaggcggcttctcccctcccgcatctccctgatctcctcgcgtcgcgccctcccctcgaatggcgatacctcctccaccctcgcgccccaatccctaaccctagatccctcctcccacgctctctcgcgcacgaccaatctccctcttccttcctgtctctctccttctcgcactgctcaatctcccaattcattatggaggcggggg

SEQ ID NO: 25504 - DNA, 164 bp, Oryza sativa
cctctcggcctcttcctctttactcccccttcgcgccatcgcctcgcttgcgccgcgccaaattccataaaaattccacccaacacaagcgttaggcctcccgcgcacgcccgtccgctcgccatgcccacggcctcttccccttggcgtttgtagatgggctc

SEQ ID NO: 25505 - DNA, 550 bp, Oryza sativa
tttcctgcgatggattgaagatgttcaacaaccacttcctgactatcatcatcattccccaaactatagctagcaaaccccttttttgcaacttcaaggttgcattgcactgcactgcacaagccaaagggggtagagaggtcagtgtctttccaagctgacctcgtgccagtagctccccacactagcacaagagaacaagagacaacaggtccctctgctggtagaaaaggactagtccttctccttgggggcaatggcaatgctgggccctggggacaagaaaagattgggccctttgcttgctcgcttggacccttgaagccttggaggagagagaacatgagaaagagggaagcttttgtagtagtagcagtagaagaaagaagccaatgccatgcatcaccccatcatggcaagcaggcaaaggtggtctaaaggcattgttgggaaacaaatttaaaagcctgccttctctccccactctgcctgaccccaatcccaacccctctctcactccacaacaccataatgagtgtaaagtagtgta

SEQ ID NO: 25506 - DNA, 898 bp, Oryza sativa
acacacacaattgcattacatggatggtcaagtggctccaagtctctacggacactgacgttttggacaagtttggaacggatcaaaaagctccgaaatcctggaaaagatatctgaaccctgaagtttgttaggccatgtacgtggccatcatccgtctctgtgcgtatgacgtattcagaaaaaaaaactgcccggcctgaatatgtcaaatatgctttctggatcgtactctaccaccgtttgcttcgtcaactctttaaagtgagatttcaacaaagcacaagtcagataatatgtaggagtattcataacccattcacatttatttacatggacatggacatgtttttagagagagttgcagttcaatgtctgtcgcttgcaagtgggccctaaaagccaaaagtgttcgatgatgagattaaaaccatccgtgaagtaaacgaagtagaaaaaattggagccgaagaatcacgaaaaaaaaggatagaaaaggtcccgggtcaaactgttacactgataaacttggtcatgccactgacttatagaagtacacagaacctgaaaattgtacatattgccagaaatcacttccagagagtgtactggtaaggtagcaaaagtagctttttaccgccaattgtaccactctgaaatttctaataacaaggacagctgagcattggaaacatctgacagtgcacaattataaggtgggttcatcaaaccaccgacatttgcacagtgcagacatgaatcagggtaagatggtagaaatgggattgaactcagaacaacagatattgcatggtgcagacatgaatcaggaaagagagaaatgtgattgaactcaggacaataaaacaggcacactttccagcaaggatgatgaata

SEQ ID NO: 25507 - DNA, 284 bp, Oryza sativa
ttttgaagttttggtgtgtcatatcgggtattatataaggtgtcatatgagatgttcagacactaataaaaaacgaattataaaatctatcagtaaacaacgatacaatgatacaaatttattaaacataattaatctgtcattagcaaatgtttactgtagcacaacattatcgaatcatggagcaactaggttaaaaatattcatctcgcaaattagtcgcaatctgtataattatttatttattagctcatattgaatacttcatgtagattcactaaaca

SEQ ID NO: 25508 - DNA, 1501 bp, Oryza sativa
ccgccaaccggggacacggggggccggcccccgtgcccggaccgaagtggcgctccggacgaggaagcgccctccgttgcgtgggcggcgcgacgaacgtcgcgccggcgctcgatatcgaggcgggcatccggccccccacgcgcatcttcttaggtcggaggcgttgacgagggaatggcggacgaacggcgggtaacggccgccgctcgccgcgccctccgcctcgacgatatggagccggcggcggctgcgccagaggcctcggtggcggaggaccgcccaacggcgcctaggcgctgctgcgccgtcatgaccaagtcggccacgtcatccagccaacgtcgggttggagtctctggatcggggacgacgggcgggtgacgcaggagcgcgccctggggcgtgccgccatcgccgtagacgaggcggcgacgcgccccgtctcgccgtcctcccccgtcgcccgcgggcggcgaagtcgcggatcctccgacctccccgagcgcctccccccgcccaagatttcggcgagagggggacggaggggtgcgagcccgacggcgcgggttctgctccccgtcgtcaccgctagcgttcggagagaggctgtgcgccactgcccgttcggccattgggctgagcgggagaggcttggcgcacacgaaagaggacgagggcttagaaagacacgcgcgccccctacctggcgcgccagatgacggagcgtggggctcctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtggcgtgaaggaatacagagtgccggagagcgagagagagagttcagcctctagaacccattccccagagtcccaaccctccttcctctttctttttccctcttttttccctctcctaggcctgggcctcctttttatctggtcagcggtcaccacatgggcctctagctgcctaagaagggaaatatgctttttacaatgagggctagtctacagccagaagtgacctctgacaagcagagcacacacctcctgccccgctcgcctgcttttccggtggacgcccatttcaaccttcatttaatggccagcgacttccttgccgtacttgcgctgaagcctggaatggatctgaccgggactgacataccaactgcaggagttagcacgccggctccggctagggatgagagccaggaagctcttatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggtgcgctcgtccaac

SEQ ID NO: 25509 - DNA, 315 bp, Oryza sativa
tgtggcaaggccaaggagttgctcaacaggatggtcgccttcgttaacgtcaccggcgcgtgatctccgagttcgtggccacgcgccattgtttgcttttgggtgtgcgaaaaattttcctactttgatttgatgaactctgctatgttgtgattgaataaatgagacaatgagtgatttttatggttgttgactctgtatgtgttaatggaatgcacgaatttccaacatcttcatatgagaaaattttgagctgcaagcctgcaagcctgcaaatctttggaggagaatgagagtgacagggcacattcacga

SEQ ID NO: 25510 - DNA, 363 bp, Oryza sativa
tttaggtgacactatagaatactcaagctttgtgggttcggaggagttgaattgatgggtgcaattagcagttgacccgtccgtttacactgatggtaaggcatagctgtacttgacaactggattgtcatctgtttaaatttgagattaaacaaaaaaggtgaagtacttttaccgatggatcaactggaatccccataagaaattgctaatgggcatcttagtactaatgccttctttagagttttccacttgaatacttgataggatggccaaaactttgttgactttaatctgctgtatctctttagtttagacaagtctcccagaatcagtgctgacggttcagctttctcccctagg

SEQ ID NO: 25511 - DNA, 1501 bp, Oryza sativa
tggtcgctcgtttaagtgagattcttcaaaacgagtcagtctagggttttagtaaaactattgggatttattcgtcagtcagttgggatttgatgggtgaaatgcattaggtcctagctcagtaacatgggttccaaggtatttatgctttgtttgttattattaatatgtatctaatttctcattattttatcgttatgtgagtcggtcttatttattcgctctcatgcaaaataatctatgcataaaattttcgctcttattcgtttcccttatttgagtcttttattgctttatttaaatttggagtctgagcatgcattgatcctacttctttgtcttctctagatggccggccacccacccaaccaccgcggagaaggcatgatcgactttgtggcagagttggcacgcatgacactggtggtgggctaccccaacgcgccagagtacacgacgattccacagctcagtggcgagcttcctcaccgtgttcgcttggaggtccacggctacgtgggtacctgcctagctaacatggtggtcgaggcatctggaggcacagcagatcatgcctgtcaggaggcagcctacttgatgatggccagactacgggagcgccacaactacatcttccacgacacggcgtaccgcttccacccccgtcgagccaacggtgatgacgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagagggagaacgctcagctaaagggtcttccagcgccaggaggagtccggatccgcactacgccccgcaagacgacgacggcacccgtgcgcatccagcttgcgcccaggaacccacctccatccgcagctcccgcagcacctccagttccgcccgcagctccggcagttcctgcagctccagctcccgcgtccgctctctccttcgctcccgcatcagccgccaggggtccagccagtggcaatggaggttggttgtctgctactcccagtggctcagagtcaggcagtggcgagacttatctgccaggctccgggagtcgctcagagggacctggtgacgagcaggaggacgccttcgactccaccgaccgcaggagccgttccgagcattaggctcgttttccattagtttatcgactgtctagcttctgcttgttaatttgtgtgtttaggttgcttgtttggggttagtcgacggtcgatatcatgtgcctatgatatggctgtcctaataaggatttttgcttgctctttaagtgttttaattcagatcagaacaattgcagttttaattcctttgtaataaagcttagttcctgagcatctgtttttcttcttttccccgtctacttttccctccaga

SEQ ID NO: 25512 - DNA, 768 bp, Oryza sativa
ttgaaatggaattagtagttgattttaaaaacacagtgcaaggactaaatatatgtacatctttgataacttaaaaaaataataagatttaaattgacataaatttgaacaaccccttatatctttactttgtaaaaactatcaagatatttgcatgcatattcctagtagagtctagagaggctcattgctgaatgtagtactacatcgtaattaccaccatgtgaatcctttcctgttaggaattcaacgttcaaaaacattgtaagagaaaaaaagagaaaaaaacgaccacgatgggaaaaagagaaaaaaacgaccacgatgggaaaaagagaaaaaaacgaccacgatgggactcgaacccacaatctcccgctccggaggcgagcgccttatccattaggccacgcggtcacttcgtataatagctcagcacaaaactttataaactataaaaaaactatcgtacttgggctttttggtaagaaagagcccaaggcccaccataggcccaccatcttggtccagtccgcgcaccacatcgccgctgtcgcccgcggtggcaaccaccgcctccttctcttcttcctcccccgccgccggccgcccgaatcctcaaaccccaactccggttcaccgttcacctcccgccagccaaggtactactccttcaccccccccaccctctcctccctcgcttatcttgcgcccgcctttcaaacccacactgttcatgtcttcttgttcttgccacagccaacagca

SEQ ID NO: 25513 - DNA, 162 bp, Oryza sativa
  unsure (1)..(162): unsure at all n locations
aatttgaaaatccatagttttaacgtttccagataggggtatgaagggatttttcagcatatataatctaaagaattttacgatccttgcattggaagtatcatcactccatctgttgggtcctaagtaattaagtanctgtatttatctgaccaatccagg

SEQ ID NO: 25514 - DNA, 235 bp, Oryza sativa
agtacagtgctggtacagaagtacagaactattgcctattacagctaactttagtcttacaatttctcctgtctcattaacttttgatctggtgaaacataaactgaaaaataaatcctttggtaaggcgatttctgtttatgcctccagtgttttagagctagtagttgcaatgtcatactaatggtttgacaaaagtgcaggcagcaacaggggatctgagaacgacgtgtca

SEQ ID NO: 25515 - DNA, 1222 bp, Oryza sativa
tgtttgatttttgtgacgaggagatgtttaagataggcagcgtattgcttctcgatctgggtgtaaatatctcgaaatgaagatgttcaaagcctcaaagataagctctgcacgattcacatctctgagttgtcatcagtctatcaaatttttctctgcaacgaactaacaaaccacttgaccaaatcatacacaaaaattgtctgaactcaaatatatttcagaaatgagatcttagctcgaagctgtacgtatgccatggcgtctgcagctcatcatgctgatctgtcagtaggaagaaaatgtccaaagggtggcaacatcacacacacaattgcattacatggatggtcaagtggctccaagtctctacggacactgacgttttggacaagtttggaacggatcaaaaagctccgaaatcctggaaaagatatctgaaccctgaagtttgttaggccatgtacgtggccatcatccgtctctgtgcgtatgacgtattcagaaaaaaaaactgcccggcctgaatatgtcaaatatgctttctggatcgtactctaccaccgtttgcttcgtcaactctttaaagtgagatttcaacaaagcacaagtcagataatatgtaggagtattcataacccattcacatttatttacatggacatggacatgtttttagagagagttgcagttcaatgtctgtcgcttgcaagtgggccctaaaagccaaaagtgttcgatgatgagattaaaaccatccgtgaagtaaacgaagtagaaaaaattggagccgaagaatcacgaaaaaaaaggatagaaaaggtcccgggtcaaactgttacactgataaacttggtcatgccactgacttatagaagtacacagaacctgaaaattgtacatattgccagaaatcacttccagagagtgtactggtaaggtagcaaaagtagctttttaccgccaattgtaccactctgaaatttctaataacaaggacagctgagcattggaaacatctgacagtgcacaattataaggtgggttcatcaaaccaccgacatttgcacagtgcagacatgaatcagggtaagatggtagaaatgggattgaactcagaacaacagatattgcatggtgcagacatgaatcaggaaagagagaaatgtgattgaactcaggacaataaaacaggcacactttccagcaaggatgatgaata

SEQ ID NO: 25516 - DNA, 160 bp, Oryza sativa
atatggcccccaatttacctttgcaatttctcttattgtcaagtggttgtgggggttgcatataaaattatgtctgcatgcaatttctctgttaactgtttgttgatattttcatttttgtatatccaagttcgcataatcagcttcttgaacttgcaga

SEQ ID NO: 25517 - DNA, 216 bp, Oryza sativa
tgtgggtgttatgtgatagagccacagatatttacaacatacatgctgctaatcagtggacatctaagttcttgaaaggttggttcctctaccaactggtaatgaagagcttagagttccgcaatacggcagtagtacgagcacttgctttttctctaggggtggagcaactagttaatgggatattgactaatgggactatatttttcttttagc

SEQ ID NO: 25518 - DNA, 984 bp, Oryza sativa
attatatatagaaaatatttgaattcaaattcaaatttaaacggatataattcaaattcaaatttgaatcgggtatgtaaacttttgacttataaactttgggtctataaattttagtatataaactttagatgcataaaaatactatatatagaaaatatttgaatgcaaattcaaatttgaatcccgatataattcaaattcaaatttgaatcgggtatgtaaacttttgacttataaactttgggcctataaactttagatgtatagaaatactatatataaaaaaatatttgaattcaaattcgaatttgaaacggatatataaacttttgacttataaacttttggtctctaaactttagatgtgtaaatttgaggtgtataaactttagatgtgtaaacttgaggtgtataaactttaggtgcataaatttactaaaatagaaaaataatgcggtgccaaaaaaggaaaccaggtggagggagggagggggaagggggatcgatcgctacccttgtcgccgggcgatcgatcgctacccttgtcgccgggcgatcgatcgcccattagcacttccgcataagcaaacctaatgacgagggcaaaaaaaaaaaggaatcagcggggattgtacgtagtactagtggggcaataactgacactgacgtatagatccagacccatatgtcagccacctctactacaccacagtgctatagaggatctatatctgaaaggaatgcaactgcaagatgagtggttgtgatgtgatccatctctgcaataatagctacaactaatacagatgactgatgaaaagaatttcacccgatagtcatataggaaaaccgtggaaatttaacggaagtttaacatttagtaaacattaagcttaactctagctgatccagaaaattctatgcattccaaacattatccaaagtgtttttgcaactcatgaaaatgcatttggacccatg

SEQ ID NO: 25519 - DNA, 914 bp, Oryza sativa
aagacgaacaatcaaacatgtttaaaaaagtcaacggcgtcaaatatttagagacggaagaagcatatagcacaagtcaagatttatggttttgcttatacatgtgcttataagataaaatttaaattttaagatgtaatttcatggtcgattttttttttcattgtaagtatattcataaatatttgcttttgaatcgttaaaagggacgtatacctataaattatactattattaataagcagtacaggtaggcataaccaaagcgaaacacattgaaagcgacaattggctgagacacacaaaaatccaaaccaaaataaagatcatcacgatccaactctatgtgaacggtcaaaaacaaacaagatattttttgtggaagactacaagaaatacaaacaagtgtagattgtcctcacgagactgacagctagggcgttcacagtgcaatgggttggcattcagcccaaacgatccacgtcggtgaagcgaggagaatctactggtatcatcttttcgcttaggttgctaatcagctaatttgaatttttaaccggtcttatcttttcgcttatactgcttatcatccaaaaattgaatttttaacggtttttttcaatgaagtttatttttcagcatttacttttagatcactatgaaaacgtatatacaagttttattcacaaattcttttcatttgcaaatatgtcattatccgtgaataagccaaacaatagggctcaccaacctgaagacctcgcgttcaaaaaaggtcacgagttctttggcaaaatcaaggacgcgtaggatgaggagagagcgtcgccgctgtgccatggagcaagtggtttctccattgttccttagcgcgcgcttgcccccgatcccatattcaccgcgagatggaggca

SEQ ID NO: 25520 - DNA, 470 bp, Oryza sativa
tcttgtaaagattgataggcataaatggttaataccaatcctgagataaacgacagaaaacttaagaatatgaccgcttgccttaactgttcgccggtaatgttaccttgttgaatggcacgtaatggcccaatccgctcttgcgtatcagagcctttaacatagtccccataatcattcgcaaagtttgataaaatttgtaacagcatagtagtgataatggctaataagttcgttacccaatcaaattgccccacccaattagctaatgcagatccaaccataattgaagccaacgctaaaggtaacgtttttggtcttgccgtgataaaccagttcgaaaaaatagaacgcttattcataaaagtaataatggattaaataaaaagatataaaataacgtattttagtataaaatacccgtgttgattttgatttataatagaaaaagtgcatttttatggcgaatc

SEQ ID NO: 25521 - DNA, 657 bp, Oryza sativa
ccaaatttgcaaaatttttacaaaaattaatggctttgtaatgcttgttgcgtaaactctacgcttaacattcgccggtggtttatgttgaccaaaacctaagattgcttctggttcgctgtctgcgtaagcaatataaggtttgatatccaaaataggcgtaccattgactaaatcaacactaccaagttttaactgtgcttttccatgatgtatttcgatcgcttctaatgcgactttagataacccgatcggattcgggcgatgagtggcacgagaagcaaaaacaccaatacgttgattacctcctaaacgtggcgggcgaacggttgaatgccattcccgtgcggggagctgatgaaattgaaaaattagccataagtgactaaattgtgccaaaccgcgtaccgcctctgcacaattgtagggggggaataaagtaaggtttccttttccttgagccactaaattgggttgacgtggcacagaaaatttttcatcatacgggctttcaataacaccaatcggatttaacactagaggttgtggattcgccataaaaatgcactttttctattataaatcaaaatcaacacgggtattttatactaaaatacgttattttatatctttttatttaatccattattactttta

SEQ ID NO: 25522 - DNA, 1501 bp, Oryza sativa
taaaagcgtaacagatgacgcccggttaatggtacctgatatggaaaaataggtgttaagcctttgccttctcttcgttgaagttgtgcttcttcgatctctttgaagatgcacttgttttgttcaattgttcataacatcatgatgaaccaagaggtacatgtatgtgatatattgaggacaggttctgatgtatatacaagaaagcaaactagtaaataacggaagatagatgcccatgaaagcttctagcacacaagaaccatcagtaagttgtgtttctattgaattgtaaatatccgtacttagtagtactgtagtagagtactagctccctgagaagaggcagaacaatcccctgagaaaagctgaacaaaagacaaaccatttgcaaaagagattagtggtggagtagattttggagaacacattatcttaacataaaaacgcgagaaatttagttttgaaggatacaaaagctgaggtaattaaacacctgatctcaggtcgtctgacttgatcctgcagtatcccctcactgtcccaagcaacacaaataacacctgtttcttgggatttagttgcagagtggtggtggttctggcagctccattcattagagctcccttgtcaccttaaaatgtgattagtatccaccaatttgggttggtgtagtgctgggtgagttggaaacacatgcccacaacatataatataaatcgaatatccaccaattgcagtttaaatacagaaagctggtgtggaaatgtcactttcgaaaccactctatggcaagccagtcaaagaaggacgatcctcacaaaaatcatagtaataatctagttttgcttagctgttggtagtcagatgggggctgtatgaggacagcgatttctagtttggggctgtagttgcaagttgcagatcgaagtatcgaacaagttgagctcccccctaatagatctagtctgggcgggccagggagagagagagagaaaggtaggcgtgggggatcagggatgcgatacctaacctcgtcgtggagatggaagacgacgaccgcgcggctgcatcgttgggccatgcgtccgcggcagtatgcggatgggataggagccggaggcgaagggaggggagcaagccgtgagtcctggcggcggcaaccggcagcaacggtcgcgcaagcggtggccgaacgattaacattggaatctgggttattttacattctactagcatagttttagagaacttactttgtaaattaaccctatataaaattatttcagaattagaccattatctcgatgttagtgaccctcgccaacgtacaatgtctcaacaccaacgatattagtattgacacccttatcccccccaccccccaacagtcaagatgtagaggatcagtgccactaaagagattatcatcgaggacctatttataaaataaattttttaaaagaggttaaaatgtaaatattctttcttcaaatcggtt

SEQ ID NO: 25523 - DNA, 196 bp, Oryza sativa
ggggaagcaaaagggcttgaatttaacttaccttatcgcttgaaaaacaatcaattagactttggtttaaaacaacctattaatttaaaaattgcttatctaaatgttggcttaccgattacaaatattcgagcaaaagtctttggacattatccttatacgccacaacacccattaaaattagaacaactatcaa

SEQ ID NO: 25524 - DNA, 1501 bp, Oryza sativa
attcaaatgagtatatatatatatatatatatatatatatatatcgtcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttact

SEQ ID NO: 25525 - DNA, 1501 bp, Oryza sativa
ttacgttgatgtatataaaacgagaaagttattagtatatagctaattaagttttaattttaattattatagacttaacaaaataaatatattaatattttaaagtaacttatgtatgaaattttttgtcgcggaagcgtctagtataaactggtcccatgagcgcgagtagagtggccagcgacgtgatcgctcctctgccgtacgcccggccgtgcttcatgatggtggtggaggtacgtggtggagattacctacagtatccgtcggaaacagaatacgtatgacttttaaaagagaaagtacacgtgattgccctcctcgccacatgctgacatgcattatgtttacacacaacccctgcctgaatcgatgatagtattcccacacacaagataaggataaagaagataattaagtattttaggtaaataagatggtattaatgtatgattaattaagttttaattattaaaaaaaataattaatttgatattttagagtaacttttgtatagaaagttttcgtacgaaaagcgtgtcactagtatccaaaattttatccaattttttttaaagaaaagaacagggcttgtgtaattgtttattaatttcttcccacactgccctccctacctacccaccatctgcagcaaccacagggccaatcatgtacttcctcgctcgatcgtctctggcccagccattaaacggtagatggggagacctgagcatcatcgatggatgattaattttggtctttttcaaatatgctaaaaatgataaaataataatatgatattttctagcaaattaacacgttcttttaggtgtccttaggtcaagccacgttttaggagtatccctaacaaaatcactcttatagtaaattttgccaattttaaaaactaactttaataatgttggagtcatgacttaattctatccatcgagactaatagcgtcactaacttttttttctttaatttaatttgcacatcgattaattcgtacaaatcatgtatgtttgatttgcctttataagagttaggctcgatataaaaaagacataaaacgtatcgaataaaacgtatcgaaggaagaaaattatacgagatctttgcctcctcacattttttccttcttgagaaggggatcatcaaattattcaactttcaatacactaattaatatttgaagcaggctcttcatctaatcatccaccccttaatcatggcattttcttcatgcaataattatatagtgtgctctttctttattcttcttggatcttccgtatgctatcttcttcgtgctacctctgttagctagcactgcaacaataacaaactcttaatggtacaaaatatacaaataaaatgtaaacataccttactttaagttatattacaaatcatcttgtacaaaatgcatacataaacaattaactatttacaattaattgatagttaaccatacatatacattgttgtaactgcaga

SEQ ID NO: 25526 - DNA, 1501 bp, Oryza sativa
atctagataatttatgtgctacacaatttgcctctttattacaatgttaaatatggagatattctctaaatcaaatctaagcatagggacattggcctactctgacatcatcttaaaaaaaatgaagaaaaaaaatgctgcgtgggctgggccgaatagacgattgaacaacaggccgaagaaaccaaaaatggtgtagcctgaaggtgaagctgtcaagcacccaaatggcggcgccggtgaggtcggtcctccccgtcgtcctcctcggctgcggcggcgtcggccgccaccttctccgccacatcgtctcctgccgcccgctccacgccaaccaggtacctcgtctcgtctgacccgtccccttcctctccgattcggtgctctcatcgcccatacttgtatagggcgtcgccatccgggtgctcggcgtcgccgacagctcctctctgctcgtcgccgacgacctccactccaacggcttcgacgacgcgctcctcgctgatctctgcgccgccaagtccgccggctcgcccctatcttccctgctcgctcgaggtatccccattctatttcgttattccttttttctttttttagaatattccatagcttccttgggtaatgaatactttgtcatgaatttgcatttgtacacgtgatatttaaagtaatggatggttggattgtgcaattttcagggcaatgtcagctattcaacaacactgaggctaggaggaaagtcattgacactgccagcgttctagggaaaacaactggtctgtgatccttctccctatgcagaatacattgcgcgctaagtttttgaattctctggaatagaaaccagtggggaaaaaaaaggaatctttgatatgctgtatgattgttgattagttcctttttttaaaaaaaaggagtgtaatatcttctttggttcttatcttatgatcctttttgcaggtcttgtactagttgattgttctgcaacttatgatactgttggcatgctaaaggatgccgtggattgtggatgttgtgttgtattggcaaacaagaaaccgcttacttgtgcttatgtaatgtcctccttaagtcttccatccagtattttttgtcattttgacacataagttcatgcttaccaaatgtgttcctttttcatgcaggaggatttcgaaaagttggtctccaacttccgtcgcataagatttgaatctactgtatgcatacgccactagtaattccttcatttcactattaaatgttattatacttttcccccaatcttaatgaaatttggtcggcgtttctttcgccgacccagcaaaaaatgttattatatttatttttcatggaaatccattcatttatttgatctggggttgtatgatatgactgtggccatatgattaagcacagcctttttttttggcaatttcttttattattacaaatgagttgagggtctctgctgatatttactattcctactcttagg

SEQ ID NO: 25527 - DNA, 1501 bp, Oryza sativa
gaaggacctaatatcaaataattagaaggggtgaggcttcgaacccaggtcatctagcccaccaccttgtggagctagctggaagacccctgggcgtttcttgaggatgcagtttcaaaggaatgtggttgatctggaccccatgagacaacgcgaggatcactcctgggaatgcccaagaagattctatcatctatggcacacagggctagagtcaagggtgtggccttagatacaaaggaaactaattatccgatcatgaagcctcctgtttcatgaggaacgaactgcatatgcactattcgttcaagaaaagaagagcagtaaatcgcatgcacctcatgaagagttatgtgttatgtcaatactcgctataccaaattgcaaccttttctaagtgaagcagcagagttcactaaaaatcgttaacattattaatacattcatacatatctagcaaaagggatctcaggcttgaaacgatgaaaaagagaaacgctgtggcaacaagttacccgtagttattgggcgcccagaggaaggcaggccccatcaccggagccgccgctgacacctgcgcaaggaggagcatcacggccaccgccgccgcccaggcagccgccatctgatcggatcggacccaaattagacaccccggaacaaaaattaggacaagtaatgacaaaaattcgatccgcgctgccaagcacagagatccgtgagagatcttaccttggcgcgaagagaagcaggggatcccggattggggatttcggactcgtgtaagctctcgccctcctcctcgtggcgagatgttgttcgtcgttgtggaacaaggggcaggttgctaaccacgattacttctttttttttttcctcgagagagtctggcgtgtgggtccggaagtggacctgagtgggccggcccaagcacagacagcattaggccccaagcgtgttgggcttttagctgacctggcctgatgtagggtgtttaatttttctttttgaaatttatttatttattgaaagaatcgaggatgtttaattttgtttttgaaatttgtaggttgctgaactgcttaatcagatgtcgcttgtattgaatattttcctgctggagtaataatatggaaatatactaacgcttctatgttgtatactgtgttgcattgcacgtctagagaaacaaacaaatattgtaagaaaaatgtgtaaaaccgctaaaagaatatactgatactatggatgaagcttacattacatcacaccaaagccaatgggtgtaaattttgcttgaagagttcgaatacaccttcgctttctctcactgattaactaacctttattctcaagtttttctctatgcaggtgagtcatccaaacaaaccctcttcggagaataactaagggagctaaatttctctagagactcaaccagatacaatattcatcgtgtgttttttttttcttctcttgagactcaaacaagctaaattat

SEQ ID NO: 25528 - DNA, 1501 bp, Oryza sativa
aagggatatcgacattgcattacaagtatcattttcacaagtattgaaagcagactaacctgcaggctcaagaacccatctttctgaagtggcggaagaagacgcgctgtcagtgccactggaagagcacctcagcgacaaaatggaaatgcttcttctgccactcccgttgctgtttctgctggttagctgactgacgaactgcagccgcggctgctgcagcttcgccccattggaggcgtagctgctgctgcaaggaggcggcagtgacaagcaggaggaaggcctcctgggtgttgggctagagaagagcaaggaaggagtagccactgctgcttccatttgtgtctgtgatttgtgctcactgctcagcagtggcagggaaatgcagtgccttgctttttttgttcgcttcttgatttctttgtggatcagtggagatagaattgaggttgtttgtcctgtgttcaatgctatctctggactcatggccaatcagttgctcttcaccttcatctgttggtggtcgaggttcactgcttggtcattgtcggattctcccgttgccctacggtcccactctgcttgtctgcttctgctgtactgtacacaaataaattttttttctcaaacacatttttaagagtaattttagatgaaacaataacactcctccaaatttcacagaaaaaaaaaagagtactccaggattaacattgcagtaatcttttagcagtgcataaataggaaaaatgcataatgaataatttagcttgtttgagtctcaagagaagaaaaaaaaaacacacgatgaatattgtatctggttgagtctctagagaaatttagctcccttagttattctccgaagagggtttgtttggatgactcacctgcatagagaaaaacttgagaataaaggttagttaatcagtgagagaaagcgaaggtgtattcgaactcttcaagcaaaatttacacccattggctttggtgtgatgtaatgtaagcttcatccatagtatcagtatattcttttagcggttttacacatttttcttacaatatttgtttgtttctctagacgtgcaatgcaacacagtatacaacatagaagcgttagtatatttccatattattactccagcaggaaaatattcaatacaagcgacatctgattaagcagttcagcaacctacaaatttcaaaaacaaaattaaacatcctcgattctttcaataaataaataaatttcaaaaagaaaaattaaacaccctacatcaggccaggtcagctaaaagcccaacacgcttggggcctaatgctgtctgtgcttgggccggcccactcaggtccacttccggacccacacgccagactctctcgaggaaaaaaaaaaagaagtaatcgtggttagcaacctgccccttgttccacaacgacgaacaacatctcgccacgaggaggagggcgagagcttacacgagtccgaaatccccaa

SEQ ID NO: 25529 - DNA, 793 bp, Oryza sativa
aacccatacacgcggagcaaaaacccacgaggggtcggggcgctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgccttcgctgcttgcgccctaactccttctttcctgtgccctaccttcgccacacgcgctcgctcttaatcttctcttcctccggcgcca

SEQ ID NO: 25530 - DNA, 1501 bp, Oryza sativa
tattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagggcccacttgcaagcgacagacattgaactgcaactctctctaaaaacatgtccatgtccatgtaaataaatgtgaatgggttatgaatactcctacatattatctgacttgtgctttgttgaaatctcactttaaagagttgacgaagcaaacggtggtagagtacgatccagaaagcatatttgacatattcaggccgggcagtttttttttctgaatacgtcatacgcacagagacggatgatggccacgtacatggcctaacaaacttcagggttcagatatcttttccaggatttcggagctttttgatccgttccaaacttgtccaaaacgtcagtgtccgtagagacttggagccacttgaccatccatgtaatgcaattgtgtgtgtgatgttgccaccctttggacattttcttcctactgacagatcagcatgatgagctgcagacgccatggcatacgtacagcttcgagctaagatctcatttctgaaatatatttgagttcagacaatttttgtgtatgatttggtcaagtggtttgttagttcgttgcagagaaaaatttgatagactgatgacaactcagagatgtg

SEQ ID NO: 25531 - DNA, 584 bp, Oryza sativa
agatgtcttatttctcctttctcttccctatgtttaaaaacataaggaactcgagatttatttcctccaagcttggtagtatccaccactagttgggcactactaagcagatgtcctcacttatcatctccgtctaacttctactatgttgcttcctcgtttgggggtagtactcaacttacctacctgcagctgcacaaccacaatagagctctattgctggttacttcagctacagaacagcaacagccgcagccagctaaaccattgagggcctttgacctctttcaaccccatcagtgtagttggaccaatttgaactcaaacataagcttcctttggtacacatgagtttttttccttgatttgtatgaaaaatgagctccttgatgtaaaggctctctttgtttaggcttataagccaacttataagtcaaaaagtttaagccaaaacaaacaagcagctttttcatttggcttttttgaagccataagccactctaacactattaagccaaaagctaggttggagaagctttttttggcttatatgagatagatgtatgactccaccactaaactta

SEQ ID NO: 25532 - DNA, 1501 bp, Oryza sativa
atattacataggagtaatatgtatagctggtagtagcacattgttgcagatggtgttaccattgcagtaattagtaacagttcaatcaccatatccaagggcagtcagtacagttaattaccaaagccactgtaactaacctgcctgtcctgatcttgattcatcatgccatattgccatatgatgagtagtacctttatggttttattggggttaggtaggagtgtacaaaaggtgccaactaatcgtcagtcccatgcaggggcaatgcaaccaaccgatgaacttgctgacatctgtcgaaggccaccattttgtgccatttctttcttctggcagtggcaatggaccagggcagcaagaaccctactccctccgtcaaaaaaaagacaaaccctagttttcgtgttcaatgtttgaccgtcggttttatttgaaaaaattataaaaaaaaataaaaagataagtcacgcataaagtattaatcatgttttatcatctaacaacaataaaaatactaattataaaaaaatttcatataagacggacagtcaaacgttagcacgggaatccacggtttgcttttttttttatgacggagggattacaagttagattccctgcctcaccatgccaatccaatattgttaccactccaactactactaaaagcaaagctatcactagcaatgtgctttaatttggttaattagtaggaggggcaccaacttttatctgtctccatgtcctcctccattcatcatcaactccgagatcttggctagctaaaactaattaattaaacgctagtttaacgagctacgactacccaagcatgcatgtgctaccagtacgtactccagtactcgaaaatttgtcacaatcttataattttcatcttttcctttgtcgattgatccaactgacgtacaatgcactgcaaatccggaggcatatggagatgcagcagagagtgagtgcagatctcaacaaagcagggaattgatgagctccgtgattggactgccaaacgccaagaaagcgtgatcgatgatgatgcccagccaaaagaagaggcgactcacgacgcatgatctaatcaatcagaagatagacgagagatgagctgcttctcttcccatgcacgccgctctcacctgattgccattgtccgtgaattacgcttttacggttcaaagcgtgagtgaattgtccgtcttcccttatcagtttaaactgacgtagatacgtacgtaattgtcgatacttatgagccgatgataagcagagagctggagagtacatcacaaattggcacaacatgagagaagagtacatgtgtacagcatcttcacacgggcgaaatacaggcatacagcagtgttagtcagtaagtagatcgaagcaagcagacaaaggttagtaaaaggctcacatgcccacctaatgtgggtctctgtctcttgctctcacgcactgtgttcttcgttttcttttccac

SEQ ID NO: 25533 - DNA, 437 bp, Oryza sativa
acgccctgggtgcgccgccgctaggaaaggagggaagagggagcaagggaagagaggctgaggataaggataagacatacggttgagaggaggaatgtgtttttttagcgcctgagatttattttttatagcgactggctacgagaaccgctcttaggctcttagccatccgccagtaaaaatcgtgttatttttacaagtggcccttttaagatgatcgcttgtaaaagtaaattttcacaagcggtttctaatcagggacctctgattgccctttttacaagagtttcttattttgtccgccaaaagaaaataaggtggagccaggaataatcattttttagtagtgccacaagccaccctcgaccacggagcttcatcttccacactgccgagctccggcgaacgacggtggccggccgcctctgtctccacca

SEQ ID NO: 25534 - DNA, 1501 bp, Oryza sativa
caatcatgtcaaacaacaagttcgaaccaaagcgtctctttctctgcgttcgacttcgaccgatgttttcttttcttttctcctttcttgcgaggacgcgttaactgttttttttctctctttcttcttttttctttcttgcggtggacgtgttaaaatgttttgacgtcatgggagtacgtgcgtgcaagctccatcatttaatcttcggctgataagccgtagctaaaattaaaattttaaaacttaacttcataggctgtttttaatgttttgttattttattttactttttcattagctttaatttgagatgatatacatataaaagtttcaacataaattatttgttatcgttgataagcgttgtcgcttataaagttataatcagcgtgatgtataccgggtccaatggctctactacggacagagatcctcggtagtactgcacctgcaatgctgccgctaagtcctacatgttagcggcagctactaggtggcagttgtgcaaacaatccccactaccccgatgtcgtcctaagtcgcttacggatcacgataatataatgtctcgtattttcggtgttcaatgacttctattagtgcttatgtttgcccaatctttgaaaatctttggatcccgtcatcccacagctgattgtgagactgtttggtacagctctaactcctaaatttagcttcaggagttgggtctggagtgagctgtctaaacccagctccacaactctagttcattttgtgagagagctccacccagctccactcccagttttggtaaagctgaaactgtttggctgagctccagctctagaaagagtgaaactggagctggagctgtgctaaacagaccctgaatgtcttctcgctcttttcctgattggtgtcattgttcagtttttaccgtctgttggtcatgtgttgtcggtgaccgactattgctaccgctgtactgtccggcaaccggtacattgtgcaggaccgcatgatcgatcaccgacaaccttcatctctttagtcattaatcgctctaacccccatcattctacgaccccatttaatccccaaatcagagatgcaacatagcaacagtaaccagatcacatgcatgcaacaccaacctgcagcctgcactcgctgcagcagggaccgcatgcagaagccgcttgattctgccactgtagtccagctctgcagcttcatttctctcgtcggtttcctgattatttgtgacagaagaagccatagcacagcttgatacagtcactctgactcactgccatgctgttccagggctggaagttcagtgcaacttcctgtctcattcagcctgtgaaaatgttctgatgaacaaaaatcaggaattcaggattcaggtactttcttgagacatcaacaaaatcctgaattttctgatgcagtagcaaagcctaaagattacacgtctcacagtgtcacacactacatgccatagcattattta

SEQ ID NO: 25535 - DNA, 1501 bp, Oryza sativa
attatggacatcatgtattcatgttgtttagcacttaatcgtataattattacgatgggtcatttattgattattgtattattgttccttggattgctaactcgatgttgcattgattgcatatacatgtaacatccgataaatttaatccgttttcgaactgattgcgcactatttccgacatccgaaacaatccgctccgcatccgcatccatacccgcttcgaattcgcttaaaaaatatggtttaggatatggtatcagcactatccgatcgaatccgctccgttttcacccctagatagaggtgggtagggcgggcgcgcgtgaggttggggtggtgtcaatttttttttattcgcccaaaatatttttgcaagcgggtggctatggcgcctgcgaagatggagatgcctcctgcgaaaacttgtgcttacaggcaggcctttctccacctaaaaaaatgattttttgttgcttgggaaaacgattttttgtgctagtgagatttgttttgagcttcgtgtaggtagggaatgaaaaaaaaatcatggcatgtgaacgggtgagggcaaagcatccacgtacacgtcaggcaatgaaccagaacatcgggtaaataaacctgaagataattggaaattgttttttaaaaaaagataattggaaattggaaaatgcctcaacctgggtgggcaaaggtagatccttttgtgctgcgtacccgtgccatattaaaatgaaccacgcggtactactcccttcattcaaaatatataaatccaaaatcaaatttgacatataatttaaacaagcaccagttcatataactacgatgtcagatggagtagtatcaatcgagccaaccaccaccgccggtcgccgtgatctcaacgtatattaattaaacacagacacaaatacttctcaccaactccaagtgtttggtacggtgaacaattgcgtgttctgacgagattgtactcgtactcatctactcgtcacatgccaatctctttatccataaagaagtactcactcgcacagttgtacctgtagactgtagtactcacttactccagaaaattatcttttctttctttttttttgactgtcaaacgaagagttggatcgtcataatctttgtttggtttggctgcttgtgtgtgtcagccaaatatagttttcaatgttgcattatcaaagtagctgacatactccctctgtccaaaaatataagcatttttagcatagtaacaagtcaaacattttaaactttaactattaatagcaaaaatataaaaaatatcaatcatgtaaaattgatgttgctagatttatcattaaataaactatcataatatgcaactcgttttatttaaaatatcttacttttatagatattgttggttaaaatagcatctcggagaccgtgtcatagtcaaaaatacttatattttgggacggaggaagtagattttattgttgaaggttggatgact

SEQ ID NO: 25536 - DNA, 1501 bp, Oryza sativa
tagttatagctaatttaatatctaatttatataatagttatttaatatattattaatatggtcacatatatcatacacatattgcgtcttggaatccgcgttgcagctgggctcgctgcttctctctcatcttttatctcattaaaatatatttatagctagctaataatcttatattgtacctgctattagccgagaggagagcgagaaaatgccgtgggtgagtgagtctgagaagagggaaggaccgcgggttggttggttggttagcttagctagcgccaccaccacaccaccaccatgcgggcatgcagcatgtgagcatcatgtgatggaacaattccccccctcccctcccgtttccccccttccccttctttccacttgtggtagtaggttttctcatgcatccacatctccatttgccctagtacagtatcccccctcctcctcctgctgctgcagctgcaagctgcaagctcctcctttgcctttgcctaccaagctactagtactcctagtcctagaagtagtagtatagcacccatccatcaacacgtctgcacggagaagcaggaggttaaaaataaataaaaagggttttaattaatcgcagcctaatgccgtgcttatgttagtgaaaaaagtgattaataaattaggcacctaattttcggcactaataaataccgctgcgcgttcttcgcgcagctatagggatagatggatggatagatctactagtgcccttgcctcctgccggcacggccctactgatcaatgcgatcgatcaatggttgctgcatgtgtagcgacattctgcggtttctggttattaaccaaagctttaggtcacaccaacaaacactgtgatgactggtagatgccactgtagtgtgtatccgcatcataactcgatgtgttctacttctacgcatgttaatacttgatctactactaattctctagcttttgaggcggtgacgtacaagggttcacccccattcgcacagttattaagtgcgctagtatgcaatgtcaggcgccttgaatctccataatgacgcatcacatgctgctggagtcgtagtagtacccttattatggtagcagtgtattcgtgcatccctcttgtagcatatgattctcctccctttctagtagtaatagtatcgagctatctatctatcggggtgtttagatcaagaggcataaagttttgaagttttggtgtgtcatatcgggtattatataaggtgtcatatgagatgttcagacactaataaaaaacgaattataaaatctatcagtaaacaacgatacaatgatacaaatttattaaacataattaatctgtcattagcaaatgtttactgtagcacaacattatcgaatcatggagcaactaggttaaaaatattcatctcgcaaattagtcgcaatctgtataattatttatttattagctcatattgaatacttcatgtagattcactaaaca

SEQ ID NO: 25537 - DNA, 499 bp, Oryza sativa
aaaacgatttttataaatttattctagtataaaattacacattttggagtttaaaatgttttataaatcctgtctagaatgccaaatgcttgcatatctatcagacaatatattatcttgagttggggcctcatcgactacccaaaagtttattataaacaccgtaaaggcttattggcgattaaaaaaatatttttttataaaatttttatatgtattcttactatttaatagccaatactaaaaaaagtggtgaaaacatattaaaattaacttcaaattaagttaagtcaccaactacccaaaaatttattataaacaccgtaacatcttattggcgattaaaaaataatttgttttaatttttttatatgtattcttactatttaaaagctaatactgaaaaaaaagtggtgaaaacatattaaaattacttcaaattaagttaagtttcaaacttaaattttactttgacttattatttttttatcctttaaga

SEQ ID NO: 25538 - DNA, 1501 bp, Oryza sativa
ataaaactacgataaaatcttgaaatgacattagtaagacaacaagcaaacaatgaggagcgcatactctctttttatatcaaaaaattgagtgcttattgtcttgtgtaaatgacatattgggccaactaagagcatcttcaaatctcattctccaaatgcctattcggtcagtttgacaaaccaaatggtagtctaatttacatttcaccccaacaacctctattacactatccaaactaaaagtgggtcccacctgccagcctctttactatttcaccccttctccttcacccctcctctctctcttccttttctctgtcgcaccaccggctgaatccgcgcagggctggtggtggtggaggccgtgcgggggtgggggagtggaggtcactgccaccgtcctcattgtctcgggcataggcggtggaggccgcacgtggatgggctagtgacgaagcgatggcgcggattcgggcgaatggcggcgacgtggattcgggaggacgatgacgacgcggtttcgggcgaatggttaacgcgagacctcctgctcgtgtccgcaagggcagtggcaacgataggccgacgaacagcaatggtggtcctgtagggcgtgctgcttcttctccgacttctcctaaggggcaccgccgcctctagagatctcgctgttggcttgccagtctgagtggaccgggtcccttgcctccatcgggtcgttggagatctcaccatcatcgagcttctgctaccggacactggctctccccctcggccacgctgctcccgaatgaaggaaaaatgaataggaggtggtgggacccatggatggcaagtaggatggccaagtttggcaagtgaaggaagaagtcgatcatcggatggcttggagtgggatggagatgccgttggagtgtaatttttgttcaaagttgctaaaattttgatttggagagtgggatggagaggatgttggagatggcctaagtttcacgctactcccgaacgaaggaaaagtgaataagaggtggtgggacccatggatagcaaataggctagccaagtttggcatgtgaaggaagaagtttgatcatctggatggcttagagagtgggatggagatgttgttggagtgtaattttcattcaagttgctaaattttggtttggtgagtaggatgaagaggctgttagagatgctctaagtttcaccaggctaaaataggagaaccagatgatataagagctccttccgaccgcaaaatatttactgggttttaataggaatcatctcaatttccgtaagattttaaaaggtcctacattacaaagaggcctaattttgggggtttctcaggataatccttagagataaaaaggattcataatagtccttagccgtgacagtacttgacaaacggaaaaagtccagttttttcatgtatgcttgaatttaaacacttttctgacacaccggggaataattaagggacatgtaa

SEQ ID NO: 25539 - DNA, 1501 bp, Oryza sativa
gcaccacactcaactctatccacgcctttgggattgaaggagagagggtgagagagaagaatagaaccgctatcccccacaagacccgccaacatggtcaatttgcaaaagctagggtgccgctgcaagaggacgaacatctagagagatcacacacaagttatcggagagacgttttgactagggggcctcctagatgatgtctctagggagaaaagcgacgataagtaccaccaccgccgttcgtcgaggtctcaaagagaactaggagaactttctgctcgacagccccactagaggaagagggacaactcgacaacgcccccagaaggccggagaacgacactcggaatgtcgtcgttgacggtccagcaaggccgggctaggttttcacctactgcccatcccctgtcatccgaagctatcactccatcgctccaccacccgtcatccttcgatagtgcgtggacactattgaaccgacccccctgctggccaacctccgcatgcctatgttccatacccaccatcaccggcttccctgctgccacgacgctagcctccctgccgtcgccgcgttgacctcccacgctgtcggtcgggccgacatcccttccgtcgcccacaccaacctctaggcaccaaccgtgttggcctctcgcagctatcactgactctcccacggccgctaccgctgtcgtgtttctaccgcgccgctcggccatatctgtcgcagggttccgcaggatcgctcaccgcaccggccacccgccaccgtcggtcatgcctcctcctcgcgctcaccgaccgctcctttgcagcctcccggcgaagacgccgctgggacgtcgaagccggctgaggggggtggatccggccgccttgccccgatcccctctgcctcgagccgcctcatgctacctccacttccatcgtcgacaagtccacaccggtgaccgagttctgaacccgggctagaggcattagatctggccggccccaccgttgttgagctcgcctgggagaagtgaggatgtgggagcaaccgcctcgtagcctgtgcgtatctgccaccgcaccgccatgacagcctcgccgcacgccgccatcttgctcagccttacaatgcgcatgcgccaccgcaccgtctctctcgcacaagggatagctcgccaacgagaaaagacctcaccacgactatcatggctcaccgcgcggttgtccagcgacttactccgacaacggcgaggtggatggccgagggaggggtgccgcagcgacagctagggtttttttagccccaagccacccgcgcggggaacaactcgtgggagcgtggaaaggttcgcccataggccctgctgacaaatttacttgacttactgtttcttcttattttctagtcatccaaccttcaacaataaaatctacttcctccgtcccaaaatataagtatttttgactatgacacggtctccgagatgctattttaaccaacaat

SEQ ID NO: 25540 - DNA, 1501 bp, Oryza sativa
gcagcaattatgtactttctccgtttcatattgtaagactttctagcattgttcacgttcatataaatcgtggacaatgctagaaagtcttatattgtgaaacggatgaagtattttattaaaaaaataagtggacacgtgtacctggatatttctatgttcaatatacacgaatttgatctttcggtgtcaccaaaccaaattattccttgacagtttgaacattgttagtatttttgttgtccctaaagtgaacatctttcttatttttattttaccatccatgttgtgtaggatcatgatcaaggtggtttacctaactgtgtgccaaaagtggggatgacctttaattcagagaacgaagcttatgatttctacaactcctatgctagaaatgttgggtttagtatccggaagaaccacgcaaatactagggcggatgggagtctttgctccaaatatttcctgtgcagcaatgaagggcagccggtggcaagcactacccagccggggcggaagaaacgttcttcaacaagatctgattgcaaggctcgtcttcagttctatatttcccgagaaggtatctggacagtgcagaaggttgagctcgatcataagcactatctcgtaagtcctgataagtcacacatgttaaggtcccagcgccgtttgacaccgtcatatcaacagatagtgaatgaaatgcggcaagaaggtattacagcagctgatatgcaaagagtatttcggcaatggtccaggggagctgaaaatgtgcatcttctgaagaaagatactcagagaaagtacctccaaccaagttatgcacagaaattgcttgagtatttgaagaacaaacaaacagaaaatccttcatttttttatgcagttcagctgaatgatgatggtcgaatagcaaacttcttctggacagattgtcaagctattgtggattatgcttgttttggtgatgtcgtgtcttttgatacaacatttgaaacaaacaagtttgaaatgccgtttgctccatttgtggggactaaccatcacaaacaacccattttgtttggagcttcgctgatatatgatgaatcttcagagtctttcaattggctgtttcaaaccttccttacggcaatgtctgggaagcaaccggcaacaattttcacagatccctctgctgaaataataaagtctgttaggttagtgtttccaaactcaagtcaccgcctgtgtttgcggcatatctgtcataatgctgttaagcatttgaatcacgtaatttgcaaccatccagaatttctatctgattttaagagacgtatctatgaagaaaggtctgtaacgttctttgacttgaagtggaaggaattggttaacgcatataatctagacggcaatgattggatgaataatttatatgcaatgcgtgaaaagtgggctgctgtgtattcccgtgactcattttacgctgacatgatgacaatccaaaatgctgaag

SEQ ID NO: 25541 - DNA, 383 bp, Oryza sativa
  unsure (1)..(383): unsure at all n locations
aataaccaaaattccttgtaagcaagtataatttattttttgtaaagaaatttatatctacagtcaataatgcaattaacatcatcatttgtttaaaaaccaatataaaaatgaaaaaaacgctaaccataagattagcgttttttgtatttggtgctctgagcgannnnnnnnnnnnnnnnnnnnnnnnnnnnnnnnnnnnnnnnnnnnnnnnnnnnnnnnnnnnnnnnnnagagcttttttgattagatattattgaggaatatcattattttgattttcaacttttgtagattgttctaccttttgttgaataccacttaaatcttcaaactgacttacattacctgttttatgtgagtttaaattgcctattaataagc

SEQ ID NO: 25542 - DNA, 1501 bp, Oryza sativa
caattcaaatgagtatatatatatatatatatatatatatatatcggcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttact

SEQ ID NO: 25543 - DNA, 576 bp, Oryza sativa
acagatgatctgtctcatctagtatcctgcttgaagcacaaacctgccttttagttaccatggcaaccctgaggccttctttggataacaaggcgacatgttatttcctacttattagactgcttctcaattccaacttatgtttgcaactttgcatatatgacattcctctctttatctgtttcaagagaaataggtccagcacattgggaggtctgactatctctatagcataagctatacagttaaggtggcccttgcatgagctaatagaaagatgtgcctgcagtgatgtacccatgcatatgcgttgttattagttgtaacctaggttctatgtagctaacctgctaactccacggtacaaacatgtgtcattgcatcttagttggaaatttccaatcacatatttctgctcccgtatgtagcatccgtctccgctggcttttgttaacattgctatataccatctcagttaaaaccgcagcatctttcctgccactgaaggggtgttttagcagctactcaagaaattatttagattgatttttggctaaccctgatttaattgacagg

SEQ ID NO: 25544 - DNA, 1501 bp, Oryza sativa
gtaaaagtacgccggtaggaacatatatttgctgggtgcttcaggtatatgaacacacaactttgatatggccaccctgagcaattgtggatcaggaatacagactgttatttctgctgattcttgttccagtctaggcagcatggtcccaggaaatagcccattagcctgtgaaatagaaatgatttggaagaagtgacagatagggagaaaaaggaagccaaaaggagcccacaagtatcattcacatactgatctgaacaacggacaagaaattgctgttagttccccaattgcttattctcggtgaattgaaggatacagcagattaagctagcttacctaacggccggaatgtgagtcatccagctgattaagctacaagctactaagctagcagtttagtggaactaatgatgaaactagcgagacgatcttaactgtagtaaagaaagctgggttaaaactatctacaagatgggataaatcataaaactcatctgcaaaacttttgctaactaaaacggagagcagaatccaggaagaagctgaaggttgccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccggcgccgctgccgtgggctgctgctgctgcagcagcaacctcctgctactcctagcagcagcagcagctactgcattgttgttgccgtcacgcaacaagtcggtgccgatcgttggtgatgcagcagcagttacagagaggagaagatggagcaagaagatggcagcgaacacgcggtgcaaagccttcttcttcatggtgatgatgctttcttgatcagccgtgatgtggtggtagttgcagtactgtgtgcgtgtatggcagttgagcatcaagggggagcaatgctggcttatatatattgttcttttaacttgtgttacagatacagactagcttgattgcagtagcagtaacatgcagatgcaatgtgcaggcgcgctgcttccactacttgggaacatgcagagaacatgccacacatttccctgtaaattttagcttctgtggaatattttgttaagaagaaaggagtcatgcatcaagtgggtctggaacatgccaccctgagacctcacttttgttttgcagacctcaaatagtagtgctgtttctctttgactgaaaaaactccttttccttgagattctcagataatctagtccataaaagtgcttcacattaagcatatgatccataattctttctagggatatatgcgtgagtgccgaccatgtgaaagatgcttctatttgactaatagcatctcttgccgtcaggccggcagtatacgaacaactaaatacaacacgttcggtcatgtgatcagatcagacattcgtttttctttcaagagtacac

SEQ ID NO: 25545 - DNA, 1467 bp, Oryza sativa
  unsure (1)..(1467): unsure at all n locations
aggtccatgtccgtgtggtggaacgccggaagctgcgtggcaagcgcgggaagctgcgcgctggcagacaacgtcggcgcgcccgccgcggcggccgtgacatcggacaggtcgccggtgacatgncggcgcggcggtggcaggtccatgtcggaggcggggcgcttgcggaccatggcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagaggaggagaccaagaaggagaggttagcaggagcatatcacgagcattgagggggtaatttatgggggaagagaggcaacgcaacggcaagctgtctactggactggactgctaccagcgtgtcatttgcccttgggctccgtgtatcctttctttttcgttttctttttcacctttcccatggtagattactcgtaccgatgtttgtccctgttgtaatgttcacacttagcatgtaataatgcctttgtcaatatcatgtgtactgtctacaagtttcacactacagttaaaaactgaaaactttgtaaagcagacctccaaaaatcaagagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttatgatatggtgcattaaatctgtagttccgtgaaaagtttaacgctaaatctgtagttttgtgatacacattcttaaatatgtagttttgtgataatttgacacaagtatctgtagttttgtgaaatttactcaaaaatcaattgtggatcataagtaggatggagtataagggacctctcaattaagcgcccctttgaatcgtaggaatggaaaaatggagtgtcggtgacatgggaccggaagtatcatgacttagagacttgaggcagacacgatcacccacgtggcctaaccccctcaggggggggggggtcgggcccgagggtgatacggccg

SEQ ID NO: 25546 - DNA, 1501 bp, Oryza sativa
gaagacaaaaatgtactcatggacatgagtacatttggagggaatgggagaagagatgcctcattcgagcaaactaagggtgtgtttagttcacgggaaaattggatgtttggttaaaattgaaacgatgtgacggaaaagttgaaagtttgtgtgtgtagaaaagttttgatgtgatggaaaagttagaagtttgaagaaaaagttgggaactaaactcggccttaagccaagtaatatgtgcgggttcgagagtcaaaaccgttatttcaacgtagtttctctttccaattagatcataaataataaaatagtggttaaggtgctcaaaaaataaccagcttgcgaaaggggttgtcctaacggttccaatgctcaagtagcacctctctaggtcctatatataggttgaattttccagtaagcgaatttcaatcttaaataaagaaaaaattactgtggacctccctcactatttcctataaaaacaaataaccagctttaggaagttctatggttgtaatagttttacgatgttcactggcaaattacatagggtgtgtttagttcacgtcaaaattaaaagtttagttgaaattggaacgatgtgatggaaaagttggaagtttatgaccgtgtttagtccaaaataattcttcaaacttccaacttttccatcacatcaaaactctccttcacacataaatttccaactttttcgtcacatcgttccaatttcaaccaaacttccaatttttgtgtgaattaaacacagcctatgtatgtaggaaagttttgatatgatgaaaaagttgaaagtttgaagaaaaagtttgtaactaaacaaggccataaatttaatttgaacatctgtaacaaatttcggcatgctattataccatgagcagatgagaacagtgatttgtatctttctgagcactatacatggaaattaattaagtagtcctcaatcgtaccacacaagccttccagccggacagttagtttcttttaggtcggttcctagccgtagctgtcaccagcattatctggcaaaacggattataagattatagaagaagaatataataataatatagatagatggggatctaattaagcacaacatgtagtatatataaatctgattaatttgacggccacaaaatacttagtttggcaagagccacactttatatatagtacatatattaattctttatcataatgaaaccgagtgaggacttgtcttccttgctaaccaagatttttgtggccttcccctcaaaaccatggaaaaggtctcaaagcattataaaacttgctggctttgtccccttcatttctgttccatttcccattcatcgcgcgtcgtctccacctttcttgcttgtgccaccaagctatctcctcctctccttctcctctagctagagctagtgcttcctccatcttcagtctagcttcaattcaagctagggagcaagctagctagctagca

SEQ ID NO: 25547 - DNA, 1501 bp, Oryza sativa
tagtgtccaaacattccatgtaacactctatataatatttgatgtgacacgatgaaactttacaccctgatctaaataaggggcagaatctggatctaaacaaggggcagaatctctgaagaagaacagattaatcgcccagtctctgtcagacaaggaaacgggcgaagcatcgtgacaatccacgacccgcaagagtaacagatccgcatccgataaggtggggcaagacccgcaagagcacacgagtagcccacaaacacaaaagcctctctaccttttttttttctcttttctttttccttcgcctgaactgagttttgcatcgtttgccaatggacgaaaccctagccgacgaatccgccgccggcggcggcgaggcagccgcggcggagccagcgcaggaatcgcagcaagagacgctcgaggaggtgctctcgaggcataggttagtttactctttggctttgtacccttcaatttttttttctttttctgctgccgtgtgtgctcatgtgccggagacctcgccgtacctcgatctcgccgcctgcccccgaaccggaacctcgatgccgtcctccgtatcgccatgaaggggagagctgcgagcgattgatgaggagaggcggagagggactttgtgatgctgggtcgtaccagtgggctatatcgggcttccttttacttgctgactgtggggttcccccgagttgttgaaccctagcagagccgcagagcagagcaacaggcggaggcggcgatgcagtgcgcggtggcgtggctggtgggcggaggctgcggcacggcaggatttaggattactcttgttgttgttgattattaagagctgagttattggtcccattattgtttttgttgatgatgatgatgattattaagtgttgcgctattagtcccattggcaaattaggggataaaatttttatcttgctgtttattattaagtgctgccttattggtcccaattgcgacttggataaagttttgtgctgggctgtaaaaaaggttggaattttccattgttcgtcgggtttttgttcatgattttgattggctacttagatttgtcttagtggtttgtccttggaatcttagtagtaagaaaaatatgcatttcgactaaaagtgccctaggtttgtcagtgactaaattcgcaatagtgtttctgcattacgcatattcatttttttccctctaattatacaactagtgtcagattgagttctccattaaagcggcgttattcggggaaactgcttagatgagttgaaattgaaattgctaccagattgctgaacagaaattctattaccatgagtaaaattactctaaaattctgtgatggtggatatgctcaccaaagatgaggaacagagactagtattttcatcatttgtgataatattttcgttttaccacatacactgtagtgccagggttgctccaccagagcgacttccactgaaactgatgtta

SEQ ID NO: 25548 - DNA, 463 bp, Oryza sativa
ttggtttgtctaaggtggtgtttggttggagggactaaagtggagctaaactttagtccctctcacaaaaacattagtccctaccatagggacttataattttgtgagagggactaaatttagtccctagttcccaaacaccccctaaaccagctaccactccatctataagaaatatcatccatctataattcaaatacaattttctcttaaactactcatccaatttacgatccgatatcaccgttgtgttcgtaacaattaaatctttacaacaagatctcacatgattatattttgatgaaaaatcacaaattacttttagatttcactaagttacttcttagacatacacaagtaaattcagtaaagtttaaaagtaatttacatatattatagaagtaacttataaaaaaagaaagtaactttaattaataccctttttcattgaacaaattatcat

SEQ ID NO: 25549 - DNA, 1501 bp, Oryza sativa
atgcggtcactgacaagattgttttgctcttcttgaatccgctgctctctagcggcctcttcctttgccttcttctctcgacgccgtgcacccttgctaggcttcgcggaatccgcgttgctggtcacagaaacaccagctatagcctttactaaggtgtccatgttccccttttctgagctgcctgaggatttgtacccaaaagtagcgagctctgcggcatgtttcgcctctaactcagctgagaggcgtgaaatctcctcctctacctgcttcttcttggccttctgctcagctttgctgcctttagcggctgctttcttgaggcttgtttccttatcctggagtttggatttctctttcctgtttaatacaaagagaaagaggacctcaacttttagaaacaataccatataattgaaaaggatccaacccacaatttgtgaagtcatgaaatcaacaggaaacgaaaattagagaatatatgtgcttcttattgctttaactgaacaaattaactaatggttcacattctacttctaagaaaaaaaatgctctgctgctcttcatatggttaactaaacaacccaaattcttgcaagtacttcactgcaactatttttttcctcctttgaataagcatatgtaagttttaaagaggtgttgcaaatacctatgaactggttgtagctcaaaagtagaatgtgcgtggaacttacaaattaactaatgtatttcaatataaggaaggttctgctatccaagaattgtgtatagtagagataaacaagcaacatgacgttacacctaaaaatgggaactttcctgaatataataagatccttagatcctcatcatatgagaaaaaagatagtaactactacgggcaaatgacatcgataatcagcattgaaaacactcataacatcagtttcagtggaagtcgctctggtggagcaaccctggcactacagtgtatgtggtaaaacgaaaatattatcacaaatgatgaaaatactagtctctgttcctcatctttggtgagcatatccaccatcacagaattttagagtaattttactcatggtaatagaatttctgttcagcaatctggtagcaatttcaatttcaactcatctaagcagtttccccgaataacgccgctttaatggagaactcaatctgacactagttgtataattagagggaaaaaaatgaatatgcgtaatgcagaaacactattgcgaatttagtcactgacaaacctagggcacttttagtcgaaatgcatatttttcttactactaagattccaaggacaaaccactaagacaaatctaagtagccaatcaaaatcatgaacaaaaacccgacgaacaatggaaaattccaaccttttttacagcccagcacaaaactttatccaagtcgcaattgggaccaataaggcagcacttaataataaacagcaagataaaaattttatcccctaatttgccaa

SEQ ID NO: 25550 - DNA, 586 bp, Oryza sativa
cgttttaattaaccggctttatggcttggccgaaaatattgtcaaatccacgccatgtgttagacggctattttatagtaccccttcactttgtctaggtcaagtttcaacccatctaagatcgtaagtccgatgtgtaaatgctatggacagattaggtgtatgtggtcacacagcttttctcactttgagtgagaacattctccatttcacagtagagaatatgttacagtgctgcccatagacttaggctttccaaagtctttcatacgatttccacctcttttctagtatcgtccgctacttaaagaatgttgtccctagacgccactttttttccagcgtcaaagcccgtatgtaaagtcctttgagggtgtcccatgaagccatgcatccgacaattaatgaagagcactacagggtgcaacacttctgtgataattttacaatcctcccaccgaaccctatcactcccctattcctctctatcctctgccctctttcacgtcctctcccctatcacctctcctccctctatctcatccctactcgacgggagcatggctggcaatagcaccagcgacga

SEQ ID NO: 25551 - DNA, 1501 bp, Oryza sativa
ttttaaactttactgaatttacttgtgtatgtctaagaagtaacttagtgaaatctaaaagtaatttgtgatttttcatcaaaatataatcatgtgagatcttgttgtaaagatttaattgttacgaacacaacggtgatatcggatcgtaaattggatgagtagtttaagagaaaattgtatttgaattatagatggatgatatttcttatagatggagtggtagctggtttagggggtgtttgggaactagggactaaatttagtccctctcacaaaattataagtccctatggtagggactaatgtttttgtgagagggactaaagtttagctccactttagtccctccaaccaaacaccaccttagacaaaccaactaccactagcagtgtagtcacgtcctatattaaaacatggatataagagaatcattaaaaatagaacagtactatatctaaggccatttccaacccaacacactagacatagtttccataaactccacatcatcaagaaactagtactagacattgctcttccaatacaaacaccactgttccatacttaaatttaatgttatttatctcacatgatgtcttggatgttgtgtagaaaccatgtctcatgcaaaacatggtgtcattctcttttctcatttattcacttgccacatcatttttcattttaggtggtaacttatttaatgttatggacaccatttattaggttaggaatggcctaatccgttcgaacgacttccttgacccaagttttttttggaagtcagatgttaaaaaggaccaaatggttgccaagagctaattaattggtgctcattaacttctggcgaagagatgtgttcaagttcaagttcaacaacgtgtgctgatcggtgagcaactgtcgcgtagagatacgtaacacttgtcgcaataaaaaacgttaaaacactagtacaatactcccttcatctctaaatcaaatatttgacgctattgctttttaaaacacgtttgaccgttcgtattattaaaaaaattaagtaattattaatttttttcatattatttaatttattgttaaatattgccagctctcgtttgttgtcaacttggcactatcattcatcaattttgtaatagggcccgtgcacacctatctgacaaccattcaatattttgggctgttcaaattgtaatcaaaataaatcttattaaattttgacaatttaataatattgttaaaattttagtaggatttcttatatactaaagttttgcaaaaactctaccaaaaaataatatgatttgaaatgacatcaatatgaacaagccattcaacgtattttttttcataaaaactaatctaaaataaaacatgatgtttttttaatatacattgtactaataaatgtcatatttcatcaatagatcgttctttgggacagtgggaataggagcagcctaaccaccaaccgacgtcccaccacatgttggaa

SEQ ID NO: 25552 - DNA, 201 bp, Oryza sativa
  unsure (1)..(201): unsure at all n locations
ttccatgataacacaattaaatggtcatttatccagaacaaccaacattatctcttgctcccgcctagtggcactcagttgatttcgctacaaattcttcgggaacaggcccggcgcagggcatagcccggttgtgcgaccgcntagggccaaggccagagggggccccatcacttaccacccccctttttttttccaagc

SEQ ID NO: 25553 - DNA, 273 bp, Oryza sativa
ccaaaacgtcagtgtccgtagagacttgtttccacttgaccatccatgtaatgcaattgtgtgtgtgatgttgccaccctttggacattttcttcctactgacagatcagcatgatgagctgcagacgccatggcatacgtacagcttcgagctaagatctcatttctgaaatatatttgagttcagacaatttttgtgtatgatttggtcaagtggtttgttagttcgttgcagagaaaaatttgatagactgatgacaactcagagatgtg

SEQ ID NO: 25554 - DNA, 336 bp, Oryza sativa
  unsure (1)..(336): unsure at all n locations
acctgtgcccggccggaagaatgannacgttggtggtggtgaagaagggggaaaccagcgggggggagttctttgnagctatggatgggggtgggnctgggccactgacgncgncggtgcggganccagtggcgtcggggaagncggcgaagaagaacgggnagncggtgncggtgncggtagtgaaggcgnaggtgncggtggcggcagtagcggcgnaagaaggtgctggtggggatgcggcaatggtagacggcgctacaaaggtggcaaaaaaggcggtgtcggcggcgaggcgggcaagggcatcagggcggagagggaaaaggccggcga

SEQ ID NO: 25555 - DNA, 1501 bp, Oryza sativa
taaatcggctcgaaaacctcaaaagtgtcagttccgacacatttattcctcctcacactagagacatttgccgggtgtcggttagaaaatctggtacctattgagcggacaccaatttatctttttatattagtgttacctatatttttaccacatatcaacgtgtatttacgattcatcgttaactgcaaaagattaaggagagctgacacgtcataaaaagaccgatggttttcacgtaaagaacacaccacaacgatcctctcaaggactctctgctttggtacacaacagagtattattactacctctcaacaacaagcttatcttaaaaagacatgatgatgaagagagctatggagatttgttgttgacgacggagttgcgagcaggaggattcccggggacgatgggcggcagcggcaggttgggtatcggaggcggcagcaacgacgccttctcctcgccgactccaccgcctctggtggcctcgcttcccctcagctgtctcctaccatcgcagggcggcgcaagaagcagcaggacgatcgacgccgctagcatcagcagagcgacgacgacggagagacgacgattgtggtgcttggccatgactgctgctatagctttccactgttcggcgaattctttcgctgtgggctgtgtggctgcttagcttgatttgtgtttgcaactttgcatgggcatatttataggcgagatggtgcaacattgcgaggatggagcaggggtgtcgtgtcgatgtagtggactgccgaggagaggaaaactgagaagtgaaggcggcgactgcgccgcgcgtcttctagcttggggaagtagtacgtgtacgtgcatgcagtgcaggggcggagtcacgggcgcgcgcgggggagggaggtatggagcgcggcatgtgcgcgcgcgcgggcgccggtgaagtggtttgtccgtggtgaaccttggggcgcgcgcggccgcttcggcgccggccggtgggagtggggattacacgcagactacgcagttacttccgcaccaatccactgttcgccacgtcgcagattcatcagacctatggttatgcaagcactcatagtgaactctttgtgtgcacagcccttttatcgttgctgcagcaagctcagcgtcgaaagatacgcaagccttatgcgtattctaaaaaaaaaataatttgtgcagaccaacgaataatgttaaatactttattagctggacggactacggagaccgaccttagctcagttggtagagcggaggactgtagtgttgcagattaatccttaggtcgctggttcgaatccggcaggtcggatttcttttcatttttctaatactattttttaaaattctttttacgctttccgcaattccgcatgtaaaaacgcaaacgttttgaaatattttattccattttacgttcttcctatgtataaaatgcaaacgaaaccagtattttattcccttttacgttcttcct

SEQ ID NO: 25556 - DNA, 174 bp, Oryza sativa
ttcctctcccttcctgcacactataaggttgacagagacaaacgagagaagattgatctctgatctcgttctggattactccactctcggtttggtttactcccacactcattcttccatcgttggttcatctccttctgttcctgtgctgcttctgttctccccggtcatgat

SEQ ID NO: 25557 - DNA, 205 bp, Oryza sativa
aattttagcttcgactgtgtgtatgcccgatcaaattttctagcaattttttttctaacctgtacttacgtgtaaatgcaatactgatttcctcaaatgggtgaatgttgtacaccttgtggtggctttcagtacagagttggaggcaggaaattctgaatttacacccgaatttgccggtacaacttttaatttgccaagtcac

SEQ ID NO: 25558 - DNA, 168 bp, Oryza sativa
tctcgacagagcaagtgtttgatgtgcacttgtggaacgcgaaccgacatagcgttaatttaactaagattgacattaaagacggcgaaggcattacgctaaccagcagtcaagcgccgtttacgctacgcgcgttagcacttaaaaagtggacagttaaagtcagca

SEQ ID NO: 25559 - DNA, 1501 bp, Oryza sativa
cttgagcaataaaataatcctgtaataactggttggtgcgcgttttacggctattcctttttaactgataaaaaagcgaaacacgagtttgttcgaatgcttgggtaacttgctgattggctttggctaaggcaaattgcttagcggctaaatcatcattatctggatcaaaaaattcagatttagcttgtaaataaagacttaatgcatcataggctttggctaaattttcttgggcaatgcggtttggaaagcatagatagaccaattagctgactaaactataaatcaaggtgccaactaaaataaggataatattgctataccaagggtgctcctgcatatacgttaaactggtataaattgctacaagtaaagtaccgaaggcaatggtgctataacgttgtccaaccgcacccatcatcactaaaataaaggtacttaacattgccgcaggtaaaaataaccaaccaaatactaacaaaattgcgcacctaatgaggaaatagtaaaggcaattaaacttaacattaagtttttaattcgaccggttaaattattgtctaagtcaaccaacccccccgctataacgcctaagattaacggcattgataattgtgatatctgtaatcgccaaacgatgattgagattaaattgatcgcgataaagatcggcaatgtcttaataatattttcagacaaccactcagagtggacttttttgaagaagtttttcataaatactagcgaccagaaatcagagaatatttactgattctaaaacaaattttcccgcaataaaatatgttatccatatagttgtatactaatttcggtttatttttattttataaggctaaatttataaaaatattctttgcaagaatattgagtcgtgaatagatatagaacagaaaaaataaggtttgtaataagctgaaaaaatatgaatggaatatactaaaaataagcaataaagaattaattcaatcttattatctttatatgatgagtgtaattcttaataatctataaaattttattactgttttttaggataaatatgtgatgagtctgttggcatacaacgtaagtagccataatgcttgaaatggcaggttaaataaagtgttgagaagaataatgaaagcaaagattatctaaatgtaataaatgctatgaaaaagtaaaatgatatataacagcaatattctaaaatatggaatttattgagttaaatctggttaggaaatgttattttcgattgtttaaattgagaatgatttttaattactttgctaatataaaattaaacggcgtgttttttgattcttatcaagaataacgccgtttatttattaaatacctaaatggagtgatgaaggcagaccagtaaaaatcagataataaatcatatcgagtttaatttgtaaaaggtgtgttttggctaaattaactgaccaatctttaccacgtcgcagttttttacgtgggcatttct

SEQ ID NO: 25560 - DNA, 391 bp, Oryza sativa
gtaaagtaaaaaaaccattcaaaggcttgcaccaaggtttttaattgcaaattcgttaacgcaaataaacccaccaaaaattaaactgtccaaaaacacactaaagaaagtaattcctcttatttctttcgccattgttttattcctctttaaatagatgtcctacattcacaagttcttcgctgtctatccacgaccaaacatcaaaacaaggacaatctttgacccattcccatttatctactttgccgttaccatttgtgtcaggcgagagatcacgatgaccacagatttttgctttcgggtgttttgcctctagctcacgcaacaaacggtgtaatgcgtgccattgcttctcggtgtatgcaccgtgatttctaccactggcagt

SEQ ID NO: 25561 - DNA, 1501 bp, Oryza sativa
ctaaacattttatcagggaaaaaaaaagaaactaaatatactcgcttgtacattgaagcgctgctagatgatgctccgtggcgctcaatgtggggagcttcaccctgacgagtcgtgaagaagcagagaagattatagttggaacgccatctccatctgcactggttgttgtttcaagccggtagagcttctggccagcggcgaagttgccaagcagctggtaggaggtcgcggagccatccatggtgaggcagagatcgtcggtgcacgccgcgagctccttctgtgtgcggtagatgaagttgagcgccgcggcgacctcctcctggaaccgagagaatgggctcgtggtgtcgtcgtcgagacgcagcttgcggagcttgcagaggccttccccgagctccatcatggcgccacggtggttctgtgtttgtgcacgatcatgtctaatcacaaattttactggagtaattactaatttactatgcatagtcaaatgtggaaatgagacgatgaaaatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgcggtgaggaggcggcggcggcagcggaggtcaggacgagaggaggagcggctgcggcgctgctggtggagcggtgggtgggggcggcggagcaagaggccaccgcccgccggcaacagtgtccgtggcgcggtgggcgtgcgctgctgcggtagtagccgggcggcgtgcagcgaagccgcagagtgggagtgcgccatgggaatcgaattaggaacaagaaagctgcagagatcgctagctctgctttgtctctgtcctgccacgaaatgggagtcgaatcgcgagcgtgtgacgtggaggacgtgtggactcaagcagaggttgagacactcactcgtgcatgcagaaccaaccaatggacaatgcagtgggtcaaagtgtcaaacacgcaccaactggctgcaaaaatatctaaccagtaaccacaggcccaagaggccaagaagcaacagccgtcagccggtctgcctggcctagactgacctggttttctcatcgtttcctgttagaaaaattttccctcgtcgaatcaaccgtaaaatcagatacaacacatctcttaacttttaaacccaatacaaacgaggtcacttgacaataatgttactgcttttggtttatgtgacgtttgcgtggcttctttgattaggtatttattcgacgtgtgatattgacatgacgcttacatgataatttgatccaggaaaaaaaataaaaatcaaggggccacatatcag

SEQ ID NO: 25562 - DNA, 1501 bp, Oryza sativa
acacctgtgctacgagtaatgaaatcaatgactgggagctacatcaggagaaagataagagtagcaagcggagcaggcagaagcatataccggggttcttgccgccggagatggcggagaagagggcgtggaagtcgcgctccgagaggggcccgcgggagagcagcgcctgcagcagcgtgtggtggcgccacgagagcggcgccatcgctcgacttgcccctgccgcaggatcgagctcgctagtaatctggaagagagggacggaatgggagggagatgaaggaatgaaggaaggaaccctagcaagagcagaaggaagtttggggatgaaatggaattgacgagggcattgagcgaggtgaggtgggggaaaatgtgttggcgattggcgggaagaggcgcgaggagacgcgggaagagaagaagagattggcagcgcagcgggccagcggagcaggacggcagaacaggacaggttggcgtgtgcgggccgaatacaaggcccatgtgatcgagcccacccattgccgttggtgagaattgagcccgacccaatcctacccgcccaagtatttcaagtgtagccgatgcatggtttaagccgaacgggaaaggacaaaagtttattcgaggcgcctcatgttgttgttgagtttcaaaatcgatttttgaaccgtaaaaggggatacaacgcatttctaactttcaaaaccagtacaaacaagattccttcctttatgtattgtccctgattttatctgacgtggaggccgccagccccatctctctccccgttagccgcccttctctccactgcccgtgttcggccaacatcggtctgtagatcatagatggaagaaagagggaagtaataagggttggttgttgatatgtgggtcctattattatttttattttctgatatgtggccccttgatttttattttttttcctggatcaaattatcatgtaagcgtcatgtcaatatcacacgtcgaataaatacctaatcaaagaagccacgcaaacgtcacataaaccaaaagcagtaacattattgtcaagtgacctcgtttgtattgggtttaaaagttaagagatgtgttgtatctgattttacggttgattcgacgagggaaaatttttctaacaggaaacgatgagaaaaccaggtcagtctaggccaggcagaccggctgacggctgttgcttcttggcctcttgggcctgtggttactggttagatatttttgcagccagttggtgcgtgtttgacactttgacccactgcattgtccattggttggttctgcatgcacgagtgagtgtctcaacctctgcttgagtccacacgtcctccacgtcacacgctcgcgattcgactcccatttcgtggcaggacagagacaaagcagagctagcgatctctgcagctttcttgttcctaattcgattcccatggcgcactcccactctgcggcttcgctgcacgccgccc

SEQ ID NO: 25563 - DNA, 1501 bp, Oryza sativa
acttcgccgctggccagaagctctaccggcttgaaacaacaaccagtgcagatggagatggcgttccaactataatcttctctgcttcttcacgactcgtcagggtgaagctccccacattgagcgccacggagcatcatctagcagcgcttcaatgtacaagcgagtatatttagtttctttttttttccctgataaaatgtttagctcttccgatccgtttgaaccaaattgtagttttctgtacttgggaaacgaggaatggagtcaaatggattatagtaccattggtttccttttctttcccttcaatttttctctgcacatactcttattatacgatgatgctaattttagcataacgggtgaccatgcatcttaaaaaaatagtagaactatgttatatttaaagtacctcaaatgataaaatgagtagatttcataaaacctgaggtcttaggctatctaacacaaaatcctaaaatttacaatttatgttcatgcccaccatgttttagggtaaaatgttccatacgattctagctacaagtatttcgtccatttgattataatagttgtaaaaaatgtatgagatattttttctatatgcacatgttaattatgtgcttttcaacgagccatcatcatggttttattgagtgaatttcactttggtccccctgctatcgaagtttcactttggagcatttttatctgatttttttttcactttggatcatctatttttgttttcttacattttggaccatccaaactctctttgcggcacatcaacaatctcaagaacattggcaccctcatgaggacgatctctcctatttacattcaagttacatcgttaccgagggagagattggatgtgattatacataagcattagggctaaagtgtagcctaatatgttgctaaaatatattctccccgtcctagcatataagagattttaattggacgtgacacattctagaactacgaatcttagttctgattcgtagtattaggatccaacccaaataccttacattttggaacagagggatgtagtgagtattatttggaaaaaaataaatgaacgagccttatcataacattaaatatgtaagggtatcaccaaaagcgatatgtataattcaagtgataaatgctatggctatattcaatatagcccgcattgtacgctaaacaaataacacgctttaacgtatgtatattaatagaaaaaatgtatagcatatttgtatacgagttttcaaatctcacaagaataaaaccaatagtattatctatttaattcatttttatagctatctttgataaaattataatccaataacattatcctcagtttcttttttcaccctctcatgttctgatgtgaaaaaccctctgccctcttgaacccaagaggcttgcagcgaacacacgcagcacggaaaggggaaaaaaaaagaaaaccaaaccctctcgtctcgtcctcccc

SEQ ID NO: 25564 - DNA, 1501 bp, Oryza sativa
cttgcaaatttggtagcgctcgtactttatctgtctagtggttttaattgatttactgttccagatgaatagaaccctaaattgcaatgtggatcagtacaactgacataggatatctccttggcgttccatacgttggttcttgcgctatttgtttggttaatattcaccttcttatgttcctaacagtgcttattgctgttagacagcatctcgtgcgttatttactgatgcatacggatataacttagtgtggcaattgtttctgtagcttctggatcatttttttgggcatattttgatatactgttttgaattatagctgtataagtgtatatagatgagcatggctacaaaatttagatttcttatcagcattatggtgtatcagcaatcaaagttggtataataatttctgtttgatgcattcttactgtatacatgctttccattatttttgtttcttggggaaatctttttttcttgtcttttgaggatgattatctttacaaaaatgaaaaataatggcatgaactgttaggtattattttaatagtatccttctgtttgatatgcaacgattttttgtttgttgagaaatactatgtttttcaatgccttttgaggatgactgtatctagaaaccgaaaaatgatgataaggagcgttcgggctttgtgttacattttactagtattttctaggttgtctacttagtacttatatatgtttcctgtacattagaatggaatattttacctgttcaatttgcaaattaataaccagaactgatcatattgccacatactttggttccttttggttggtgctattagggtagtggtatgctagtgctattagggtagtactactttggttgcttatattatctgtctggtagttttgattgatttactattcaagttgaatagaaccctaaattgcaatgtgaattagtacaactgacccagcatatctccttggcattccatatattgccttttgcactgtttgtttggttactgttcaccttcttctgttcctaactgtgcttattgctgttagagttagattgcatctcatgttttacttatcaatacttattgatgtgtacgatgatacacatataacttggtgtggccattttttctctagcttctggatcattcttttgggcatattttcatatattattttcaattatagctgtatataaattagcctagctaaaatatttgtagtttcttatcagcgttatggtgtattgtgctattggcaatcaaatttatattacaattttggtttgatgtgttcttactgtcaatacatgctttccttttgtttttgtttcttgggaaaataagttttcactgtcttttgaggatgattatcttttgaaaaatgacaaataatggcatgatttgttaagctgttgtgttacatctagtagtatcttctattcttctgtttgacgtgtaataattttttgtttgttgtgaaa

SEQ ID NO: 25565 - DNA, 1501 bp, Oryza sativa
acgcacacgcttttcaaactgctaaatgtaatgatttatgtaaaaactttctatatgaaagttatttaaaaaaatcatataattcatttaaaaaaagttaatacttaattaatcatacaataatacgagcttcgttttgcgtgccccaacccctcctcccaaacccagccaaatctgcattgtgcgcatgttcattctctctgaattgcaaaacccatcccctgatcgttgtttatttgaaaatgagataaataacaaatggctaaatatgctttgagtaaaaaacgactacgtataaacatcatctctatcatggttcgtcacggatgagcaaaacgatgagctccgcaagctggaaggtgtcgtcgttctccacagagagcggcgacgtcacattgctcttgccgaacccgtcccggcactccttcaccgcgctcgccgatttctccagcgatgaaatcgcctcctggaacctgccgcccttcacggcggcgccgacggcggcctgaacttgcagtatcccgccgtacaccgcctggcatgacttgaggcaccgcgtcgtggcgtcgccgccgccgccgctgctccggagcatggcgtctatctcggacttggtgctcgtcgcgttggccgtgaggaggtcgacggcgatcaccgcgaactccttgtagctgccgacgttgctgctccggttgtcggagctgagcgcgtcgatgcagaacgtgacgccgatgagcccgctgccgccggcgatggtcttgcacgcaccgtacacggccgagttgatgccggcggcgagttgagacgcagcaattaggagaacagccaagaggaagagagcgctgacgccattgttggaggaggccattgtggaaacctctgcaagtctgtaagataatgttgaaacagatggttttcttgacgccattgcgtgtcaattatataagcacaaaattttgcatggcatttaatgacctgatcgatcgtctcgaatcaatgattatatcgtggatttgtagaatcgattattgattttccgttaatttctctccccattaaatgatgcatcgtcctttattgccatgagggaatttatggtttttttaattagatgaaaaaaaagagattccttttcagagtttatggtctatgaaaaagatgctgttacaaagttttgccccgtatatatgccatcatatggatgttttcatgatgttcctcgttttataaaaaataaatacacgaatagtcatgaacatttttagaacaattatttgatggtgggcccaaccaagtttagtacacaagtatagagtatcccatatttaggacaataacagtagcccctgacctctattcaaatgtataaatcgatcacattagaatccaccgaggagccgagctgtcggaatagatttactttcagtagcacagaaggaatttatccgtacaaatatcatgatggagaaaagcagtacaaaaaacacattgccatcagctg

SEQ ID NO: 25566 - DNA, 1501 bp, Oryza sativa
gagagagagagagaggaattaaaatggagatttagctagatagagaagggcgtcggctgcgtgtgcagaagtttttctaggacacggacacgatggagtattaataggggagatctatgtaggtaggcaaagaccacatatgtttttcttttattgtgccatgaaaagaactgacgcaacgacggctactgtggatgacgcacgccacccaatagaaattgctgtacttgatactatacggagttggaattttaagctcaaggcatatgcgccagtttgttttaagcatctgccatgtttgatgccataaaaaaatgtaatatctaaaatggatgggttatgaatatggtatgtttgaattgtggagcttatagtaattgcaagtatactccattagtctcttgctccatcaaacatattctcatccggattacgaggatacgtagttattatatgataaaaaaaactaatatctacaactctctccgtctaaaaatatagcaatttgaaactagatgagacacatcatagttcaataaatttagacaagtggctgtccagattcgttggactaggatatatcacatcaagtgtaatgtagctatattttaagacggatgtagtagtagttagttggacatttaccaactgtaaatccgaatctatagctccttgaatttaattagagatctaactatatctagactagatttgaatttttttttaattccaagtgtggacttaatttatcctggctcatttatctatataaaaatgatacccctatgtgaaattataatctatatttttttaaaaggaaaaaagatgtttttcccgtacaagggcatgtgcactaggtgatgttttttctccccgaacattattctgttgtagttatcctgatgtacctccaaatgtccaaatctagtaatccctccgtcccataatataaaggattttaagtttttgatcgtagtatttgaccacttattttattcaaaaaaatttatgcaaatataaaaaacgaaaagttatgcgtaaaatattttggataataaagtaagtcaaaaaaagcaaataataattctaaaattttttgaataagacgagtggtcaaaccgtgtaagcaaaaactcaaaatcccttatattatgggacggagggagtatcagtcaaacattaacctagatataacagccaaatcatatgagaatttgaagtcacatatcacatccgatccgttcagccgtcagatatcccttcccgtatactccatccgtcccattattagggtaataatgagttttcgtgtttaatcttgatcgtccatcttattaaatttttttaaaaaataacaaatacataagtcatgcgtagagtactattcgtattttatcatctaataacaattaaaacattaatcataaaaaaagatttaaataagacagacgattaaagtaggacaagaaaactcatggctacgtttaaaatgagacggagg

SEQ ID NO: 25567 - DNA, 1501 bp, Oryza sativa
aagtaggcccctatacgctttcgttaagataaaacataaagaagtaaatgcgaccataagttcagatcagatcaagagaaggcctaaattccaaaatcaaaatcaatcaagaagttgctcacaagttggttagttactcgacatgccacagtaataatatactaatccagctagagatcaattagtctctgtctactgtcttggcagtttggcttactagcttgttgcaactacccttgccaaagacaaaggggaaaaagaatctagctctgcaggacatgcatgtctttattacctgctcatcaatcaaactataccaaacctactgaaatctgtcatgcatgtagaactagcaaagtactcctaccccttctttaatcatctcttctatcatttgatttttttaggtttagcatcccaagagttacataacacaagatgttggatcaatcagactccctgaaaagaagtgtggtgacttaacaccagatgctggattaattgggacaggtctctgaaagaagcttgcaacatttgtactagttgggacaccagtgcttagtatgatcactattatattaaacagtcacaaatgtttcctttaatcctctgtgatctccggcatggggggcaatccatgtgagggctatgagcaaaagatgctctaacacttgggtccctcttcatctggccgcccagaggaagcaaaccattgcttttatttttgaggccgtttggattttggaacatggcctagcttgctgctaatcactttaccaaagctttctgcatttatcaatctattttattaatccatctacctaaagacacaacactatgatacttccatgaagaatgttctctgacaagggcaacagctagcaaggccacaccctgtggcaatcatttcaactagagcatttttgtctctgaaaagtagtgaactgtaatctattagcaactagtatcaggtatgtttgtgaatcatcctctcctgctcttctccctttattttcccttcgatgagaagcataagctcaattataaacatttggtgcaggtatcggttgttaacatttaagaatgcatggttgaaccatgttgattactatagtacttcggtgaggcatagaaacattatgtctgttcttgacatatcagagtctggtcactccggtacaaaactgccttaccatcaagtgtcatcaaccactgcagatgtccgtgatgccgtaatggggaggaatccaacaagtgcagtacatcaacttctgatgaaaaatcacaagaggatcatatgttcagacttcagacagatattcatctaggcaggctgtgatgggcctgccttgattatgggccataattggacttcactggaccatcacaatgcatgctaataaaacttgcagcccataataaagcaaatgttgaacaaaacaaagcatccaaaacagatatctaattgcaccacttttgctaagaggatcattggaagatg

SEQ ID NO: 25568 - DNA, 1501 bp, Oryza sativa
attgtatatgaatttcgtatacttggataaccgtgtttctggtttgtttaggaccttagggggcatgtttctgaaatttaccgtctggaaaaaattctgacattgcttattatatactcagattttccagaaaaatgcttatgtattgccagccttctagcacatgagtttggatgcttgttattgactgacataatgataacttgcaatattaaatcggaatacaaacagtgagtataaaaacttttgtatgaatggaaccgtttgtgttattagagtgaggtttacatttggtcaatattatatttccgtttatgttcatgaaattcatcttgtttctgttcagtgcagtactcccttattgattccttcctcatttctgaacaaaaaggactcacgaatcttagatggcatcatctacactattgatgcatcatctgcactattgacctccttatgttcatgcgatggatattttttcagatcagtgcagtacaatcctacttttgattagtgatgataaatagaagtttgatcgttgaactgatcaatacaagatccttatttgtaagtagcatctattgcacctaattttgtatatgcagtacattagttaggatcatgtatattttggtattgctggcaaatataactctcaccttggatcaaaaatgatttcagctaaacaccacctatataagtttaacagatatttatctaaactcaaaactgaaaaaaaaatgtgtttaatgtctgaaacttgcaaggtgctactatgatctctgaacaaataaacggtctgagtttcctagcagcaaattgatttgttcagagatttaggtgggggcacgccataataaatcgttgagactaggtcttataacaaattaacatgattttttaaagcaaattttctttatatttttttacataaaatatacagatcggaaaagcgtgcgtataaaaataagtgagtataagttaggaagatggagtaaaaagcacacccttaacccactaacctatgttttgcctcattgtaccccttgaactactaaaattggtttgctcgagcatttatcttcttcgtctctttttatacgagtcatattctaaagctgatattttgcagggccagacataacaccattatcaaagctctaaaatatttttaaaaattttcatgactattgtttgaaatttgaaaccacgatgtttaaatcatgcttactgctttgaaatatatgtatacggtggtaaaaaaatatgaaaaatactgagaggtaggttataatatatctatatatcaatcctaccaaatttgcttacaaaatacgacgtatatggttgtatatctttatctacttaaaacattcatagtgtttttgccgtgcatcgtagaaaagtgtgtctcacacaatttttcatccgacatgtgaattgttggtccgtatccatgtcccctgcaagcgtcaaactcttccgcccacgtgaaacggaa

SEQ ID NO: 25569 - DNA, 1501 bp, Oryza sativa
aaagaaaatgaatatatttttagaactttgataatggtatcatatgactctaaaaaattatagcttaaaatatactactagcttatataaagagaaacaaaaaagaaaaatgttactactatggagtaaactggactaatttcaatagtttaggagtaaaatgagccaaaagtaatttaggcgttaagtgatctaatgaaattatttaagagagtaaaatggacttcttttttcttctgttgtaaaatcctttgctggttcaaaaaggggtggtcaaacggtagacctgttgaaagtggtatattctgaatccaccgtgctaaatttgtccttgtaccagttgaaagtggtttcttttcagcaatcagttgtgccatcagataggacgaacactttttggactcttcaggaatcaggattaagatcagcgcatgcttaggtataaacgacactctatgtctttgattcgtaccaacttgcccaggacccagggcaaatgttagcctggcttccacaaaggcacctttctaatcaacacaggaccaataataaaccctaacctctcgtacgagcggtttaaagcatgttcatatatctgccagaaagaaaattaagattgcacaatggagaatactagtactgacacacacaaaaaatatatattaaactgcatttcagagtcattttggtacttgatcagttgatcaccgagagaacagtagtataaaattttcggacaagatatcatgctgaaaatattggactgtgcagcgtgcacaagacgaacaagacagaagcaagttcacgtgctttggttaatgttaagaaaggttggcttcaccactaatcagaaatcttagccatatgtccccgcaaaaaagaaaaagaaaaagaaaagaaatcttagccatatggaaaagagacgtgtgttaaatacccttaaaaaaattaaaaatcagacactagtaattgaatacacttccagcataccgtgcatgattcagaaagccaggaaaagattttagttgaatatagttagtttcggttggtttcgctcggccgttagcatggactaatcaaagaacactgtcatcatcattggcaacctgatagtgcgaggagcactctgcttgggctgccccggcaaaagagaggggaaaaaaaagaaagaagctacaaaaccagtagaattcagctgaagtctgaacccaaatcttgcgttagtggatgaagcaacaagatggcgcagccatctcggtgagtggcatctcacatgcgtgacagatgcaaagaatcgatgcgtgcaactaagcgaggtagagtgattttaaagtcattgagaaaatattagaagatacctattttttaatgtaagatttagtatctctcgatgcatccgatactgtaagtaccaaagatttataggatttattggtccaatcttcgaagatacttataggtgtagaatttacgtacatacatctatagggatgagtgtgga

SEQ ID NO: 25570 - DNA, 1501 bp, Oryza sativa
gtttggggaaactactgttctaaactctcgaccctcgagtttacatcatttctttgcatatcatctaaactagcaaaatactcgtgcattgcaacggatgaaaacaatataattttataattttaataattaatctgtcacatggtaaatcatctatttcaatcattgacacttaataaataaacgtgaaaatatttagaaatacatcaacatcattgtttattaataacatttttcctttaataattttaccttgcattttattatgttctcacttatatataaatctatatttttctttaattttatgtatgaatcgtacttaaaatttataaaaatattgaattcatattgtttctaacattctattgttattagattgtacttggcatatatcattttgtttttttattctaaactatagttgatttgaatttattaattacctaatttaaatatctatattattagtctaaattatttttaaaattaaaaatattaaaatattatagatatatcacaatgttttagggacgggaagacaaagtgcgttcaatggtttcaatttataacctgataaagaaagaatgttaaattagattcatgccaagtggcacaaatgtcttagaaaatttataacctgataaagaaaaaaagttaaattagattaatgccaagtgtcaaagtatgtcctttagaaaattttgtggaataaaaattacttataagaatataccttgataaaaagatattttgtgtgactatgggtagtttgtggtctagattcttcttaagaaatttatgtgagtttggatgagtacaaattatgtgagcttacatttttcgttctaagggtgtttggatgagattcagtaaccaaattacatatgctaaaaacggaaatcaaaattaacaacttgaaagtaggtggagctgggcagaggcagatctaaccctgtttccgttgaacccccaaactttttgagggataatgcagaatacctgatgaggtgtgggtagggagggatgctcaccggcgagcgacgatgcggtggaaggaggaggacgccgggcgccacctctgctcgcaggatggggatcggcgcaagcggcgggcgaggagacgaaattcgaggccgaggccggatgggatggattaggatgctcaccggtgagcgaatgcggcgggagcagaaggacgccggcgccacctctgctagcaggatggagatcggcgccagcggcaggcgaggagacgggagtcgagggcggagggcgaggagacgggacggattggggaggcggaggtcgtgcacgcggtgtcgcctgcctatgggtcatatgcacaggcccatgaggctggagttttttcatctcccaaaaaagttcatctaaggtcccttatcttgtcgttgagttttaaacgaccctgaacccctaatcttgcaaaacggattacggatcacttttaatctcaaggtagtattgttttccggttttg

SEQ ID NO: 25571 - DNA, 1501 bp, Oryza sativa
atctttttttatgattaatgttttaattgttattagatgataaaatacgaatagtactctacgcatgacttatgtatttgttattttttaaaaaaatttaataagatggacgatcaagattaaacacgaaaactcattattaccctaataatgggacggatggagtatacgggaagggatatctgacggctgaacggatcggatgtgatatgtgacttcaaattctcatatgatttggctgttatatctaggttaatgtttgactgatactccctccgtcccataatataagggattttgagtttttgcttacacggtttgaccactcgtcttattcaaaaaattttagaattattatttgctttttttgacttactttattatccaaaatattttacgcataacttttcgttttttatatttgcataaatttttttgaataaaataagtggtcaaatactacgatcaaaaacttaaaatcctttatattatgggacggagggattactagatttggacatttggaggtacatcaggataactacaacagaataatgttcggggagaaaaaacatcacctagtgcacatgcccttgtacgggaaaaacatcttttttccttttaaaaaaatatagattataatttcacataggggtatcatttttatatagataaatgagccaggataaattaagtccacacttggaattaaaaaaaaattcaaatctagtctagatatagttagatctctaattaaattcaaggagctatagattcggatttacagttggtaaatgtccaactaactactactacatccgtcttaaaatatagctacattacacttgatgtgatatatcctagtccaacgaatctggacagccacttgtctaaatttattgaactatgatgtgtctcatctagtttcaaattgctatatttttagacggagagagttgtagatattagttttttttatcatataataactacgtatcctcgtaatccggatgagaatatgtttgatggagcaagagactaatggagtatacttgcaattactataagctccacaattcaaacataccatattcataacccatccattttagatattacatttttttatggcatcaaacatggcagatgcttaaaacaaactggcgcatatgccttgagcttaaaattccaactccgtatagtatcaagtacagcaatttctattgggtggcgtgcgtcatccacagtagccgtcgttgcgtcagttcttttcatggcacaataaaagaaaaacatatgtggtctttgcctacctacatagatctcccctattaatactccatcgtgtccgtgtcctagaaaaacttctgcacacgcagccgacgcccttctctatctagctaaatctccattttaattcctctctctctctctctttgtgtctttctcaagggagaattaaccatcaaatcaatatatacaatgagcttgatcagcatga

SEQ ID NO: 25572 - DNA, 197 bp, Oryza sativa
aatcaggcctgcaaggtcctcgaagcagaatttcagaacgtagctagacagcatctaaattatgaattgatgttggcaatagtataggtaggcatgaattatttctcgtatgtaaattatgataaggtttatggttctgatctcagtgagaagatgcattaccagtttcctttttttttttatctaaattatgcagc

SEQ ID NO: 25573 - DNA, 1501 bp, Oryza sativa
cgcagttcgtgtcgcggaacaggaggatgcatgggcctcgcgcggcgtgtgggggaagctgcgaatctcgcgtgcggatcgtcgcctcgtcgtcgtcggcgggtggaaggatttcttggcgcatgcggtgacggcacgcaccctctggcccagtagtactaccagtagggcccaaggtgaaggcctggctgataattgcgcacgttgcgtgatgggccaggcctggctgggctatcaggccgtacaggccgagatttgcaggagccgcaggttttttggctggtgttgccactgccgggaattcggtgccagcaaaaggttcacgcacccgatcaccgtgtgtgcgttcgtgtttttatgatccttttgtatttggacatttctaacacggagtaatacatagtatgtttcatataataagttatttaactttttctcagttaaactatagagaaatatactaatatttttaatacaaaataaataaactatcaaaatatattcaatgttaaatttaataaaactattttggttttataaatgttgctaatttttttctataaatttaattaaccttaaaagctttgactaagaagaaaatcatatgacttgtaatatagaacggatggagtacatgtttcaccgatctcactgcggcagcctgcatgtcccggtggttgcctcacgacagcacgaggatcattactggtctgcctatgatgtcgttggtggagctaaacatcctgaaaatagctaagtattccctccatcctataataatataatatagcaatataggataggacgagacatttcatataacaatgaatctggacatgcatacgtccagattcattatcctatgaaatgttttgtccggttctatattgctatattataggacggaaggagtagtgagttaaataagaattaagaaaagttaatattggtaaaaatcgaacataaaattctaaaggtcgctccggttaacagaaacttcataatttggatctatatctcctctcgggcagtgtgtggtatgcggcagctgatgctattgaggctaaaccaaacaacttcaatgtgcaaatatcaattcaccaacagaaaaaaaatatttcacacaatcaacttctgtatcctaccataaagtttgaggataatttcaactagtaaaacaacagagaaataataacgtttacatgcacgcaagacaaaatgatttacgtgaaaaaacatcctcagcgtgaggagtaaaaacatcggtccactccaagcatccactatagtacaaataaaatattgtccagaacacctagaggcatatcatagcagcatcaaaatcgtcgagttatacacttggcatcaacaacaaccataacaactaagaggtatagcaacaataagcgaagaaatggtagattatatctcatttgttggacctttaagctacaatgggctaagagcaaaaagctcctgcagagagaatttagcccaacag

SEQ ID NO: 25574 - DNA, 392 bp, Oryza sativa
attggcctataattcaatggcacagttgcttcaagcttgtaacggtaaactgctgataagtacaatatcagttagaaacctataacatccttagaggcactaacagtgtgtgtatattgagggtattattctgtagacacgaaactacaacacagctcaattctccctaaatgccaattggttcagttctgtacttgtcctgttgtttcagtatcaaggcttgaaggttttgtgtcaaataaggatcagtcttacgaagatccaattgaagagtgagtacttgccttgagtattcttccacacaactgagctccattccctattaaactatagtgcattgcaagaatcatctgtagctattaaaatgattttacgcctttcttgtttgcaga

SEQ ID NO: 25575 - DNA, 1501 bp, Oryza sativa
cagtccaatattttcagcatgatatcttgtccgaaaattttatactactgttctctcggtgatcaactgatcaagtaccaaaatgactctgaaatgcagtttaatatatattttttgtgtgtgtcagtactagtattctccattgtgcaatcttaattttctttctggcagatatatgaacatgctttaaaccgctcgtacgagaggttagggtttattattggtcctgtgttgattagaaaggtgcctttgtggaagccaggctaacatttgccctgggtcctgggcaagttggtacgaatcaaagacatagagtgtcgtttatacctaagcatgcgctgatcttaatcctgattcctgaagagtccaaaaagtgttcgtcctatctgatggcacaactgattgctgaaaagaaaccactttcaactggtacaaggacaaatttagcacggtggattcagaatataccactttcaacaggtctaccgtttgaccacccctttttgaaccagcaaaggattttacaacagaagaaaaaagaagtccattttactctcttaaataatttcattagatcacttaacgcctaaattacttttggctcattttactcctaaactattgaaattagtccagtttactccatagtagtaacatttttcttttttgtttctctttatataagctagtagtatattttaagctataattttttagagtcatatgataccattatcaaagttctaaaaatatattcattttctttcacgactgttttcttcaacttcataatctcgatgttcaaatcaatcccctaggtacttccaagttccaactcagataaactgtggtatgaacaaaaagtattgagatgtgagatgtatactattatcgtcctaccaaatttcattgcaaaatataacttatacatggaaaaacataaaagataaatactgttagggaataatcaatcgtttttaatagtttgaaggtgtaaaataagcttacgcggttaagccatctaatgtacggaataatagtttgaaaagattaacttttttcggagccaacagaaacgatgaagccttcgccgtggtactgcccagaatgcggccgcgcgcggcatcttggatcgtttggtcacatggaggctacgaccatgtcggcacggcaagcaaacgatatctgaatttcgatgcaggagtaaactctgaatttattggttgcgtgcagcatcgggccgtatggcccccatctcgtcctcgccgcaacggccaacctgccaacctggtgtcctcctatcctactacttcccgccacttttggagtcaaactgtggcctatctcttcacacgttgacgcgaccacgttgacgcgatcagggagctcgttgacttcacagtggattgccacaccattcgaagttctttatatgcacttgcgattttgattttgatttgatcccatggttgcatggagaggaataaatttgcaagcaaaa

SEQ ID NO: 25576 - DNA, 863 bp, Oryza sativa
cgctacggcagccatgggcgcgcgcgagtcagcgacggccgcgtcgaggttgccgcctacctccaggtgtggctcgaggaggtggcgtcgcccctcgccgtcgacggtcgcgcctccgccttgactacctcgcgctgccactgcagttcctcaccaacgcatgtgtcgtcgtccagactagcatcgacgatgagtgctagtagtatttgtgatttttgttcaaattttggtcaaattttgtaattgcatagtatttgtgattttttttttgttaaagtaaaaaaacatcacaagagatgctcatatttggtcgaaatgctcatcacacaagctgaaatcacaaaataggggcaaaatcacacaaagctgaaaaaaataggggcaaaaatgcaataaccaccaagggtataaatgtctttttttctacaactaacgtcgttaaaaccggctattagaagtgggggtacacggctgattcagattcaaaaagtaggagtaaaactgcaaaccctaaaaaatgagggtagaacagcaattggcttcgaaagtgggggcacccatgcaattgccccaaattttaatgtataaatatgagaaatattatgaacctataaaagcacctcacatattgtcatggttacggataagacatacctcctatctatgacttacgaaatatacaagtatggtataccattgtccatacgatatattttcgtatgcggtaagaaaatctacaagatattatagaaaatatcctcatgggctggtgattaacagagtcctactcagagaggattggatttattctatatcgtgtagggttcattgtctccgagttgtacttagagactaaggcaact

SEQ ID NO: 25577 - DNA, 180 bp, Oryza sativa
cccagtctgagaactgttcaggctactgatgaagaagtaaaactgaaaataataacagagagtgtaaaggtttattaggccattcacagagattatttttaaaatcaccttcctatctagatccaaatttagtggcattgcacttcatatttgtcattatgatgagatgtgttttgcaga

SEQ ID NO: 25578 - DNA, 619 bp, Oryza sativa
cataacaacattgtatcgggaacaatgggcacatgtggcctcgtaatcagtgctaactcatatgtatctatttgaatgaaccctgcccaaaattaacctttgccattagctcacacttactatccacggcattattgccacttctgtaaactgctgtgcatctctaaccctttaactttctcaaggtttgaggacaatgggattaacaataaacataatagcattcgtatagtaggttcaaagtgaaatctttaataccgatttcaaggtccaatccctagcctctcattggaccacatggcatcctaatatttcggtttgaatccctcctaaaatctgtcacgtgtccatatggagaggtggtggagaaccctgcgcagtctcccgcgcgaacattaatctgaactctagagtattccaaactatctatcacttgcaatctcttcaaatcgaaataaaaataggcatcaaagcatgaaagaagaggtatccatttgtcttcttcaatcgatcaaaactgataaaagaatgttgtcttcttcaatcgatcaaaactaataaaaaatgaagatcagaatgtgagaaacccagtgtcagatatgtgggtgatgcactgcaa

SEQ ID NO: 25579 - DNA, 1501 bp, Oryza sativa
taactttttgttggtttgtctgatcaattagagaacaaggggcaaccattactaagataaagtgaacttctggagaggaagcaagatttttcgctgggccagcggaagccgacgaaattgtattaaaatgagagaaaagattatcagttacaacaataacggttcttgacggagaaggctaacgctcccctagggagcagagagtcgggccatcgccaagcccagagcggagactgagctaagtaccacagggaagaagacccacaacatagctatacacatgccactgccaagtctaataccacaggaggactatacagactcgatcctagcacctaaaccagcatctctccaagtccaccactcctctgtcatggcttctgccacctcggttgctgtcttggaagttggaaacgccttcgaagaccctcccatttctttctttccaaatcagccaatagaagaggaagagtctagcgtcaaacaccttcttcccttgtttgttatgaagctcgtgttcatgcagccaccaggaaaccataccgggggatatttggtgtttgcggctgaaggcggaggcggagtcgcagttgcgcccaaacctgtttggagaaagggcaattgacaaacaggtggttcccggtttctggcccagacgaacagagagggcaggaaggccacctgcgtttgtccaaattgtcggaggtcaagcagctgccccgagccgtcaggtacatgaacattttacagcgaggagtgaccttagccccccagactaactccacccataccacctttgttttccccatgaaaaacatggagtaagctgaggaggagtagtagtttccgtcggccgaaagcttccacacaaagctgtccctggaatccggctgtagctgaattgcctcaagccgatcccacaagtgcagcgcctgcatcgaaagggcccccttgatgtcatggacggacggacccaaccgtgtgagaggaagctaagatgttaggggtctaatctgacggtgacggaaatggaatcctatattttacaattaactgattttctttcttttacaatcaactgattttctttcttttacaatcaactgattttctttccaagaaaatatttatgatttaaacttgttatgtaaggagagttggagacagatagaatcatcgtgtttcacgctgggcaccaagaatcagttcttctgatcaatcaaaatcaataaagctagcgcactaggattacacacgtgaatccacagtgaaacctttgcaacacggccccgtctaaaagctgtttattacagtaaatacaattaatacggattgagtattgtactgtgctaatgggtggacactgtgattagggactgaattatgcagagtaaactctacgttagtaatccattaattcccctctccctttaaaacctgccccttgcattctgttgatgagcacctgcgcctcaccttgtctagttagcaatggcggctg

SEQ ID NO: 25580 - DNA, 1501 bp, Oryza sativa
agagaagaagaagaagaagagcggaagagaaggaggagaggagccatggatgcttcagcgctcagcaacccgcggctgcaggccatgctagaggtaataataaacccataatgtattagggagatttagagatgagccgcacactcgagtacccgacctatggaaccctaacacggagattaattagcagcccccttcttttgatcccatcagcccatctgtttgttgctacgctcgcgattaattttttgtcctttttagatctactcgaagattcgtgaaaaaggctgagctttgggcgaaattttgctgatttgtgccaagtttttgccctgttccttccaaccattagcttattatgtatgcattttatttattttgttcagttgttttagcaatattcttcagtctgcaggaattcctaggcatcacgactggtttttctagctaagagtaaggttgtgccctaattttggggtttaacagatgtcctgggagttgcagttcaggtggagatcggtattcgaatcctagttgtgttacttaggtatctagtatcatagcaattttattttaaagtatatcaagtgctcagagcaattgcggtatcttatatccaaggattgtttggcctcaaatctcatagccggttctgttgttgatagggtcccaaatccatagcataactggagttaatccagcttgtggttgtggcttttgatcaattccttgcggagaactagggtatgttcttggggctccttgtggttgtgactatcacccaagtacccagtaaccctgactgtgaaccaaactaatttggatagagtctagttttaggcaccatcagaatggtcctggtggttcatgaagtctttcctaaaaaatagccatagcttgaaaagtttctaacgcttcaactgaggtgatattctgtcattcccaattgcttttgtggtgctctgtatttaaggattatggctgttcactcattactaatagaagttacaattctctctcatgatatccaacaaattatttattttcatgcagtagtttcttaaattgcagtagtcccaaatcccaagtgtgctagccgctaatgcatatagcgcagtgaggtgttttattaaatttgatttgctaccagctttgttatgttagaaaatgatagtgctgggtattctgacacgttgcaaggaaccaaagatgttttcccggtgacataccgatatactcttatgtgaaaggaaatactaacatagaaaggtcatcagtctgcaaattaaacgacttaaggaaaaaagggaattgcctttttacatctagtatgctgctaggacctttttgtcctgggtttctgatatgtaatgagaatggcagaagttgcttgcttccctttatgcacaagaaattattttgtgtactctgttctttggacaatggataattaagccatgtgttcattttcaagatcccctattcaattgcagaaccgcgg

SEQ ID NO: 25581 - DNA, 1501 bp, Oryza sativa
atttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaactttgtaaagcttgactgcatgcacgcattagtcaattttataaagatgtgcattaaggggacataaatgtttaacaattagccgggtcctataaccttatttcttaaaaaaaagaactatttagactccattaatatgtcaaccattgtattacaataaggaccaatgtttacttgtataagtatagagttcgtaattaatgcaatcaaattcagctagtaaattaatttcgaatggaagttaccacaaccagattaaaatagggctttttaatttttttttacttacatattgtagtgtgattttgaaacaatttcataatttttgcatcacatagcaatttgaaacagcaagatataatcgtctttttgtttcatttcatccatcatattgaattgggacaattttattcttgctgctactttgattccgatattgtttttccctattttttggttttcattatttcttttcaaatattttttatagaagttagtgggtccaggattgctaaactaaaaagtaacaaaacaagaaataatattatttcaacttaacagttaacctttctacccgtggagattttgccatatgcaaacaatacccttgagtcattttcctatcccaaatccaaattcatgcccccaaacctaaggcaatagcagctcagccaggcggcgaagaggaggtgatgacagcggcagttccgtgtaggaaggaggcccagccaggcagctgctccttgtagggaggaggcgacagtggtggcccaaccaggcaatggcagtggcagctcctcacagggaggaggaatcggtgatagcctggctaggcggcggcggctccttgtagggaggggtgacggtggtgacgactctgcataaggaggagtcagtggcctagctagagttcaacgcaggaagacggcaggtcagtgcgatgagatggcggcggcttggtgtggggaggtgatggcgagtagggcaagcgacggcgattcggcgcggggtggctgctatgagtaggcgatgcaatagcgactcagcgcagggagtgtaggatcaagcaggccgactagaggggggtgaataggcggttttaaaatttaatggcacttaaacaaaactaacctaagttgctaggcaaggtaaggtacaaggttaactaagcaactaagttaagttttgcaaacctatgtgttataggctcaaatatgtctctatgaatgtaaatagcacaaatgtaaa

SEQ ID NO: 25582 - DNA, 1501 bp, Oryza sativa
tttgtaagtagtctatatttaatactctaaattagtgtctaaatatagggactaaagttaagtccctggatccaaacaccacctaagttatatggatttgcaaagaaagaaagaccatacagtgaagtacatgattacgtagtatgcactcccttcgatgaggaatataagtcattttagtttttgacatggcctttgataactttgatcattaatttctttgatagtttatatcaatatattataaaattaacttcatatgaaatacgaatatagcgtcaccacatgtactatatatctacatgttttggcgtaattttaataaaaactaaaatccatgattagtctagaaaaaactactccctccgtttcaggttacaagacgttttgactttggttaaagtcaaactacttcaagtttgactaagtttatggaaaaacatagtaatatttataataccaaattagtttcattaaatcagtaattaaatatattttcatattaaatttgtcttgggttaaaaatgttattgtatttttctacgaacgtagtcaaacttgaagcagtttaactttgaccaaagtcaaaatattttataatttgaaatggaggtagtaaaatgcgcatatattatattttccagccgagggagttctaatgcggaatagagcagaaatactccagatgaattctataccataaaaaaagggggaaaaaaaggtggccaccctcaatcccccgggatttttgactatttgccatcttccccgatgccacactcccaaatgccatcttcccaaaaattctagataaattgccaccgggtccatatattagttgattctcagccatttttttcctttttatgtcaaatcagcattggatggggcgaaatccctattttgcccttacgtatagggagtgggagaaaaactctaatatttgcatcgctactttctccaggcttcgcatcgctcctcctcgtctgacttcgcgtcactccctgctctaggcgactccgctggcggtggccaaacaatgatacaatcccaagtaaaagaacagatcctttgtatttccctctttgatttggcatcaatttttttcatgatctttgcttctttttttagattgatctgtctagggtttggttttcagaaagatttgagggagccatggctccacccaattgcaagttttgttgtatgttccaagctgtgtttgcttgtgaaattgttgtgcattgaagttggtttcattttatttgctgtgagctgtgttaaatttgtactgaacgggtaggggtatcattgtcattttcttaaagtgtcatgaggtggctgctgatgtggcatcaagaatggaccaaaatggtaggaaatcaactaatgtgggggaccaatggcaattcagctacaattttttggaagatggcatttgggagcgtggcattggaaagatgtcaaatagtaaaaaaaaaaaaatccccaatccccctgc

SEQ ID NO: 25583 - DNA, 1501 bp, Oryza sativa
tgaacaatggtaaattcaactgaaaagactagctgcagcagttaggtaaggttgactaaattattgatctcatcctaacatattttgatgccggcagagaaagtgacgcgataagatgaactgacagagctaaataggcaaaatctgacctcaaaaaataatccaaatagtgtgtcagggatctttcgtgaaacctcccatgaagcatcaacctctactagtgctgtctgaggcaggtccagctctgaagataggcatttggaactgaaacaaaaaagaagcaaggagcagaaggtgcaaaagaatgcatctttggaacccatgccctcggtcctgcctgccgaacaacagtaggtcagtaaaaactgtaattcagaccattgctacttcgctagtagtcatatagaaatatagagtaagaaaaggagcagtaaaaagaagagtacggaatcgattgagttgttaaacagcaagaaatttaacagaaaacagtatgcatcattggattagacctactagaaaattgaaactgcagctgccgcaacagaagtccgctaccaaacactaacaaagggaactccaaagatcgtccgcagtcactactgaacccatgtaaagtttagtggaatcccacagaatctccgtcaaacaagatttttttttagaggaacaggggaagattccccatcatcatacatatattgatgaatttgatgatcagctaacaaaggtttgaaggttcataaaaagtgaaatgaagacgaatctatcatgcaatgaatcaagaacagaaggtaagcaaagtagtggccttctctcaggcatttcatcaaacatgtaaactgcacgacaacaggaacatgattaggggggctagagaaagaacttttcgacctgcggatcgaagtacgcctttgcctccaacacttggagacgagaggcaacagctacaagtgcgtgaacagaatttgtgaagcttcgatagtgttagcggagctcaggagggaatttagctgtgatgctgcttgcatccttaaataggcctgcgatgctatgaagtatgaacaagacaagtatgggcttgccggcaagctacatcacaacgtgacatctgtagcctgaattcctgacggatcttgtcatcttcgatcgagcggtggaaaggcggaacgggcaaccgctcggttgttgcttcccgggctagacatgaccgggatcgagaaaatacgaccgtatttccgtatttgtactagcacaaatcggaccaagttcgtctctttctagcttgaattattaattgtgcctagttatgtgaataaaattttttacatggatgaatttgggtggcaatgaaattattgaacgctgcaaaggacaagaggggaagaaaaagatgcaagtacgtgaccacataaacattaattatgcactcagaaatggcaaagacattcttaatgtatgcatactctatttgcctgtattaagtgcatccaacaatggc

SEQ ID NO: 25584 - DNA, 190 bp, Oryza sativa
gcccataggtgggagctggccccgtccaatctccctctcatcccacccccaatggcgacgccgccgcaccatctcctccaactccgaccatccactccctcccggcccttctccacctccgcctcgcctacagcagtggcaaccgactgtagagagtgtgcgtcgaccgcccgccccccgcccccgcagg

SEQ ID NO: 25585 - DNA, 1501 bp, Oryza sativa
tggacatatcactgtcttctctatgtttggcctttcgtttcttctaatggtatcgctgttttgatgccatctagtaatagcatctgcttgtccgatgcctatctttcttagttgacttctcatgcatactgtatcatcttctggccttatttgttcaacagacacacgacctgcactagtgtttacagctccaagtatgggttccagagaacccttcctgagtgccatcttcttcttcttcttcttgcttttgttctgcctcggctgcaagtgtatagcttcagagttacacttacacacgacccagactgcggtcctcaaggttgatgcctcactgcaacatgctcgacagatccccgacacgctatttggaatattttttgaggtaaaccgtaagatacatatagtaattttgttttgcacaattgcattatatcactttgtcctttcctctggcactttgttagcatgtctagaataagtcaggtagactacatgtttcactatgtcctgatggcaatttcttggctaatattgtaggaaatcaaccatgcaggagctggtggaatatgggctgaacttgttagtaacagaggtacttcaattattctttaatgcaagatatgcacttattttgttccatcgtccagataaaacataatttgcttctggatgaacatgaataacttattctgcaatccgatggaacacaaacacatggctttaaaaaaatccttttgttatttttttttgctgggccggcaaaaaccggcagagttgtatattaagaagaaaagaaagttttacaagtacaccctaagccaggggtggcttaggctacagtgaatcgtctcagcgatttagcctacagacaaacttaggctacagtgaatcgtctcagcgatttagccagcatcgatcgcgctcaacaggccggcggccttccatgtttcccactcatcagcgatggtagcacagaggtgtaccgccgatgtggtttttccatcaaacgcgtgcatttcgttccttccaaactaaccacgttaccaggataaccccggcgtcgaaggtcttccgatccgtcttatgaaccgatttgtgcgcctcgcaccaccagcacagtaggaaatccttttgttattgtctttactcgaaaattctccctactatcttattaactaaattatgtttttcccatgaacttaaaaaaagagtttaattttttttagcataactgtaattctgtaaacttggaacacaaaactttgattaggagcataaactggatgggatgcaaaataatatgccctttcatggaagctatattgacatgtagggcttagtataaccagcttatgagttttatgcacaggttttgaagctggaggccctcataccccatcaaacattgatccatggtccataattggagatgactcttccatatttgtggcgactgatcgaacgtcatgtttcagtcggaatactgttgctctaagga

SEQ ID NO: 25586 - DNA, 464 bp, Oryza sativa
tgtacttgtatgccattgaattggctggactgttgctcaattgagactggatcactggaggatttatgtattgtacgatggatggatgtattttggagtggacagcatgcttgctattaaacttaatgggttatattatatcactgttccaattatcacttgatttgctgattgtgcaatgtggctgcatggtttgtttatgtgcttttcaatcctaatttgtaaaaatctctggctgctatgttgctgccctgctgtctgactggatgcattggtgtgctcaatttgatactctaatgggtatgggtacccaatgggtacccgtcacccatgcgggtgtgggtatgggggaatttttcacccgtgagcgggtgtgggtattggagcgggcgtatttcatttcaatgggtgtgggtatggggtgggtgaacccaatgggtacgcacccgttgccatccctaccc

SEQ ID NO: 25587 - DNA, 1382 bp, Oryza sativa
ccgaccccaagcgggcggtctgaccggcgcataaggccggtctgaccggcggcacttgcccgatcagaccggccccctggaggccgagatgatgctgctcgggatggccgaaacagagccgacggagccgtagtcggtctgaccgagccgaggccggtctgactgcccactcaactccggtctgaccggccaggccgatggggccctctgacagcacttcaacggctagttttctagccattgcagagtagcacggtctgaccggccacatacctccggtcaaacaggcagagcacaaagttgggggatttcgcccccaacagctagttttggcgggtgggagtataaatactcccccaccagcagcaaggggactctcttggcacccaattcaattgcatacatcccttgcacctctctcacacccacttgagctttgtgttcatccatctagtgtgttaaagggttgattagccaagagtcaagtgcattgcttccatttgtagagctagtgtggcacttgattgatcatctccacgccgggtcattgcttgttactcttggaggttgccgcctcctagacggcttgtggaggagttgtccggtgacctctccgagaaaattgtggaggaggcccggcgccggtttgtgagtggtttggagttcaccaccttcggagtgaagaaagaactaccctagtgatcgaggcttgggtagtcctctccgtgggccggctcccgccttgcccaccccttgatgaagggggcgtgcggtggcttcgtggttgagcggtggagttgggctcgcctcaacgaggagtaggaaaccggcgagtttccgaacctcggtgaaaaatctcttgtctccttgtctcatttgattgtcgcatttacatttgtgcaaatttacttttctagcacctaagtagatatcatatcaccgtaggtttgctagccatcgacataggggtgtgctgtcctttctaagagatatagttgagccacaatcaccataggtgtgcaagacataagtaagttgattagttagagttgaccctcaccaagcctagcaacttaggttagttttgattaggtgtcatttagttttaaatcgcctattcaccccccctctagtcgacatctcgatcctacagggtggccgacgacgacgggtgcgcggagtggccgacgacgtcggttgccagatccccttccctctgccgcggggccgtcgccgtcgagggtcatcgccatcggagtggcggcggggtggccagatccggcatgggctttccggatctagcctcgggcagcaacggcggtggcttgctggcgaggtcagcgcccggtcgccctcctcccgctcccctctctccctccagc

SEQ ID NO: 25588 - DNA, 332 bp, Oryza sativa
ttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 25589 - DNA, 244 bp, Oryza sativa
  unsure (1)..(244): unsure at all n locations
agccactcgagcttctcaagcaccctaacttagcaccctcggtctcactcctccaggcacgctagccacgatgcagttaggcatgggctagctatagctaatagctaagctcgatcgatctcttcttctccctcctcctcctatccactgtccaaaagacggtgatcgatctgtctccgactgccgccgccnatgtcgtngtcgtcgtgcgcggcgggccccaggccacccgggctggtggcca

SEQ ID NO: 25590 - DNA, 1501 bp, Oryza sativa
cagaaaataataacagaacattttttttaccgagtttcctggtatcctaatccttttaaagaagctaccacttaactactcaggcaaatgagttttagacagccaatcgtagataaccataaaatatatattactctctgttcagtcagatgattaattttgcgtgcaacaatttactatttatgtaagtgtacttttggtactggaatgctgggaacgcacaggataccctaatttccatattactattacatatcccctccatacatataggtttcaaaacttttggacctaatttcaattagataagacttgaaggactttggcagaaactctaatctgcccatcactcccttacttttctctgcattgcttacaacagcttattattggtagagaaaatattcttcttaccccttatcctcccaacagtttaatttagttatataactcaaaacaaaaggtcccagtgcttaaattgaagaatatggaactgagggttctatctatatcacataaagtggaaaacttgaaactggagaaatgaccatccattagtttctggacacacttttcgccaccgtggtgagatgatgattactcatcagatcccaaacctacgcccaaaacgtcagtgatccaaccctaatcccgtctcctctccatcccccaggacagaaagatcacgggaaaccctcacaaaatccacaaattctacccacgaacagctcaatgtctaaacattcatcaaaagcaaagaaaccccccaactatttccacaaattctttcgataagccattatatttattacatacgaacgcacgaaatgaagccccccaattatttccacaaatattttcgatattccattatatttatttacatatgaacgcacggaatttttaccggccacggtgaagcttccacagctgcagttgccggagtcggggatgcagtagtcgcgcctccgctccctcaccacccacgccgccgccgccgccgccgccaggaacaccccccaaatcacggcctcacctcccagcccgcgagcaccggcggacggagcgccgccggccaccgtggcgcgcggcgggcgcgcgcgcgtgcggctaggctagggtttggagctcgcggggattgtgctcgtgctcgtgcagccgccgccgccggctagggtaagggaaggaagggggaggagaaaaaaaaatatagggaaaatactaataggtccctgcacaaatacagaaattacaatcctgtcctcctcaggtgggccggaattttacaatccggtccttctcgccccattcctgggctcgtgggctgaaatagcacgaaaatttcagtgagaaatccgaagccgtcttcctcctccccccacgccggcgacgacgaccaaccctagacccgccgcctcctccgccgccgccgccgccgccggccaccgcgagaggtaacgacctctcctcccgcatctccccctccctctccttcccacca

SEQ ID NO: 25591 - DNA, 259 bp, Oryza sativa
acggcaagtgattgtatacgactcctataggcgatttcgagctcggtacccaagaattttaaaccatagtacttcatagtaggaaaataggagtactactatcaacttgacccactctcattttattactgtaccgagatgtgaagagtaggaaaaataaatagtactccatcccttggatacttgagtattttggattggatttactcgcttttgcacgggcaaaatgatgatctgatgtgactccaaaattatcagt

SEQ ID NO: 25592 - DNA, 1501 bp, Oryza sativa
gcattgtattaagatagaggtcatgactaaggactggtaggggaatgctaggcatggcttgaccaaaataagtcaaggtgagtaggtgggtcatcctctcctaggggccaccacatggtagcctctgggaaggggatggtttccgcactccagttgtcttaccgcgagaacccattagcaccccgggaaggggtatatgtgttctcatggtaagtaaaacgggttgatgtgtatctatcgatgagctataccgacaacggtattagtatagtatggggaacactagtgctaaggtatacgtgagtttgcgataaggtagacgggagacagggatttgtatactagttcagaccctcgggatgagtaataaccctactctagtttatatgtatagttgttatccttggggaaacccaaacacttgctttgcatttcttgctcccaagcactcttgagcagatcaagttcacctagagcctctagtcaatcacagacatgtggtttcccacgtctgtctaagcccatctttccgacatattatacgttgatcattagtttacttatagtatacaatcaacaactacgaaactaacattatgaaaaagtttttttaatacaaatctaacgacatcacatacattatgctaagcttgtcctgtaatttaagtatcagctaaaagtaatatgaacaccttatattttgggggaaaatagagtaatatcttagtgttaagtttagtgttaagtggtaactcaaaattgaaaatatctattatacgtaccattataatactacaaaaatacatagagaatgatttcattatgatcaaatactatggtttttggtgtgaaaatgttagcagtgactaacaatgaacaaaatataaagtggaggttcatgggaaggatgttagcccttgggggagaatcaccatcaccactatgttctcttaaagtagtataaattttcatattgtgttttcaattaacttctcagaataatggtttgtaggaatcagaattgattgatttgatgtgaatatcttagtatttactaataaaaacaaaaaaaagaaattcattgagttttgcaattatttgctataaacatttttagaagtgtgtaatatgtttttcccaggttaaataaagtttcaccacttgactatcatattattactctctccggtttttaatgtttgatgccattgacttttggaaatatatttaaccactttcttatttaaaaagtatgcaattatcatttatttgttgtgatttgttttatcatcaaagatattttaaggatgatttttttcatatgtataaaaaaattggatgagatgaatgatccataagttaatggcatcaaaccaaaaaaaatgctactgggatgcaaatactggaagcagggaacccggagaactggcacgctggttaaaatatctctacccctggtaagtaaaactgaaagactacaatatttgttttaaatataata

SEQ ID NO: 25593 - DNA, 1501 bp, Oryza sativa
agctaatggcaaggggtatcccgattgtgcaaataaatcaatttaattacacaagtatagaataagaatttaatatttgggactgaaaataagatggcaattgtataaataaacaaaacaatatccgcaaaagttagcaaaataataattaaaaacttaaaccagtgacattggaactaacagaggccaaatcctcgtgctcttgctatttactggtttattgacctgtgctactgtgcataacttaattcaaggtatatgcataaacatcatagtagaagtgctttcatgatagagactagcccatgaaggtataacaacaaaaaggctcaacttccatgacagataaattctgaaggctatggagaagtgaggtttgcctagtggagttgcaacgacaatgaaatgatatacatagtcatccagatgaaacatgcttcacaaaataataagttccaccgtatgctggttatctatttaggagttataaagatgctcacctgcgcagctccataaccgctatcataagcaatttgtccaacaggaagactaggcgcgccatcatccttttgagcagtattagtattgtatagcatacctacacatagaaaatgtctcatggtgtggtttctatatatgctacccaaaaattgtggtaaaaaaaatggaacaacagataaacggcatgcctcctctgtcaatattagccgtgttcatcagctcagcacgaagcttgtctagctcagcgaccatggtgtcataattcctcttcatcacctgcagcgactcggagtgatccatcctgagtttcctttcgtactcatacgtagccctgagatttcgaccggtgcgcacgcagaaatcgatgtcagtcataaatcaagtaaattcataactaaaaggcacaaacgcggagcatttcatatcgcgcggcacctgaggtgctgatactcctgcctagcggcgtcgcgctcggccacgagcgcggggagctgctgcgcctcgccgaggttcctctgcaggtccttgctcagcttctgcgtgtcggcggccagctgctgcctcgcgacgacgaggccctgcgcctcggcgtgcgcctgctgcagctcggccttgacggggtcgcgggccttgaggtcggcctccatcttggcgaccttgtcgaggatccccctcgcctcctgctcctcggccgccatcgccgcctgcccctgcgcctgcagcctctgcgcctcctgctgcgccgcggcgagctccttccgcagcgagtcgtggctcatcgccagccggtcgttctccaccgccagcttctgcagctccccccgctgcgccatcagcttctgctccaggatctccggcggcggcgccgccgccgccagcatgtcgtacgggaacggccccggcatccccggtgcccccccgtacgggtcccggtgcatcatcttgtgcgccccccggtggtggtaaggcggcggcgccctccccttgctccccatggtgg

SEQ ID NO: 25594 - DNA, 376 bp, Oryza sativa
tgaaagtttggttgaaattggaatgatgtgacaaaaatattggaaatttatatgtgtatgaaagttttgatgtgatgaaaaattgaagtttgaagaaaaaatttgcaactaaacacggctttatatgaactagtgcctgcagaaacttcaatacaggggatgtgttcaccaaatcaataccaactcaatgcatatggtacgtccgtacatgaatgtactagactcctgcaggtggcattgcaataaatcaaagcaaacgaatctctttaattaatatgccaccaatactttcctttctgttctttaatttgcttctgttggtgttggatgggccaccaatccaccatacatgtgatatctggcaccctaaaaaaga

SEQ ID NO: 25595 - DNA, 1501 bp, Oryza sativa
cggcggcggcggctgcacgagcacgagcacaatccccgcgagctccaaaccctagcctagccgcacgcgcgcgcgcccgccgcgcgccacggtggccggcggcgctccgtccgccggtgctcgcgggctgggaggtgaggccgtgatttggggggtgttcctggcggcggcggcggcggcggcgtgggtggtgagggagcggaggcgcgactactgcatccccgactccggcaactgcagctgtggaagcttcaccgtggccggtaaaaattccgtgcgttcatatgtaaataaatataatggaatatcgaaaatatttgtggaaataattggggggcttcatttcgtgcgttcgtatgtaataaatataatggcttatcgaaagaatttgtggaaatagttggggggtttctttgcttttgatgaatgtttagacattgagctgttcgtgggtagaatttgtggattttgtgagggtttcccgtgatctttctgtcctgggggatggagaggagacgggattagggttggatcactgacgttttgggcgtaggtttgggatctgatgagtaatcatcatctcaccacggtggcgaaaagtgtgtccagaaactaatggatggtcatttctccagtttcaagttttccactttatgtgatatagatagaaccctcagttccatattcttcaatttaagcactgggaccttttgttttgagttatataactaaattaaactgttgggaggataaggggtaagaagaatattttctctaccaataataagctgttgtaagcaatgcagagaaaagtaagggagtgatgggcagattagagtttctgccaaagtccttcaagtcttatctaattgaaattaggtccaaaagttttgaaacctatatgtatggaggggatatgtaatagtaatatggaaattagggtatcctgtgcgttcccagcattccagtaccaaaagtacacttacataaatagtaaattgttgcacgcaaaattaatcatctgactgaacagagagtaatatatattttatggttatctacgattggctgtctaaaactcatttgcctgagtagttaagtggtagcttctttaaaaggattaggataccaggaaactcggtaaaaaaaatgttctgttattattttctgtctgtatctctgttaatatagtggtatagattatagtagtattattctagtgagactagataattcatgtgctggatgctgtttttatgtcctgccccatttgtttaaggatggcctgctgcttgtgtctctcaaaactctttaagtttttcactcggcaatatggtagcctgataatatcttgaacttgatgcactgcctttaactggtaaacaagtatcggctgcacaataagtactttcccatgtagattaacttgctgagcatacatccttaattctgcaaatcattaacactttcattgaacctcttcttaggaaagtgtaagtca

SEQ ID NO: 25596 - DNA, 1501 bp, Oryza sativa
aaccctctctctctcctcctcggcccaagccggcccagtcaagccgagccgcccacgtgcgctcgctgccgctgacaagtggggcccacctatcaggcctgtcgtctacctccggccggccgccgcccgaaccctagcgccgcgccgccgtcgtctctttccaaattcggccgcccctttccttttccggtgaaatcaatagaggggaaatgatcttcgggatctcctctaccttttctcttttggaatcgtcggctaaaatcgtttggaaatctgtggattcgatctcgaatcggattcgtctctctccccgaaccctagaccttccttcgccgtcgccggtcgccgtgggccttcgccgccgcctccttgcccctataaaaggacccccaagcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgtcggagcaccgccgtcgtcgtcaagccgaaggttgccgccgcttcttcctcgacgccgtcgccgtccgttgatcttccgccgccgttttggtcaccggtgagttcgccgcgtcattctctacgtgctggtgccctccgttcgcgtcgtcgcgccgtcgttcgccggcgagcttgtgcgcccgagccgctgccggtggtgacgtcaccgctgacgtcatcgttgccgtccgtcgtggtccggccgtggaccggttgatctcggccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagatcccaaacaaccctttgaacatgtttatcccgtttaaagctattgtttctattcaactattgcatttattttcgaatgccattgggtggaattaacctattgtttgttatagtccttttgttcttgattactttattccttgataccttggattattataacttgactagttgagctttatatattggttcagctagatattagatatgattgcttagccatgct

SEQ ID NO: 25597 - DNA, 1501 bp, Oryza sativa
tccctgtgaggagctgccactgccattgcctggttgggccaccactgtcgcctcctccctacaaggagcagctgcctggctgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttgtggtaacttccattcgaaattaatttactagctgaatttgattgcattaattacgaactctatacttatacaagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgaccaatagagggagcggtaactattctctcaacgaaatgtgcaaaggaattgatttccttccagtagcacagaaggaatttatccatacaaatatcatcatagagaaaagcagtacaaaatgatacacattgccatcagctg

SEQ ID NO: 25598 - DNA, 1501 bp, Oryza sativa
cgcaggcggccgtcgaggtggagatcggtcgcggcgcggaggagggcgaggggagcggcggatcgggggtggggaaacgcgataggcagggggattggggatttttttttttttactatttgacatctttccaatgccacgctcccaaatgccatcttccaaaaaattgtagctgaattgccattggtcccccacattagttgatttcctaccattttggtccattcttgatgccacatcagcagccacctcatgacactttaagaaaatgacaatgatacccctacccgttcagtacaaatttaacacagctcacagcaaataaaatgaaaccaacttcaatgcacaacaatttcacaagcaaacacagcttggaacatacaacaaaacttgcaattgggtggagccatggctccctcaaatctttctgaaaaccaaaccctagacagatcaatctaaaaaaagaagcaaagatcatgaaaaaaattgatgccaaatcaaagagggaaatacaaaggatctgttcttttacttgggattgtatcattgtttggccaccgccagcggagtcgcctagagcagggagtgacgcgaagtcagacgaggaggagcgatgcgaagcctggagaaagtagcgatgcaaatattagagtttttctcccactccctatacgtaagggcaaaatagggatttcgccccatccaatgctgatttgacataaaaaggaaaaaaatggctgagaatcaactaatatatggacccggtggcaatttatctagaatttttgggaagatggcatttgggagtgtggcatcggggaagatggcaaatagtcaaaaatcccgggggattgagggtggccacctttttttccccctttttttatggtatagaattcatctggagtatttctgctctattccgcattagaactccctcggctggaaaatataatatatgcgcattttactacctccatttcaaattataaaatattttgactttggtcaaagttaaactgcttcaagtttgactacgttcgtagaaaaatacaataacatttttaacccaagacaaatttaatatgaaaatatatttaattactgatttaatgaaactaatttggtattataaatattactatgtttttccataaacttagtcaaacttgaagtagtttgactttaaccaaagtcaaaacgtcttgtaacctgaaacggagggagtagttttttctagactaatcatggattttagtttttattaaaattacgccaaaacatgtagatatatagtacatgtggtgacgctatattcgtatttcatatgaagttaattttataatatattgatataaactatcaaagaaattaatgatcaaagttatcaaaggccatgtcaaaaactaaaatgacttatattcctcatcgaagggagtgcatactacgtaatcatgtacttcactgtatggtctttctttctttgcaaatccatataact

SEQ ID NO: 25599 - DNA, 1501 bp, Oryza sativa
aaggtaaatctcagcatccaagtgtgtcacctcatcatccactttaagttttattatttattgctttggtcaggtgtgatgtaatatgcattagtacatttgcttgtacattcttctttattgcattatattgtttgttacaacaatgtgtgcatttatgtcatttcgtaaaattcagcagattatgtatggaaggggacaaataatataatgtactcgcacatggaaatcatccagctggtacatgaagagaacaaacaaaatggagacacaaaaagtgagatattggttaagccattgttggatgcacttaatacaggcaaatagagtatgcatacattaagaatgtctttgccatttctgagtgcataattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacggaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgatagattcgtcttcatttcactttttatgaaccttcaaacctttgttagctgatcatcaaattcatcaatatatgtatgatgatggggaatcttcccctgttcctctaaaaaaaaatcttgtttgacggagattctgtgggattccactaaactttacatgggttcagtagtgactgcggacgatctttggagttccctttgttagtgtttggtagcggacttctgttgcggcagctgcagtttcaattttctagtaggtctaatccaatgatgcatactgttttctgttaaatttcttgctgtttaacaactcaatcgattccgtactcttctttttactgctccttttcttactctatatttctatatgactactagcgaagtagcaatggtctgaattacagtttttactgacctactgttgttcggcaggcaggaccgagggcatgggttccaaagatgcattcttttgcacc

SEQ ID NO: 25600 - DNA, 1501 bp, Oryza sativa
agaaccgatcctcttttgtattggtgtgctctgtttatgatttcaaaatgtgatcgatagctgaaatccctccctagcgtttccattgataactctcgtcgttaacgttattgccaaaaaccgatgaaagtcagataaattttgttaaaaagtttcaaattttttttaatctttggccaattatggttgaatacagccagctcgataaggaccacgacaaatatcgcatttgaatccaggctctactctgttgagatatttttgttttattttagacaccaatcatgctatagattagggcctcgtttagttcccaattttttctttcaaaaatatcacatcgaatctttggaaaggagcattaaatataaattaaaaaactaattgtactgtttgtatggaaatcgcgagacaaatttttgagtcattaacccatatgtactaatgacggattaattaggcttaataaactcgtctcgtggtttctaggtgagttatgaaattagttctttcattcgtgtctgaaaacccttttcgagtttcgatatttagtcaaacgtcaaacgtgacacctaaaaattttcttttcgcgactaaacacaccctaagcctagatagagccaggcagtgtgggggcacagagatgtctcagagccatagacagatgatccattccattcgatgattaaatactgtagctacggataatcaatcccacgtgtatgtcagtgggccccgcgggccgcacccaaccgccgcgccgaaccccgccgcggcaagcaactcccccgtccgtgccgccgcgcgcctccggcatccgatcaccatcaggcggccgcgcgacctcctctgcttgcgttgcgtgcctccccacgaggtcgaggtacacttcccttcaaagccactgtctctctctcctcctctcctctacttaacaccaaagcctcggtctgtgtctgtccgccccccaacgcctcgccggcgcccagcttctcttccttccttccttgttgaggtctgaggtcttggatggtggccttatggtgagcgattttggtgaaatcgtttactgctcccccctgcttgacttcttttgtttccaattttgtttctttggttatgcaaacgaccagttcgatgaaatgaccgagtagaaggcaattgattggtttttgtgtttgtttaccctgatgatgagatcatttgaaacctcagctttcctaatccttgccaaattgtctggcgtcaacgcttttgtgattttctaaacaaagcaaatgatttggttatcttgtaagcatggttttggacatatcactgtcttgtctatgtttgcctttcgtttcttctaatggtatcgctgttttcatgccatctagtaatagcatctacttgtccgatgcctatcttccttagttgacttctcatactgtatcatcttctggctttatttgttcaacagacacacggcctgcactagtgtttacagctccaagtatgg

SEQ ID NO: 25601 - DNA, 1501 bp, Oryza sativa
ctagtacttcttttcccacatatcagtacgtcaccgggaaaacatccttggctccttgcaacatgccagaatacactgcactatcattttcttacataacaaagctggtagcaaatcaaatttaataaaacacctcaccgtgctatatgcattagcggctacacactcgggatttgggactactgcaatttaagaaactactgcatgacaataaataatttgttggatatcatgagagagaattgtaacttctattagtaatgagtgaacagccatagtccttaaatatagagcaccacaaaagcaattaggaataacagaatatctcctccgttgaagcgttaaaaacttttcaagttatggggatttttaggaaagacttcatgaaccaccaggaccattctaaaaaagaaaagttagacaccaaggaagaacttggtgtcaatgattttaagaaggaagaggtaaatatttcccctggtgagcgtgctcgacaagggtcgaacccgggccgacggggtgcgtgccagtgacccctgccactgcgctacgagcgcatctccaccaggaccattctgatggtgcctaaaaggctaaaactagacttatccaaattagtttagtttgcagtcagggttactgggtacttgggtatcgagtaatatgcaaattaatatgcaactaggattcgagtatcgatttccacctaaactgtaaattccagcacatgtgttaaattagggcacaaccttcctgcagactgaagaatattgctaaaacaactgaacaaaataaataaaatgtatacataataagctaaaggttggaaggaacagtaagggcaaaaacttggcccaaatcagcaaactttcgcccaaagctcagcctttttcacgaatctccgagtagatctagaaaggacacataattaatagcgagcgtaccaacaaaaagatgggctgaagagcaggaagggatcaaaagaagggggctgctaattaatctccatgttagggttccataggtcgggtactcgagtgtgccgctcatctctaaatctccctaatacattatgggtttattattacctctagcatggcctgcagccgcgggttgctgagcgctgaagcatccatggctcctcccctcctcttccgctcttcttcttcttcttcttctctctctcctttacgattttcttccctcctctctcatttgcctcgtcggcggcttgcagaggaggaagaaagaagagaagaggccgtgggctcttttcgttaatgggctatgggcttcgtttagaaatcagatcgacaaaaatgggctatgggctttttttacattctggcccaataccgtttgcgaaagcggccctcaaccgcgtccgattgcctttccccgtgtcactgtcaaccggagccaacctaagcaaagtgaagagattaaagatttttggggaatctctactacttagaaaatatacaatcaaagcagatataca

SEQ ID NO: 25602 - DNA, 1501 bp, Oryza sativa
agattgttatattatgggactgagagagtagacaatacgtgttatctagagactcattcatataacagctgtgacaatcaaaggctctaaatattaaaccaccaaaataattttaattatttgtccttccttttgcccacatcacaaagaattttttaaaatcttaggcttaagaatcgtattgtatggctactaggctcataggcaatacacttcatctagagacatactacctccgtcccaaaataagtacagtcgtggatatccgtgcccaatgtttaaccgtccgtcttatttaaaaaatttatgaaaaaattgaaaatatttagtcacatataaagtactattcatgtttatcatctaatagcaataaaaatactaattataaaaaaattcaaataagacgaacggtcaaacgttaaacgtgaatagtgcaaaactgcacttattttgggacggatggagtagtcatcatacaagacaatcaaaacctctaaccatttagcctccaaaataattattaatcaactgtccttccttttacccaccctcacgtagcaaaattctttttatcagccttaagagtcgatttaagctcaatataaatatggagtcaaaatacaagttaattgttgttgtacatattctagtatattcttagggggtgtttggttcgagaagaaaaggggatacataaattaaacctaatggtagtgggaaatattgcgaccagagagcgagaggagtgatgcacaagggcattatacggcatatttctctttcctgaaaatgattcttaaaagtaagatttgtttttaggtacatgtgagatggggccactgtatgtctgtaggcagtgtaagtggcataacatatgcatgatgaatgattttgataaaaatattgaagaattttgttagtggccaattcaacaaactaataatgggcctcactgtagtctcttcggccctgggctctaagaaacagtagtgagtcttgtcggtggatggcccacaaaacaggttgggccagttgacctccatactgatacagcagaagtaacttctcaaaatctaagaactaacttgttgatagctagattttgagaatgtaaaagaaagaactgggtttttcagtttatacgttctagtctaagttctagattttataactaaagattttaagaatctaggtgaaaatcagcattatttggaagagttggagatttaagaagaagctatagctgctcctctaaacatggcctatacaactatgtttgacaatatactccctccatccaaaaaaaaaacggagagggtactttccaaaaaccataggccgtcgttgttgtgctagtacaaattcagtaaaaaaccataaattttctccacatttcaaacatggcctagcttaatttcccaattttctggtgcacgtgacgtaagcgatttcacagctttcatatctcgacatttcgtcaaacacatggtttgcaaatttc

SEQ ID NO: 25603 - DNA, 1501 bp, Oryza sativa
taccaaaattcaatagagttatatgattgataattgatcaccaaaaggtaagactacgcatgaaaagaactatataacatggtgttctctccacaaaagggcaaccatatttgtcctctatgatggttttcgaccattgctttccaatatagtattcgacaaaattataaaaattaaaaaaatagacgtacaaggatgcgccccaacatctaattaaatgatacgcatcgatccacgccgtaaacttttatatgcggcccaatataggttacactggcccagtacttagatcagtcggttctgtgtgcgcctatatatatgcatgtgatctaaagcatttgccgcatacggaagactcgaacgcataactagtctactatgttgccaacgccaccaaccttgatggtggctcctctctcttctttggtgtactcctcatcgtgtcgcacaagagaagagggctaatccccctaagcgcgtcttgttatagcggatagattcatgagatatcccgtggtggtggtggcggcggcggtggtactggaccgatccccatgggacgaaaagtctcttctaatcattatataatcctggcttactactcggcgcaacgcttatgaggtatgttttttacaggttaggggtgtctgtttgttgaattttgtcttccctagaaaactttgccgaatggcaacatctcatctgattccatattatcgggttgaggatggtgatttaagagatcctgcagttggttccgtgtgtcgtatatgtttatctatacttctaagtttcaacatatttttttgtatggtttaattttaattctttgtgatcacaggaagatgcaaggtacacatatgtgttcagttcagtggtgagtggtttccttcatctatgatttgattttgatggcccttgtggtttgtgtgggttgtgccatggctagttttgacaattaaccctggtggtacctctcttaatctctttgcctagtgattagggtcacattgatgaattccagtacaaaaatggatacataaaaatcgagaaacacacggagagagagagagagagagagagagagaggctacccctccctcctgcatctcgtgccatccgtctatagaaacaatcgcattatgctaaaacgctcgcgtccgtagtgtgtgtaaacccagccgccagccactgtcctcccgtgtttatcatttcatttccctttcaatccccccctcctcccccaatctcatcaagaagaagaaaaaaaaatatggagcaatcttgaatcgaatctggcacagatcctcactctcccgatcgatcgattctccgacgagcaagcagtggtaaccgaaggtatgtgtttgtagtcgcttggcagcaagatcgagcaatggtttgtccggcattgcttgttcttgtcttcgtcttcgtcttcgtctccggcgatgcggtgttgatttggagctgcattttttttcgttttggaggtcggtaa

SEQ ID NO: 25604 - DNA, 1501 bp, Oryza sativa
tctctctctctctctctccgtgtgtttctcgatttttatgtatccatttttgtactggaattcatcaatgtgaccctaatcactaggcaaagagattaagagaggtaccaccagggttaattgtcaaaactagccatggcacaacccacacaaaccacaagggccatcaaaatcaaatcatagatgaaggaaaccactcaccactgaactgaacacatatgtgtaccttgcatcttcctgtgatcacaaagaattaaaattaaaccatacaaaaaaatatgttgaaacttagaagtatagataaacatatacgacacacggaaccaactgcaggatctcttaaatcaccatcctcaacccgataatatggaatcagatgagatgttgccattcggcaaagttttctagggaagacaaaattcaacaaacagacacccctaacctgtaaaaaacatacctcataagcgttgcgccgagtagtaagccaggattatataatgattagaagagacttttcgtcccatggggatcggtccagtaccaccgccgccgccaccaccaccacgggatatctcatgaatctatccgctataacaagacgcgcttagggggattagccctcttctcttgtgcgacacgatgaggagtacaccaaagaagagagaggagccaccatcaaggttggtggcgttggcaacatagtagactagttatgcgttcgagtcttccgtatgcggcaaatgctttagatcacatgcatatatataggcgcacacagaaccgactgatctaagtactgggccagtgtaacctatattgggccgcatataaaagtttacggcgtggatcgatgcgtatcatttaattagatgttggggcgcatccttgtacgtctatttttttaatttttataattttgtcgaatactatattggaaagcaatggtcgaaaaccatcatagaggacaaatatggttgcccttttgtggagagaacaccatgttatatagttcttttcatgcgtagtcttaccttttggtgatcaattatcaatcatataactctattgaattttggtaaaaaaacaactttatttgaatttcaatcatgttactaaaacaaagaaaaatatagctctatgcttaaaaaaatatcaatgcaatagaccaatagtacaggctacagggcatttgtgtcattttgcaagaaggcatattaattaaattaaatcaaacactatataaatgcactattttattcctcaacagtttgatgttagccataaattcttgagcctgtatcttcatatagccatacgtttcattcattactgagtagatatattcatccacccctttgaaaacccaagcaaaaaccgtgtttcatcgcaaaaaaccaaaacaaaattactccagtaggagcaaaaaagaaaaaacaaaattactccagcaggaagcatgaggtttgccgttttgtccctttctgttactttttttattttt

SEQ ID NO: 25605 - DNA, 1501 bp, Oryza sativa
aaaatagtttgtgtgtttgcacactctgataattagatttgcttgaggagcaccttaagtagtagtattccacatagtgctaagtgctgatctatcctattgaattgcctgctatattgttttgagaatgaattatatgtttatgattatgctttagtaaaatttctcacttgagttgcattgttcagggaggagtgaccggagggaatgcaagacccaagaggtatgccacgagatgaattcgcaaccccgaagacgcacaagagaaaggtcgtttcccgccccttgcctcccagccaaataaaagctgaacctgagctgctgcggagggaggttccactcacatccggcaagaccaagaaagcccctaagataaccttcaagaatgaacctcgccattcggctccgcaatctgattggggaacccccgattcggtgccagagttcggtccagctgatgaatacagagcgttacggaagaagtacctgctgctggaggatgagaacggtgagctggacaagcaattgagccaggctgaagaggaagccagcgttctcgaggatgaaaagtttgcgctgctggatcagcttgttgtgttggaaggccttgtggatccttcacagatgcagccaccgagaaggctgtgagattctatgcgtgttcgttgcctgttcatagtccaattaagttacctgttactgcttcctgctagatatgtaaccaattgtaatggaagagcaaagacatattatatcgtttattatggaagtttgaacatttagagcacttgtttggagttctttttgtgcaatatgaaagagtgctatcagtttaactgaaatttaatcgtggcaaaacagaaagttcagcaagcatgaagctttgcgcctttgcctcaagtttgagttatgcttttaagaactacgcaactggtcttggggaaaaaagctgaacaatttgtgtttcatgtgatttaagaaactaaatctgttcatgtgaagatcaactgatcatcacaaacttctgcgtaatgtttgcacaaacacatatactccagcattaacataaaaaaaacaaaactcattcatcacggcgaattgacgggccacaattttaacagtatgatttctcaaaaatctttctacaatagcattgtttcgataaccttttctaaccaaataattaattaacttcataatctacagtatattgaattaatctatgaatttatcggctaattagctgacaagctgaacagggctgagactgaatttcttcatagtgactctgccgtgtgagtgctgacgcaatcaagatccaacaattttaggcccacataaactttccaagcccaactcatgaaaagcccaattctttttcaccttatataaacccgagcagcagcagcatccgcctcagctcaacggtcaaaaatctcttccaatttgaatatctctcctcccaaacggtcggctccggagcggcgcccggacgaacaca

SEQ ID NO: 25606 - DNA, 1501 bp, Oryza sativa
gatagaaaatacctcctaccaagagcttataagaggcagaaataactacaaaagatatcagtctacataagtacataacatggaaaaaggaaattagacatctaaaaaagcaacttttaatctttgggattgaccacctcggctgccacgataacctatgtcttccaattccttaatggtttccatgttcttataaacatttccccaacatctcctattccatgttcttatcaaacattttcccaacatctcctatacataaacagaagacatgtatctgttggcattcattcaagacaaatatgccaattatgattggttctaataggcccatatgcctacgagcccaacaacagtaacattttatcgtcaaatcactatcatgagatcattagactacaataataggaccaaagatggcctcccttagtaaattataaaaaaatatgaagtgctattccactcaaacacccatgtcaaaaaaaaaattaccaaattaaacacctgaatccaaattgaatcatgtccatttctaattagtaatatgcatgtttaattgccaaatcgaacacctaaatccaagtgttgatttctaacgaaggtgcccatgtccaagtagccttaaaagttaaaattaaatggtatgtactcttacataaaacctataagctacaaaattatgcagcaagccatactatgctgctatttgatcaaatgcacatgttggaagagcaaacaacatcctctctacatgatgttagccttccaaaacggaagtcttcgtacgcaaacaaaggacagtcactttcacatcatactatctaaaaagttggtggaaatgtagaaaaaaagatgcataaatctattatataaaaccaatagcatagagacaaagacaatcacactggctagtataggcataaaaggattcaccgaacaattgcaaaaaaaaaaaaggtggtgatgattgtaagcagcaatggtggcaacaattagcaagatggtgatgaaaagaagactaagatagtcaagtcacaacaaaggcaacaaatcagaagaaggctaaaaaaagaggactcaagtgaaaaactgaatcgatgataacaggccatgataaatgcggcagaagagtggagattgaactcggtccaagatggactgtgatcaacctaaaagaagaacgagcatggtacacatcattagatcagataagaatggcaagtgccaaaccaaggaaataatcaccaaatgttctaaatttggaatggcttcaaaaaaaaatagaaggccatgtaactttgattaaactaaaaaaatcctttaaacataaaaatccaaaggatgtagaataaggtcaatggagaaaagctgagaatgtgatatcatgagggaaagcaagtgatacaagtctgcccatgaaacagtaactcgacagcacaagatgcagcaaggaaacctgaatggtcattgcaatgaggctagaaacaccaacacaagataa

SEQ ID NO: 25607 - DNA, 1236 bp, Oryza sativa
aattatatatggtgattaattgctgcgcgttagattttacatgccaatatgctagtctgcaacaaacaatccatccctaaaaaaagaaaaaaacaatgaaagaatcttaaagcggaattgctaggcctcttggctgttactaagtaattcattatctgataaaaaagcaaaagcatgaacttagcctctaatatccatttatttgtaaccacagatttacctcgccactataatttcgattcctaaaatcttagcatgttatatactccatcggtctcaaaataagttatttctggagttcaaaatttgtcccaaaatatgctgatttctatccatatttttatactgggtccacaaatagggcatttctatctattcaataccatttacctacctaccgtattaattctcttcatactaatttgaatcccgattgataggaatcaatttattatgagaccaagggagtacatcttgtgttccgccggtgataaatggtagacgaaaaatactatattgtccaaatatagatatgttgatatgatttgttatccatggaaaatgattgaaatttccatgtattgtcatgctaaatttctactatcatcgtcagtcggtatgtaaggaatgttgccccctgcatgtttaaatcctggctctgccactgactcgtagttggaactgataaggttgaggggctattcagttgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttgttcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattgtttcttgtgccctaccttctatgtccaactacccaatagttatagatgggtcaccttttttcctttgatactccagaca

SEQ ID NO: 25608 - DNA, 1501 bp, Oryza sativa
accacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggacttgcccgctgccttgcgaggagtgggggtgaaacctgaggtgtggtgtgcttggtcagagggggttatgcgaatggtcctgtcacggcctctttccggtatgtcgtggtggcatgtcggcgcacggaaatgtgtcgtggggctgtgtcttgtgggtacagttgtacatctctgatcagagtaaaactattcgaatagccatgcctgcggttatgggcggtcaaccagattcaccgtgattagtctcaccctagtgtaatcttttgaaattggatagtttaagtggatggttgggcctgtcgcaacgtgggatagcgttggacagtggatagttaatattaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattatagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgta

SEQ ID NO: 25609 - DNA, 218 bp, Oryza sativa
actattcgtcttattcaaaaaatttatgtaattataatttattttgttatgagttgttttatcactcatagtactttaaatgtgatttatatcttatacatttgcataaaatttttaaataagacgaatggtcaaacatgtgagaaaaagtcaacggcgtcatctattaaaaaatggagggagtatataattagaaagaagattgctttggttggcta

SEQ ID NO: 25610 - DNA, 1501 bp, Oryza sativa
attgtcaaaggtgacataatctttaccctgcaatattcatccatcatctcatataactccaagcattcagatttgtaaggtgcatttataaatttcgtgaaggaacctatcaaagttcatccatcagcttgttacagttcttataagtgatagttttgtgttgaacatgtgacggttttccgattgcaaaaaaacagagagaacttgcaaaaagcaagttgaattttcattaaaaaacgagttcagtggttgggagtatagaagaaaacaaagcttaaaatgtaaatgtaattgcagggaatgaaattgtggtgtaagcattgaaactgcaagcaatgcactgattaacttgactattacatgtaagtctgttctagctcaatcactaactgcatcccctttactgaccaaaactatagtcaaccttgagcaggatgagcacatccacaaacccatggaagatgtgctccaacacagaagaccataagcaagagctatgtaatttgccttcaattcagtgagtcccagtttcagtgagcaaaatccatcagataagcaagacaacatgaaaaggctacagaaaacaagaaaacttctgaaccactcacctcttgtcaacatgattagttttgttcctaaccagcacaattatagaaatcactgcccctctcagttctgaattcctctatccattttgaagtgtttaggaaatattgcctggctacagcatgtaaactaaatttaaggaaaagggcctcaggacaagaaggagcatttataatgcaaactatcaaaaatcacaattttgtgttcatgtgccatcaaatttgcttggcaacaatctctgccggtctggttcatccttgctagtttatatggcaccttagatactataacatgtgctaaagagtgaatcacaataagagcataccttcagtaccactccggaccaacaacctcttctcgggtgccaacaaggtcctcaacgccggttgctcagcatgtctgaatgcagaggaggaactgagaagctattcgatttactcattgctatcagctatcaacttgcatgtgtatctccatgccaccgcaatctattatacagtaaaaagttcagtgcatcgctaaataaaaataaaaatacttcaatctacatgtttaatttttatctaagggttatttttcaaagctactaacagtaattaataagttgttatctgcagttctaggaaatgattggtatgttaatgggcgaaatcgagtaaagttaaatggatttgcaaattgatctaaaataagattattaaaacagattattccatgataataactgtactgccagtaaagataattaaaacaacagcagtagcaggaagttccacgcccaatctaatttcaaaatgactgtaagaattcaagcatgaagataaataatggctgtcaaaatctgatatgatggcagtgatgtatataagtaaatttgatatgtcggcagtgattt

SEQ ID NO: 25611 - DNA, 1501 bp, Oryza sativa
tttgctgggacaaatgcatcactgggagcattggaagcagcttcagcaacagcgaagcctcgtgtctgtccaactgcgcgaaacgctttttcgaactgaagatgctcatcgtgcaacgagttagcagccctaggtgaaaattcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgc

SEQ ID NO: 25612 - DNA, 1501 bp, Oryza sativa
ccctaggtgaaaattcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcaccatggagaactcggaagatgaagcagagagtgacaaactacccttagacttggagccattgcgctcattagcaccaaagtttcctactattttgggatatgatgt

SEQ ID NO: 25613 - DNA, 1501 bp, Oryza sativa
attcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcaccatggagaactcggaagatgaagcagagagtgacaaactacccttagacttggagccattgcgctcattagcaccaaagtttcctactattttgggatatgatgtggaaactcaatc

SEQ ID NO: 25614 - DNA, 1501 bp, Oryza sativa
gatttcatcatgctcaaatgtgggcagtaggacatatatgcatcattggaattaggtatgttctgaagacgtacaggaaggtcccataccataattctctacacaacagagaatacagcttggcaccattgatcaagtggacagacttgttcctgaaaaatggaggagaaggtggcacaagcaagtagcagacagatgatgaacagaagagtcaattggagaagagtgcttctcaatccaacctcccatgtagatccaagaaacttcctctcatccctaaatttccttcttcttctgtgctttgtgttgtgcacaagtcactgaatctctgaattttgactttctcccccacactacttcaccttttcttcaagatgtccatgtcagtgaacaaaaaccggtcaccatcttagcaattagacgaatctccatcaacctaagagacgcataagacgttttgtcaagtcaattcatatctaatcctgtccactaaaggacctacttaaaatgcttagttagttggtcatggtggtccttaactaaatggcacacacgagtcaccaaactgaatgctctgcagttgccttttggtactggcaaatagcacaagaggacaagataagatatggctttttccaagtgaaaatattccagcactagcaacagaaataacaaccaaaactagctactagatcatgcttaatgtgccaacgtgctcaacatgaccatttctatggaaataataatataataaataataagttcaaaaggctcaatgcttctctgagaaaccaacttaactacgagtgcaaatttatctacttacctgaaaaatgataagcaaaaatcactgagagtatctactgattaacaattcaatgtagtcctctcatgccactaatatgttcaaccaaagttaattgcttgctaatttaatcatcatgcaaaaaaggtacaattgctgtacagaatagaaagtggtaccaatatttcaatttctcaaagatattaatttattataccagtgccgcgctagttcctgtgcatgacgtttttcttcaagaatggtattttttttatcacgtctctatatccaaccggatatatacaacattttaagtcaagaatttagtccctcagataacccaatctaaaattcacttctatagagatagaaactcagaactttgggatactaggtcgctgcaaaccactagaccaaatactctttcgctcatgtgcatgacttgtttaacaaaaaaggtaaattgtttgcaagtgaacaatatgcataaacaagcaaaagagtacacgccctagtaatatatttgagatcaagaaagcaaagtacatgtaaagtaattaacaagacaaaataaaaaagagaaacttcctctcaacaaaaaaaaaaggaaaaaaagaaaaagataaacttttgctcatctcctctcctccatataagtacgtaccatccaaagccgtgataccaaagcttttccat

SEQ ID NO: 25615 - DNA, 1501 bp, Oryza sativa
gattcagtttttcacttgagtcctctttttttagccttcttctgatttgttgcctttgttgtgacttgactatcttagtcttcttttcatcaccatcttgctaattgttgccaccattgctgcttacaatcatcaccaccttttttttttttgcaattgttcggtgaatccttttatgcctatactagccagtgtgattgtctttgtctctatgctattggttttatataatagatttatgcatctttttttctacatttccaccaactttttagatagtatgatgtgaaagtgactgtcctttgtttgcgtacgaagacttccgttttggaaggctaacatcatgtagagaggatgttgtttgctcttccaacatgtgcatttgatcaaatagcagcatagtatggcttgctgcataattttgtagcttataggttttatgtaagagtacataccatttaattttaacttttaaggctacttggacatgggcaccttcgttagaaatcaacacttggatttaggtgttcgatttggcaattaaacatgcatattactaattagaaatggacatgattcaatttggattcaggtgtttaatttggtaattttttttttgacatgggtgtttgagtggaatagcacttcatatttttttataatttactaagggaggccatctttggtcctattattgtagtctaatgatctcatgatagtgatttgacgataaaatgttactgttgttgggctcgtaggcatatgggcctattagaaccaatcataattggcatatttgtcttgaatgaatgccaacagatacatgtcttctgtttatgtataggagatgttgggaaaatgtttgataagaacatggaataggagatgttggggaaatgtttataagaacatggaaaccattaaggaattggaagacataggttatcgtggcagccgaggtggtcaatcccaaagattaaaagttgcttttttagatgtctaatttcctttttccatgttatgtacttatgtagactgatatcttttgtagttatttctgcctcttataagctcttggtaggaggtattttctatcagggccccatgtttgagatagaacaatcaacaaagtagtactcccgcaaagtctatagtttctctccccatgtgcttctctccttcaagccaatattgtatgatctccacctagtacttaccatgttatgagccaaggctcaagtcagattaccgagtatccatattagaggagagtgtagattgtatacccattttctgtttctatctcattttgatgatctcttgtaccggtatattggctagggtcctagttggctatatatatcacaactgcccccctccccaaccctgcaacaggtgtgagccgttttccctaattctatctttctacatggtattagattcagagttcttaccttttccggtgccctagcgctgctgcgtcctcttggccatgcgatct

SEQ ID NO: 25616 - DNA, 1501 bp, Oryza sativa
acaaaacctgaatgtccaaatcttcagagggcagaagtagccatactatattactagtgaaggacatcaactatatgtctatatattcaactaagaaaaaacattgcaaagggcaggtaaggccatgagaagagagaaaaaaaagagagagaaatccatcctacacagcatgacaactgacaagtggtttctccaggtgataatgtattaaagaagcacaatggctgccagcttgggcccacaccaagtgtgttgtgtacttgtgtactacctctagatcacataattttaatatatttttttcacaaaaaaataacttcagagtgacaggttgcagctttgctgctatataagaggccatccatggccaagcagtagaccacagctagctatcttctgcacattttcagttcagtttcagtttcaggtcagtgaaactgaaaagagatgtagcttcttcttcttcttctccatcatcatcttcttcttcttgcgtaatgacacatcaggtgatcagcatcagctgccggccggcgaccggccgccggggacggcgggtgcggcatgtccggctgggctcggtgctccggctgcgggtgaggctgttcggcgtcgtcgggctgctgctccggtgcctggaggagctcaattgctgcccgaggaggtggtcgccggcgacggcggcggcggcggcgaccaccgtgatgagggcacagcggctgagccaggactgccggcgccggcggctggcggcgccggcggaggccggcggcgagagctctttccaggcggaggccattgccgactgcttggagttcatcaagagatcatacctgcagcctactacagcatcagcttgctagtgaattttcatcgattaattagtggatcaactaatattgacgtgcaatccttttgcgcgttcgcaaaaaattagtggatcaattaagttacgaagttcactcatcctgtgatgtgcagtagcttaaattaatctgtatatctcagttttgctagcttttgttgcgtaatgctttccatcaagaatgtacaaaaatgatgttaattttgatgaataaaattacatagtaatataattatgtttgctggtagtgatggcctactggccatgttggaaagaaagatagatgtcaatttcttgggggtcttgaaaattgcgtgttgatgcatggttaggcggtgattttcaacttaggaattaggtgatgtttttgtcatggattgtgacttcgaaggtatcaaagattagtttgacaaaagagtggttgggcccttgcatggtacaaaacaaaaagtagaggatgatggcttctagtgacatacatgatacatgtttatcagcattgaccattgttgttattatatcatgggtgattcttgattggctatgaggaacccactccttatttttgtggtgatgggcggtacatatactacatccctcaaactagggatgtcaacgagccgagcttaggcaaac

SEQ ID NO: 25617 - DNA, 1501 bp, Oryza sativa
tatagatattaccatatttatctacaaatttagttaaaattgaagtggtttgactttgaccaaaattaaaattactaatagtttgaaacggagggagcacgactttcaatataccttcctttttcgttaattttagggaaccagctccccaagtgccaaagagttcaaaaccatctatcctaaagcttaggaaagcaacacgcagaaaccccacgcagtaagaatactttaacttattatgttaccacaggttctgtttctttgtcagtttttttttaatcacacttttttttttaacagggaagctgaactgctaatggaaaaatccgctgcacaacttcccttttaagcagcctttgttaagcagtattcatatggtgcaatgctgcatttcttttactgacttgtttgaacgatgcgacattttgccaaaataagctttaaacctctaaagcttagacaagaagcagagccttattaggctttgctttgagagtttgaatgttgtaatcttgtactctggtttgactataactcctcgatgtggattgcggtgaccttcggtattatcaaaaagcaataagaagttcttaatttggttgcatatgctcatgttagtggtgatctgatcatttgctaaattttagtggagctatggtttttttttcttttcctgaatcgacatacaaacaaactaaacttggaattgaataatcctaaaagtattttgtttcaaataaataatcataaatgaaatagattctccaaataattcacactgtttttttttaaatattaatcccatcaggtcacaaacaccaaaacgtgattgaaaactgtcatgcaagtgggcccaagatcacgtattttagttacaaccttgttttgccgacatggcgaaaacatgtttgccatggaactaaaaatgcttaaattttgttcatgtctcatcaaggtccccattgccagcataaagtgcaggacatgacgaaatcacatagcaatagttgccatttttcagattcaatttccagaaggatagtgatgcaacagaggtgtgaggctgagagtgatcagacaaagtctcaacctcacaaaacaaaggcacaaaaatattcagaattcccaactcacaagtacaaggttggtaaacatctgagcaaaatcatattgttgagctcttaatcctcactattgtaatctccattttgtcgaattaacaatgcgcgaaaccattaggggcacgcagatttaacatcgtctgatagacaactccatccacaaaacctgaatgtccaaatcttcagagggcagaagtagccatactatattactagtgaaggacatcaactatatgtctatatattcaactaagaaaaaacattgcaaagggcaggtaaggccatgagaagagagaaaaaaaagagagagaaatccatcctacacagcatgacaactgacaagtggtttctccaggtgataatgtattaaagaagcacaa

SEQ ID NO: 25618 - DNA, 1501 bp, Oryza sativa
cgccgccgccgtcgtgctctccttcctcgcctactgcctgcattgatgacgaggagagagagagtgagagagagggtgtctcacgtgggagaaggcggcgcggctggtttatttgtgtttttttttaaaaatatatgatctaattcgttggctaatttgattgtttttggtttatattttaaatctacgtgtttgtgaattgtggttgaatatatatatatatatatatatatatatatatatatatatatatatatatatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttccc

SEQ ID NO: 25619 - DNA, 1501 bp, Oryza sativa
aaactaatgaagagctattttttcacgaataatatagcatttttttaaaaaatataataagaattacggagcgatttcagcctaaacaaataagagctatttttttcacaaattatatagcatttttttaaaaatataataaggattacggagctaggtatagggtttcaaccctagttgctccatgtttgttttccgccccagtgcgcagataattgttacctagctctacatattttgtttaaatagcatagagtatagagcagatgatggacacaagtcgtctgcagtactgcaggctgacatgtgggcccacagccctcgggcccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacccagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccaga

SEQ ID NO: 25620 - DNA, 333 bp, Oryza sativa
aaatttgaaaaccctaactacctgaaatgagcatgtcacaatcacaacataacagtagcggtaccaaagcagacagcaacactactcgcagaatcatcttaacatagcataacacttgcagtatggatcatcttaacaacataaatataactcaacataggtaacaggcaaaaccatattccagagactagagtagagtcttaaacatttcaatcacatccatttcacaatgtcaaaaaggcaaggttcagggctaagttttaaaagactaaacttgaaagtaatgcagtagctagatagatgtagaacaagccaagtagctccattgatagg

SEQ ID NO: 25621 - DNA, 309 bp, Oryza sativa
aaatacatacgattgttgtgattaaaattttacattgtaaacaaataaataatactgctccagtattttcgagtaattgatgaacggattaacggtggcacgttgtcaagcttttaaattgtgcggcttttaaaactttctatataaaaattcttctgatattgttttaattttttatggtaatattgttttaaatttattttaactttataattaattcattcatccatatccttatataaatattaaaaaatcatgaatttgctgtttagtgtatatccaagtactgcttagtactagtatttgtta

SEQ ID NO: 25622 - DNA, 1501 bp, Oryza sativa; identical to SEQ ID NO: 25488

SEQ ID NO: 25623 - DNA, 1501 bp, Oryza sativa
cacatcaaagtgacagtttttgcactcaaaacaagacttgttatctatatgttccagatatagcaatggaaggccattactccattagaatgatcacataaaggccgtgcatccaacagacggattgtaggcactgttgtagtgctctgcacggcttctaaaaccctacaaacttatgcaatgttgcaaaccaagaaaagatgctgagctgattcaggttgatacaaaaatgcacaagtcaagtcatgagggctttttttttaaactttgaacgtttatttagtcaaaaccacattgtggaagaaaaaccacgattttcaaaaggatcttgcaattagagtccgcatcaaaagttcaaaaccgaggagaaattagagtccacatcagccatgcatagcaaaaaagacatggattttaacagtgcgtcttccaaatttctcaaggacacaagaaaatatttgatttgtatatcattgaagggactgtcctcaaaccatcaaggttccgtttggtccacagaatagaattctgtatatcatcctctttaagctaataattgattgatataaacctacaacatcatcgaaaacatggcatgctaatatacatgacattgaactgaagtggagtgatactgtaatatggacatatttaaaaactaaactacaaaactaggatgaaaacaaggtttcaatgataattaagcaaaattcgatatgcccaaacttacaaagtaagctcaacaagtacaatgctaacatatctatgcacatgttcaattacaaaacatttgtatactatcctaacacattctacacaaacaaaaagcgcttttacatccactattgccaaacaggatctacgaaaccactaacaacccaacgcacattgactaatacgagaacaactaaatgaatagaactccgaataaaaaaatcatcaataaaacaatggcagaaaaaacgcaaaacattgtgatctgtttgttgttttggtgaacccgcgcggccatcatcgcacgcgctccgaccgcgggcagtcgtcatcgctcaccgccggcgagcgccacggataccaaacccgcctctttccccgaacaaagcgcgccaccttcccgccaaccgtacgaggacagcggtggcggcgcgaatgccggagaggcgactccggcagccgcggcgccgccggacggcaagctcagataagatcaagtagtgttcgtgagggtcgaaaccctagctcgccgcctcctcccccacggcctttttacaagcgaaaaacgcgcccaccaaatgggctcgcgaaggcccaactaattctagcccagcccataatggcccactaactatcccccatggcccactagagctaaaccctaatcccctcgctataaaatcgctctctcgaagcgatctctccccttcgccgccgcctctctcccgcaccaagctgcctgagccctagccgccgccgccgccgccgcgcgccaccaccgcaacca

SEQ ID NO: 25624 - DNA, 1501 bp, Oryza sativa
ggaaaaaacagtctcaggcatttaattttccatgtacagtacagaaatgataccctcaatgttgaagatgaacatgtggaggtacagaaatactgatcagagtgaatgctgccctttgcaacatcagatcattgaccattcactacaaaattaagttccatcgctaaaattgcagtatccaatgaatagacacccaaaagtgtgaagtagcctcacggtaaagaaagtatgctctacagccccctgaagaaatgtggttcatgtctactttcattatttagaatttggcacacttcgtgtggaacgagactttcttggagaatatgtggagtaatgttcagcatgcggccactacattgaaatttctccagcaaattgccctttatgtcgtagtgaaactgccaatcaaatccatcaaccaagacatcaccctcttgagaaacaatatgaagataccaaccatcatcttcttcaaaacggcgaatctctataactggcaattcaattcgatacttgtggacccataccatatgcttataatcttgcagaagccaaagatccacctttgatgatccaatatggctgtttgacatggcaaggctaccctcaatctcgagtaatgacgacatattgtgcatcttgaaaggtacatgcaaccaccgaaacacctcatcgagagtgtcgaacaccactatcttgttctgtccacctaagtgcggcagccagtgcaggtttccatgaaacaggaaaggctcgttgaactgagtttcctccttccctttcgccaaccactttctcagggatgctgacgatgaatggggccaaatgctcctctccttccctgagccaacaatgctgatgtagaattcagggcccaaaccaatttctcgataatacaatactcggtattcagaagaatggccatgagaatagagccccaggacggtgtcatgttgaagcgccggcgggaagacccaaagccattgacgtgtagtaggattgcagagatgcaaatagttgttgtaggacatgagaaggagaccatcgcaagaagcgtggacggtgaatgggctgtcttcgagtgagcagtcgtaatcttggccagtgaaccgggccagagactggaactggtgtgtgcggaagtcaacggcttcaacacagtagtccaggatatccaggtcatcgtggcgactgcccacgtcgcggatgaaggtgaggaggcgctgcggaggctggcggcagtggtggggaaggaggaaggcgcggtcggaggtgacgtcccgccagactttgcagacggcacggcactggaggatggattttggcggtagcaggagcagaatctccgacagaatttcttcagggaggttggcaatggtgagaggcctacgacgctgctgttcgggcagcctcaccatctccgccattgcaattgagcccccagctgacaatttggactaggaccctagtgctgctgcatccttggctccttgccgctctg

SEQ ID NO: 25625 - DNA, 471 bp, Oryza sativa
aagttgggggagtggcgcgcgaggccggttgtgaggagaagaccgtggagctgcgcgaagaggcgcgccgggagcgggagcgggagcgcgtcgcggcggcggagcgcgggcagcgggtcggccgcgcggcgggcgagtgctgcctccgctgcggctgcggctgcggttgctgggcccatgtgcacctgggctgctacggggagagaaacattcgtcatagttcacttttgattggaccagtctttgggccgtaagtaagcccagttaaatattggaataagtttaatatgcctccctcaactcatgccgctgcttgaatcgcatcgctcaaccacaagagtatatgtacacacactgcttgactatactgcctcctctcctgtttacaatgcatgttacaattctggctctgggtcgtcatggtaatagtacctgttcctgttggattccatcactccgtgcctccgtaga

SEQ ID NO: 25626 - DNA, 1501 bp, Oryza sativa
tccaacaacataccaaactcttgtaatatgatcacttgaggttgaagcaaaattaaattacgtttcaacacctagctagctaacatgtacagccactcttgttgattaccatgccacatttaatgaggcaactaaaagatcgttttgcttcagaaaaaaatagtttgatgccaaatccccatctatatatgaatttcttttttaaaagatttttctacaagtaaaatatatgattggtccttaaacttgagcggagttgtcacttaggtcaactaaaatttcaaaattgcatgtttaaattcatcatcttggtttaatgaactacgataggtccaaaactcgtttgacgagagcttactgatgacatggcgctccatgtaggcaacaattttgtatccgctctcttccgcatcatagtgtggccccctcttaccccaaagcacccccaaatgctctaaatctctatctccattgtcttctccccgatggctagagttatgacagcgagggtaatgtcgcacactcacttgccactctccctcgcaatcttcgtattaggggagaatgggactgggagggatttggggggattctgtgtagtttgtatgggaggggtccaaaagcaaaattaccgccacggcgccacgctatgacacggtggagggtggatggaaaattattgcctaaatggagcgccacatcattggtcaactttgttcaaacgaggtttggactgttgtggttcattaaattaagatggtagaactgaacatgcaatttttaagtttaggcacatctgctaaagtttaagtattggcaatgtatttccattttcctagataaggttaaaccctgataattttaagaaaaagtaaggtttatacatactaatttttctttttacaaaactcttacaaaggaagatctcaaccatttgatctagccgattggtagttaataaaagtcaaaatgaagtcacaatttgccacgtagtttttataaaaagtttgcaagtttttttttacatgtatcattttcatgtaagaaagagtaaagacagatgagttttttttcatgataatcattttttctctgtaattactattattttctaaatttatttgcatatgaaattttgatgacataatttatcattatatttatattattttattgaacactggtatggtatccaaaccatacctaaaagattcatttcctaagaagaaaaatatcaagggttatttctaaatttatttgaaactaataaaaataagaaaaaagttgtccatatataggccacccccctgtctcccctcaaccgtccgtccatcccctgtcaagttcgccgcgcgcaacactcgcagcagagcatccaccgatcgtcgatgctcaccgccgccatgcacatgctcgactcctccacctcctcctccccttggcttcctcccgacctcatgcctcccccgccgtccgccgccactctccaccgccacttccg

SEQ ID NO: 25627 - DNA, 1501 bp, Oryza sativa
aataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcga

SEQ ID NO: 25628 - DNA, 1501 bp, Oryza sativa
tcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcat

SEQ ID NO: 25629 - DNA, 1501 bp, Oryza sativa
tcaagttttgtattgggagagaatagtgtcttcataatagatgaagaatgaatatgattggtagagaagagagatgatgtatttattaatggcccactttaagaaaccataggttgtagagtgtagtttctattgtgatgtggcaccatagacactgcttacggatactatgggttgggactaccctaaacggtggttttgtggacgagccaaccagttgctgctaagttgcaatttggagttgtcagcctaagaaccactccttgccaatggaaaggagacttgtctaccggtgcacaacgaattcataaaagggtcatcgtcgggaaagcctactaaattatgaacgctcaacctcaccaaaaataggatctgtatgaggaagaaaaataagatcacatggctcattttcaacttcacaaagtcatttttcatcaataagcagttatgactaactgaataaaaaaactaaagctccaagttatttatctagctcattttgtacctgagtttgttttagttcttttagctctattgttatagcataagaagagcagccctcaggattctatttacaatagaaagtattaaagaacagtgcattgtttcagcattttagattaactggcagtacctctttattctccacggctcctgatctttcatttagcaaaactatatgatatatttggttcggaaagcttcagaaatataacaattgttaagactgataagttggttcaacccggcaaatatttaacacaatgggtgctatgagaatctgagttgctgtccctatataaagttttatattacatcctaatgctctcacctagttctgcaaatactttaacctgcatgtaattggtaatcaaacagaaaacaatccaaggcaaaaaggaggataatctttgtaccatacaattttccagatcacaagttctacctatgaaaccaagaatattcagaaacaccatcgtatatcatactcctacatgaatgcagcttctgtttcgaacattacaagctccgctgaaattggctgttgttctgagtccagatgactgtgaaaagacacagaggattcaatacaaagagcaaagagcattttcatgaacaaccgtcaaccctctccaacgagctcctcatgcacatacaaattcaagacctcagcgtcgatggaagtaggcggcggcacctcgatcgcactgtggctccgtttgagaagaagattgcgtcggctcgcgtcagcggccgttgccgaggccgcgagaggagggcgatgcggttgcatgagggatctgtacttatggatacagctgcatgtattctctcagccaagtcaaactcagtatgtatgagagatgcgtgccaggctaggaggacatgagcaaccaaacacactctttctgattctcttgcgataacaacaacgatcgaacgaacgatagcgtgtgttcttgtgcacgccaaatcacacaacgtgttcccgaatcggcca

SEQ ID NO: 25630 - DNA, 1501 bp, Oryza sativa
ctgtatactttttttttattatcctgaagggaagtgttgatatgctgacaagaggaagctataagagactaacaaaaggtcatatagagacaatggatcgacgacaaagtcttaatgctggcatgaattattattctctattccctgatgtgtttcgttcaagaaaaaagaaattctctatggacataaagttccaatactacttcatgctatatggagtgaaaaaataactttgttcctaagtaggactattgagatgtaatttgacattggggctatgcagttgatagatttgctacctgggatagcttaagtgttacctttcaaaaggttttatcacaattacatttacagaggtctgttttcaggcaattgacacctccaacaacaaaaatgctatcttaaatcaagtgatagaaagttcatttagtaaacgtcgaaattctacattccaactcctttggataaggttactacaaagcgaaaggccaaataaccttatgccaaaaattaaataaaattcagaattctagatacaacatacaagtaaggagcgcaaatgtcagatcagcaaacttgactagtaccgatttcccagaaaggcctaccatcatacaaaaatcaagaatccatgaagaacatcacatctaccatcactccggcttatgttacgggccatgtatgattttccgggtaaaagttcaaattggtcatgttttacagcataaacagacaaatcagtttcatatgaacaaaaatgcatcgttgcatagctacagatcactcattctcggaagaaactaccgttcacttcaacaaccgctcacacagtcaccactcatacaagtctactggcgaagtgagaaagaagaacaataacctgggtctcgatgatcccctgcaccacgcactccatcaaccccaccgcttctcgctaccacaatccctgcaagagagacaaaccctgaaaccacgctgcggaatttcgtcgaacagctacctcgcagcaacaaaaattcacccccacctttaacctaacagcaataatccgcggcgcggcgggggctgaggcgtcgggaagtgagccgatccgaggcgcaagagctccccccacctcgcaaaccccgcgtccccgaacactcccctctccgccactgaccgctcgccgtcctccgccgcctcctcctcctgcagcgatggagacgagaagaaagaattccgagaaaccgaggggggtaaagtgataaaatgcctcacccccgcgcgaagggtcgcggcgtttttgcatctaggcccctggaagaatctgaaatttcagtcatacccttcctctgacttctcctcttcctcttcctcccccacgcgctcgtctcgtcttcctctcgaattcccattttcttccacctcctcctcgtctcgaggtctcagatccaatggccgcgacggcgacggcgacgaccaccgcgtagagcgcgtgagagtctgcgtggacggctaacta

SEQ ID NO: 25631 - DNA, 1501 bp, Oryza sativa
tgtgggcagggatatgggggaatcttcttgagattgcccatcatctataagcatctagagacatcctatccaaatttgtaccaccataacctttccttttacataaggcatacgaatgcatattattgagagcaccacaccaactaggctacttatataggtcactgcataagaggagataaaggcatgagcttttgttaagcaccttcattcgttttcaatctacatgaaattttggtcaggtgggtcgagccatggtgtatgttgacgtgccaaatcagtgggagcaatgcgcattaactgagccgattacaaaatatatttaaaaatactcaatatatttttatttatctcctatccatttcaaaatgtaagacttggtcccgttcgtttctgtactgaaaaaagtggatcaaaatttggatatgtgtgacactcttttcaaattgctaaacggtgtgtttcgtaaaaagctttcaatatgaaagttactctaaaatatcatattaatttatttcaagtttgtttggtacgtaaatattaagattaagaaaaaaaatcacgtttcagatcccagtgatcaaattcttctcacggactgattggctaaaaaacgtatggatttttacgcgttgaaataagtacactagaaatgcttatactatgatacaaattttaaataacagaaatacttatattttggaacactaaactaagacatactaatatgcattgtttaggggcttatatgagaaatttcaaaaaacgagggcaaaacaacgaagcaacgaaaacgataaacatggagcggagaaagcgagcgcgcatcggcgccaccccgacaaatggcgatagagcccaaatccaaaccaaactcaaactaaaaaaacaaatcccaccgaaaacgatataaaattcgagcgagggccaaagcgaaaagccgccgaatccacgccatttcccacccaaattccacccgaattccaaaccccaccaaatataaatcaaatcccaacgtgacctcccccgcggccgcggcctgcttcacgcctccctcctcctcgccgcctcgccgcctcgcctcgcctcgcctcgcctccaccgcctctactaaaccctccgccgccgccgccgccgcggtgatcaccggcggccgaggtaagccgccgctctgacgctccctcttgacggacggcgcgtttggtctcgccgcctttggcgttccgtgtttttatcttcgcccggattccggatggattttgattttgattttttttttgtttctgtttcccccaaatacccggggccttgtttgggttcgtggagataaacgcgtagtaggcggagttgctgcgggcgccgcctcttttttttcttgttcctcttttgtcaaatggacagttcgttggttgtcgttggcgcggtggagttggatttgtgggatttttttttctcgggcttaatgcaagtggtggttaaacaatttgcttcaacgctatca

SEQ ID NO: 25632 - DNA, 1501 bp, Oryza sativa
aggatttgattcttgtgaaactcttttgctttgtttgattgattggctcttgcttttccattggttttcagtcttgataaacactccttccaacagtacaactgctccagcaccatctcactgaacatgtggtttctgatcatttggtgaacaaaatgtaacaaaagatgtttttttatattagtacattttagagaggtgcttagtgcattaattcagctttagctatataatcaattaatgcaccaaaccactgtggggggcagtagcatgtaaatgctgcttagacactaagatacgttaggatgaagctaacagttcaattggagcagagcagggttgagaatcagtacttggaaaagattgattgtgagatacaacaataataatatcgtaatcatcgagccaggtttttttttagaaaaataaagtattgcaatcatatatgcacacgcatactaaggttcggcggaagagtaacattttttttttttgaaatctaaggcggaactttgttccacttttatatttagaagaagataattgacccagtttataaagaaaaccggatccgaaaattatacaactgcacggttaattacagaaaaaccgactgaaaaccaccgctacacaactaacaactaactttacattgatctaccagtagcatcgtcagtagaagtgatattaacataattgtactatcaatagttgatgtgatagtataaatagatataattcattgtaaagagtactataaaacacgcagggcggaaaatgaaaggaaaaaaaagaaacaaattgggtgtggaatcaacatgcatgcttaatgggaagaaaaaacaaatttgaagtgtatttgttaaacacatatgtaggcttgatctagagctgagctgtttggtgcttacaagtaaccacctctagattgcccctaaaatacaatgcaaaaagggaagttgacaaggaaaggactatatcaacggagaggaagaatcagaggcacgagctgttgactactgagtctgcgtgtgatttctttctcctcgatttgcagtgtacgtgtgctgtgccatcaacaagtgtggctctggctagcacttagcagcccctggtcctgatgtgatgatggtcaggcagtcggtccaaaccgccaaaagtctgggtccgttcctggacgatgttaacacataggagtacaatacaaaccaacggctgtcctaattacttctcgatgtcgtttaccgtactactaataacttactaataatagtagaattagcatatttttttgtaaattaacaagaaggagaattcatggtccagcatgcagctgccagtcaaaattcgcggctactctaatgagtttgtagttcatagtttcccctccgtcccaaaatacgtacagccatgagtaaccgtgtccaacgtttcaccatccgtcttatttgaaatattttttaaaaaagtcacacataaaatactactatttatattttat

SEQ ID NO: 25633 - DNA, 1501 bp, Oryza sativa
gtgatgggatgcttatcaagagccagcaggtacctgcaaatcatggcgcatttcagtaattttgcatttagatatgagtatggcaaaaagcgaggcaaatgaacatgggcagtgcttggccgcaggaggcaccaggaatcaggaagaggcggaattggacttaccaggctaacaggagacgccaatccattgctccttttgctccaccaccaccagctcctcctccggtggtgactccggcggcggaggcggaatcgcagcaagaggcggcgtggagcttcgagaggcggacgcccttgcgcgggtggacgactgcgattgtcgcggggagcgaggcgaggcgggaaggaagggtgaggcggcgggagtggaggagcggcggcgcggtaggcctcggagtcggaggggtggagcggtgcacgaggaggagcgggagggtggaggccatcgccatgggtggtgcttgcgctgatgctgcaaataactgcaatggtgtgaggaggagcttgggttttgggtcgcactggactagggttctagtagttgcaattttggggagaagatgatgaggtagacgaagatgctagcaatggatgatgggctttgcatatttgggctctcggcttccttgttgggctcttggcccacctacatttatttaggtctaaccttttttttttgcggggatatttaggtctaacctaactgtgcccatctcgccggcgccgcctccattcttctcatcctctccactgcggcgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtatatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttactctgatgattcggagggaggatgaataacgatcacaaaacgagatgattgattcatgtgagatccgaacacccatcttgagctgtattttctttcaagttcttgacggtctggaatcctaatgtgctctctttccatgggaaatttttggccatttcagtttcagagcggcaaggagccaaggatgcag

SEQ ID NO: 25634 - DNA, 1501 bp, Oryza sativa
atttcgatattaactgctctaaatgttgcaacctaacattgtcaagagcaagcagtttaaggttgcaaatccgcagaaatctagaggtggattcaaagtaacactgtcaagccgaagagcctcaaggtaagatccattatgtttgtcgaaaatatgacaaggaaagtcatatttgttttcatgtgatttccaatctggggagaagtcaagaatgataacccttgcctttgatgcaatagcaaacgcaacccagccattgacatggttagcatgctcatttgacaaaccaaacttaacagcaaacttatttaccattgttccacaatgtttttccagaatagcatcaacccttttaatgaacttgttaccacttgatattctacagttcagatcagagcttgttccttttctcttggcattatttccaagggctgttttaataccaaagtacagattaggatggaatgtccaagcctgtctccagtttgttgacacaacactcaactgagcgacttcctttaatgttaattttgacattacccttagtacaatatcctgacaatgcattttgaacaagcatcagaatacagcctcctagtcctagcacaaaaggagttgagagtttcatgacttcatgtcatgatatgacataccttgggaagagactgaaaattaagcagacatggtcttgtcctctgtaaattaagctgcccccgacttatcttctgaaaattatgttgtgttcttctcctcttactaatacgttgtccgcaaattatacaattccttttggctgttgtgcttttactcctgaaaccaacaatcagcatgattaacaaggtgatgaaaataaccatgaattctgcctcagcataacatctgtaagatgctctctctttttcaacaagtttgattacagtacaaccctacaggtatgcatgccgaaaaagaaagaagggcagtaactctggctaatgttggtgaaagatatcatgcatgctctgccagtatgcaatgatacttctttcagaagttttaagtagcacacagaattgacttcttgaaactattttttttagcaaaataacacatatgtcagagggtattttgcattattattagtagtaacagtacacaaataaatgaatataagcatataatgtgatggaattctgccatgtaaggatgcctttctttagattctctatttatttattttttgcgggggcctttgtttagattccatatcgtattaaaatcacaagcaaataaaggaaaaggtgcatgagttgggagtcaccttccatggattttcgaggagacaagaacgttgtcctccattgttggtcgtggaggcagtggatcagggacaagagaaaccctgaatccctccaccgcaggtccgcagcccaacccaatcagcagactcctgatcccggcgagcaaggtagccaggaagggggatggaatgattgtgagacaagggagaggctacttagcg

SEQ ID NO: 25635 - DNA, 1501 bp, Oryza sativa
gtataagaatataaagataagctgaagccattgccatgcacttgtgatatgctaacttgtactgtggcctccaccgtactgtggagaagtgcaagacttatgtccaccgcaccacaatcaccctcaatccgttgcgtaaacactctattgggaagcacgaattcgctgcagatgatagcaccatctatgagctgaaaatcatcatctcgtgtctctccattcttgatcttcatgtcaaactcaatgagcacacgagcttggtttccaatgcctctcttggggccaggcattggtatcaaggaattatctgaatcaacaccattgtcttgccccatgatgaaaggatcatctctggtgcggttgaagatgtagttgcgtagcgggtccaaatgatcccgtactgcaaagtatccatacaagtgaactgggccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaaaggcctaaatttgacatcaaagtagatagatgtgttatgaaaaaaaaagcttaatttgacatcagttccatggtattgagcatacacaggaacaaattaggtgacacatgaatatatagaattgaagttaaaacttaaaaagagcatgaacgagttcacagcatgaggtgctaccgagtgaagttaaattgaaagggaactaactaattaaggagatgagaggatggtagatgatgcatggtggaaaggggaaaaaggtagggtttgcaagaagttaaaacttactctctcgggtatcggcgaccttgtaaaacctgtgccaaaaaatcgtcgccgctgtagatcgatccatcgctatgtttgctgcagtcgaggatcaacgcgcgattcaccccgtcctgactaccagctgctcgcctcccattcttctccgcctccgcctccgcctccgcctcggcctccacctgctcaagctcggactctgcccgccgcttcgccatgaaatcccctcgcgattccacctggcctcaagctcgatctctctcgtttgcttcatcttctccctccttctcccttcggttttatcttgcggcaacaaatccgaaaccgattcgtattgctaccattaaaaagacgaggaaaagaaagaaaaaacgattcttatatcctctcaaataaatactagcagtaaaaatcgatatgggctgatttttgggc

SEQ ID NO: 25636 - DNA, 1501 bp, Oryza sativa
attcggatccacaatttgcacagctcaaggatgaagcactggtatctgctacttctaacgcaacatgtcgtaatgagtcaattgaagagaaatcaagtgaagcattactggcaggaaacgaagattattcagaactgccaaatgaactgttaaaatcaggagatccacagtttgcagatagttctgagattcaaatgcaggttattgaggctacaggtcactgaatcatcacaagggcctaaaacaaggccaaacagccaatttctcagagagatctgtaaagcatagatgtcctgtcttagctctctgaacaggtttctgcccccctttgttccaacttactctatggcgtctggatttaactattcctcttcttaatacaaaatgtgcagcaatcatgctgtttttcctccaaaaacttttctcaggaagtccgcaatgtcagaaatatccaaggaacagtggatgtacatatggtttctgcttatttcttctcttttgtttctgcttatttgctttcggttttgggctaataggttagtagataggagagtagatgacattgatatgaaacaccagttgcagttgggtgtgatatccattcagtcaagccggtctttctttcgctgcctatggagtattaatttttcttgtctgccagacaggcattggcaacccctgatcatcactttgtttcagtaaataagatgattggatgtctgtttgcctgttggtaaaccgctggactggagttgcagcttctgcagtttgcttcttcaacagttatcctgtcagtaatcattgagtaatcaagtaatgctttcacagatttttttttaacacctcctcatgctcattatctgcttgctgttggtggtttcattaagaaaatcacagttccttgattaaaaaattcatagtcctttacattacatacatgatgcattgatgcttatgttgggtatactgatctgaatctgaggcgtgctttgttgggataattgaagatacgctactcccctagaaccattttcaggaaatcactcctttagcttgaccttgctaaaatgaattgtttgcatgatactaacaaatagatgaatctttggtgtagaatcgcagtgatgaataaatctattttttttcatctgtttgtagagccatcttacagatgagagcgtggtattcttcgactgttattctgttaaacaaataaaaaaacttaagagtgaagtacatgggcacacctaaacttaagagtgaaataaaaaaacttacagaagacacacctacatctaggttcctgaactcgcaaaatacatttttaggtccctaaacttgtcatgtgtgtcacataagtcctaacggattcaaacccgctccatgcgctgacgtggcattgccacggtggcacctacatgtcgagcatatataaaaaataaaattaaaaaccatattttctcctcgtaggtaaacagaaaaaagaaaaaaaattctaatg

SEQ ID NO: 25637 - DNA, 1501 bp, Oryza sativa
catctattcataatgattttcttagtttcatttcaaacatcaaaggggatgtagctcaaatggtagagcgctcgctttgcatgcgagaggcacggggttcgatcccccgcatctccactctaaatttgtctattttagttctcttctccttttcttttgtctaatttaattttgtgctcttctaaattctagtctaatttagctatgtgttcctctaattttcttctaaatttttgtctattttatttctctttctttttattttgtctaatttaattttgtgctcttctaaattcttgtctaatttagctatgtgttcctcttattttcttctaagtttttgtctattttagttctcttctccttttcttttgtctaatttaattttgtgctcttctaaattcttttctaatttagctatgtgttcctctaattttcttctaaatttttgtctaatttagttctcttctctttttgtgtgccatatgttgccttttttggtctagttatttaattttctgctcaccaaaattttcagcgccttattttgtacgtgaatgtgacacgatgaattattttgacttttttttgtttaatttagttttttgagcttgtaaatttgtataacattttttatgggattctctttagtagtagtccctccgtcctaaaataagtggagttttacactgtttatgtctcacgtttgaccgttcgtcttatttgaattttttttatgattaacatttttattgttattagatgataaaacatgaataatactttatgtgtgactaacttattttaattttcttataaattttttaaataagacggatggtcaaacgttagacacggattttcacggctatacttattttagaacggaggtagaagcgtctttagtgacagtgactgacagcttggtcccatcccacatttcaacgacatcggctagagccatggctataggtaaacggggccatcgtttggccaaacggcatattggtaaacggaatataattcatgaataaaagttttatatatgtgtttctagcgatctaaaagaaaaatctggaaaataaactataatgaaaaaaaaccctaaaatcaactccaaatttaaagctgaaaatttaaattttgacttataagtataagaaagtatggtattgtgtatttctacatggtcattctgttatccaccatgaatttggttttcaatgcttgttttaagggtagttttaaagaagagtaaatttccgaaaactgtaactttagtgataaaagtatcagtttgctgcaacaataacgtgaaaaattatcacaaaactacaacttttacgttatactcgttctgtcccaaaataaatcaacttctggaattcaaactttgtcacaaaataaatcaacttctaccttctcattcacacttggttcacaaatcgaaaaagtttatttcttcaatactccttacctacctaaccatcaatactaatat

SEQ ID NO: 25638 - DNA, 1501 bp, Oryza sativa
aagtccaaccatcccttaactttacgtcaagttgattggcatcccttattcccatacccataaatctttacccctaaactatataacttacatcccataacagtatagaccttttttttcctttgttttcgcttatatggcaaatatccagacccacttatcagcacaacttggagatgagggtgcgctaggatctgcacatggcgcggcacaggcataagtggtcggggaaccgggtgaggatgtcgacgacgatatcatctaggaggtcaacgagcgatatagctcttggtttcatggtaacggtggtggtggaggtaggccaatagacagagagttgacagtgaagcagactatggtgtgtggcatcttacttttcccttgaactcaccgtgtcgtggtgctctcaatgtcccaggggtacacacagtgaggaagtgggggtattgagggcggagatcgaggttgaggccatcgagtgcagcgagagtggaccgtacacgcttcccctagcacgtgcgtacatttgactgagctccctgcagcacagggagacggaagcaagatgtgggtgggcagggaggtggatccgccatcatctcgtcgccgtcgctaccgccgccgccatctccttgttcagcaatgttgcatgaggcaagggtctctcctacctctatctttctatctctctagcggcggagacggcccgagctctgatagtgcgggaaaatggaagctaagacatgggtgggcgaggaggcagatccaccatcgttggtgttgtcaccacaacgccatctccctcttcgtcggcgttggaggaggcaaggaagggcttcacgctcggcgtgactgcccaccggtcgcccatcaaaggccggccctcatcgccaatttccttcccaccgttgctgccgcctccacggacgggtgcaccagccatcaccctctctccctggcagtgcgctctggtgaagagagggaagaggtggacggatagggaattgagggatgtgtggaggttgaaggccacttgcatgtgggttctactttttttttttgactagggtgccacataagctaaaacaatcctccatattgttataggatttgattcaaatggtttcgtatagtttagggagaaagatttcgggttccgtggtttagggacgtcaattaaattgcccgacaggagggtttagaatagacttattccaaacccgaaacgctgggaaaactggctaggccagatgggctgttgcttattgggcctgtagttagatatttttgtgggtttgacactttgactcactccattgattggttctgcatgcacgagtgtctcaacggctcacctctggttgagtccacacgtcctcctacgctactacatcacacgcgcgcgattcgttcaccggacaaaagcagagcaatctccgttgaattcctatggcgccggcgctggcgccctgccgctccgccgcttcgctgcacgccgccc

SEQ ID NO: 25639 - DNA, 1501 bp, Oryza sativa
agaaaaaaaattatatgcatataggaaatcaagaaatttgactacactgcacaacatacctagagccgttatcttaaaaaaaagaagtattttgaattatccccacgagacagaactatcacatcatcgtatctatccattatattactacataatagatttagcaaattttggggaaaaaaaatactaacactattcccccttcaaccaaaacggtttagtgtttttggtttctacaaatgaatatggaacacatgtacttttaatgtagagacaaaaacagagttgtgcaacaaatacaattccgctctaagatatacataacatagcacagtcacacgggaaattcaaattctcgaggataaatgtcatcaaaatgtctagattcttacccaccattaatcaaaatgtagctagcatacatgcatgcaagcgaatttcaccacagaaaatttaaccaaccaagttcccattctctgtaaaaaaaattaaaataaaaatcgggtgattcagacctcgcatgcagctaccaccaccaccagcatgcaacgacgacgacgacgacgacgacggcgagcatctcctccgccaccgccatcgtcatcagaagaacggcgaccgctccggcgcgcggtgcgcgcccttcctagcgcgccgccggtagctgttggggtcggcggcggaggcggccggcaccgaccgcgccgcggcggcggcgaaggcgaggatgttggcggcggcctcctgatcctcttccttgtcgcctctagccacccggcgtcctcctctcctaggtcgcgacgacgacgcggacggcggcggcggcggccggcagccgccgccgcccgcggccttgctctgagcagcgttcgccttggttgggtagaacggctcgtcttcttcgtcgtcgtcttcttcctcgtcttcctgtggccctgaaatctgtggctctgggatgttgttgggatcgatggtgaatgtcagggtaggatccgattccatgcatttcagctgacatcaacaggagatagataagattattcagtagtatggattagagtggtgattcagttagttaatcagaagtgatcagaattaataatcttttttcatgaacgcataaatgaattgcacgtcaatagaagaaaaaagagtttttcttatacaatacaatcggccaggtatgcctatgtaggggaaggacaaaaaaaaagcaaaacaaaaacttcagctaggaaactactacgacggctaaacgcaacttcgatggtgtgttgataatcagaaaagtatatggaaattcgagtttcaatgttggagatgctttcatttgatggaagaaatctctttcactagagagtagagaaagatatgagttcgatggtgtgttgaattgattagcactagcttcatggttttgttgagtatgcctgaatgaaaaatggaaaaaagagagaggaaaatctaaatacccctacacccctacaatttaattttgtac

SEQ ID NO: 25640 - DNA, 1501 bp, Oryza sativa
ttaaaaaatgataatgtatagtatagtgactatgcattgggaaaaaagagaaagacaaatctagatatgaatagtaccattattgttcatctgctgaatttgattcctttatacctcagcgtgtgggttgaatttgttttttttttaatatctccgtgatgttgtataatcgaaagcaatgcattttaagatagcacaatcaggggaaaagaacacttgatagggtgatttagcgggttagactaaatgattcccccaccaagattcagctaactaactctggttattgttgattgaaccacatgcttacttagcttaatctcttcccaaataatactcccgagatgggccgggatatgggtttcatcaaactacaaggccttacaaagtttgttccaaaccgcttccgtttacatttgcgttgcaatgttgactttcgtcattttaacgttgagccttaatagtccttaaatggttagactactataggagaaactttcacggttaagggtgtgttttcagctaagcttttctaacttctaatctactactccgtactatttttcacgcacatgcgccttcctaaactgaaaaactctacttcttttaataaaaataaaaatatagaggaaaattgctttgaaaaatcatattaattcattgtttaacttttttagctaataattaattaattatgtgctaatgagttatcatgttttgttgttttatgtgcgcaggagaaaggtttgaacaagcctatgatgcaagccaagtatggaacaagcctaagatgcaacatgcttgataatatatcatcattttgaggacttatgatcccctaaaaatcatgagtgattcgagatgaatcgtacttcagtgtcaagtatatgcaaacggagagaggatttcctttgagctaaggaattcattcatctttgggtctgtttagttcacgtcaaaattagaagtttggttgaaattgaaacgatgtgatggaaaagttaaaaatttatgtgtgtagtaaagttttaatgtgatagaaaaattgaaagtttaaagaaaaagtttggaactaaacaaggcctagtttacttcaaaattcgtcctgtttcttcctctcttttttttttgtttgtgagtacaaccaaacttgaggatgatatactggttcattctactttgcgcaaaacaagaaacggattcctactactacttcctactgcctcactactatgcctcctcttctactaagctcaacgccctcttcagcggagacctcgccgccgccgccgccgccggcgcggcgcctctcgccggactcaggaacacggcgaacacgccgagcgtctgctcgttcagcttctcgttgaacacgccgtcgacgtcgccgtcgccgtcgtctctgctttgcgcttgcgccggcatgacgtgcaccttcttcttctgcttcttgccgccgccttgccggtgtcgccgccgccgctgtggcctctcgccgacg

SEQ ID NO: 25641 - DNA, 1501 bp, Oryza sativa
cgaagtttatttttcagtttttgcttttagctcgctaagaacacatacataaaaattttatccataaattatttttagtttgcaaatatgctggcccataatgttccacccgacgtgatgactaaaacgtggacgaattgtcctcggactaacatacttcatctttcaaaatataagggtcccgttcgggtgcacgattgtagtcattgcaatgcagccatacaactgttacgctgacacacattactgtgaaagatagctgcaccgcagctcaaggagtgcagcaaaacacacccaagaaattttagaggaatgtgacatatacatactattaggatgtgtctagatttatggtatgtgtttaaattcatattactaaaatgtgtttagatttatagtacgtatcatatctctttaaaatttattatatttcaggatagagagaatattagcaaccatcttcatttaagtctaacagtcagacaaaggaacgaatccagcatggtccgcggttgcgcttgcgcgtcccgtgaagcaacctgaattcgctcggaaaaaatgggcgatgaccgagtttagttccaaatttcctctttcaacttttaacttttctatcacactaaaacttttctacacacataaacttcgaacttttctatcacatcgtttcaattttaatcaaacctttaattttagcgtgaactaaacacacacgacgtgactggactggagtggcctgtggaaacccatcatccccgtgttgctgcgtgtcccactgataacgggacggtctttgtgttgaccatttcccccgtactactcgctagcccttcggttctttgaccatttcccatgtactatgggctcgcccatttggtcttgtgttgctttgcgaagttgcagtgacaaatggaacccacagtgataaagttccacgggtttatttccaaacaagttttactactcggctaataatgacctgacgacgcgtaatttaaaaaacagaaaataatttgaaatatacaattcctatgtcctaaaatatggccttttaaaacttttacacgattttcgagatactactttgatgaaccatccttgtgtaaggataaggataaagatactttttacctgatcaatcttttttatattttttttgttattaatagttaattttaaaatgtctaatttagcactatctaaaaatatagttacattttgtgatagtgggggtatgatttatcatttatgtacttttattcttacctaaatgagaattaaaaagaaagacaaaaaaaatcctttaaatcaacttctaaaactatgccggttattactagctcacgacgtaccggatgcgacacgtttaggcaagtactcatcgatttcatgactaataggagtactccgcgtggtaaaatttatgaaaagtttatcaaagatccgtcgctgcatccccacatagaaaaatgtgccactagtttgactcgtcaccgttgac

SEQ ID NO: 25642 - DNA, 1501 bp, Oryza sativa
ccaagtaatcaggttattaattaattacagtagctgtttaggttctgatcagccagctgaaactaaaaggtcaatttcctgcatgcatgatcggtaatcagtactgtacactatagtggattagtccaaaaggccggcgctctggatagaacttagtttgatcttttccaagataggagtaattctagctaaaagaaaaagatcttttccaggatgtgatttgtctgtagaactgtataacaagctgcatgcgaatgtactgtgtcggaggggcgacggcaacgaattgaaagctaggattacgaggaagtaggtacgaggaagaaacccaaaaaaaaaaaaaaatcgcgaacacggaacccagaataatctttcgtgtaggagcgttatttagagcttacccctccgtaaaaaaaaaagataaaatcatacctacaatcctacacacatgtgtgtccaagttcgatcgtaggtatgaatttgttttttttttacggagcagtagcttggataattcttttctccacgaacaagattcggattatattgtaggggattggaagaattagtttcgtgctaaagttggaacacccttgagtgacaacaagcacgctcaaggaaggtacatatggttctcttgacatttaaaacttcgagtctcttgataaatctattgagatatgaaattaagagaatggtatccttttcagagtatatatcttcctattatggaagattttaaggaggtacaactactctaaaaagatctaattccttttagcaattaagaccgtgaaacagaattagaactacctgacttgtactccctccgtttcaggttataaaacgttttgactttgatcaaagtcaaattgctttaagtataattaaatttatagaaaaaagtagtaacattttcaacccaagacaaatttactataaaaatatatttaattattgatttgatgaaactaatttagtattataaatattattatatttggctataaatttagtcaaatttgaaacaatttgactttaaccaaagttaaaatatcttataacctgaaatggagagagtaatactgaaactaactaataaactaatagcttactcttaagaaaaaagctaatagtagttactctttcgtttaaaaatatagcaacctaataagacatacgtcttatgtcccaaataaatcaatcctatgaataaacatgaacacgcgatttattttgatagtacaaaggaagtatccatatatatgtaggtcagtgcagaaggttctaatgttgaaaacctaatttctaatttcgtccgggcttttcaaaattagcgaacggacgaggcaagaacgcggcagcgaacgcgacacggtagaacaagttccgagttccgacgcgacgcgccgttggcgcaggaaaagtccggtcaccccaccccactctctcgcttgggccgcccgcaacagcaaaccagcctagcgcccgcgctgacgcc

SEQ ID NO: 25643 - DNA, 859 bp, Oryza sativa
tcctgcagccctcctgttttttttaattaaggaggggatagattgatcctccgtatgcactgtcacgacattatgttaattgttatgatccactctccctttcagacgcgacaacaatttgtattaaattgattgctagttagtcgaaagatagttcagcacaaaaaacatattatcataactaatttattttcaaagtataataaagataggagcttaattatgccaaacaaaatctaaaaataagggctggctgctcggaatgtaggattttcttataaaatctttacaggaattagtttaattcataagaaaattcttagaaaattattcattccaaagaaggcctaaaactataatatcgtagacagtaggatttattcggtttggaggaatttcaacatatagaaatagaaaagatagagaaatagaaatgaacacgcacacttctattcgaaagaatttttcaagaggtttgatcaaattttttctatgtgttctttttacaacttgtacaaaaggaaaacttcttctgattttcccatatttacattcgtacaaaccgagtaacactcaagaactttttcagcaaaatactcttaacaaaatttaatatcacacatgacaaaaagatatagtatcatttgtaatttaatatatctatctatccaactcaagggtaggttgattgtgcaatgttgcacaaatgcacacgtctccatgggttgggtggagtcgtttagttaggttatgtgattagctaggcaggcaaattaagtgatctctcgatcggcaggtgatttataaatataatggccggcgactaagcaaaagtaaatgacatgacatgacagccgtg

SEQ ID NO: 25644 - DNA, 1501 bp, Oryza sativa
tcaccgttatcgtgtagagctgatagagcacatcattcatcccaccactctcctcattgagtgaagcccaatgcctctcaatactgtatttctgtatgacattcttcacacggtcactgaagtaattggccatcccgaccaccaaatcaagggccttagaattcccggccaccgtatactgatcaagaagaccttgcataatctgcaaaccaagaattgcactcatgtagcaagacaatgatataatatagtgatcaagcaacactaggaactgaaattcccccatataccttgtgaattgtatagtaaggagcccaaacagccttgatggactcaaccctgtcgaagaactccgaggggaaggccgacaagtaccccgatcccatcttcttctggcaatcatggagcgcgtcgacgaccgatgacatcttcgccaggagagtgtcattgtgtgtgctcgcccacatcttggcagtagcactcaggtagtgtcctgcaaagaacaggcagcaaagcaaagccaccgcaaattcagaccaattgcgcgatttcgctgtgcaagtgatgccgagaaatggcggtggcgcaccgacgaagtgtccccggagctcgacgccggggccctcccacccgccgtagggcgccccggacgccggaaggccggcctgcgtgcggaagctccacacgaggcggtcgacgtcgaggaggagcaggtactccaggttggtctgctgggcctgccagtacacggtgcccggctgcagccgcacgtcgtgcagcgacgcctccgccaggagcgcgccgccgctcgcggcgatggcgccggcgccggagccggagccccggaggttgcggtagagcatgagccagtcgaacgcgtcgcgccgcggggaagagacggggctcgcgaggagcctccgcggcatgagagacatccaggtggactcgtcggtgggggtgaggtggcggtcgccgtcgtggtcgtcgccgtggccgtggccgtgggggaggaggagatcgagcacccgcgccgcctcgacctcgccgtccggccgctgctccgccgccgcggccgcgcgctccgtgtgcgacgccgtcagccccgggaacccgttcgtgcagtccttccccgcgacgccatcgacggcggcggccaagaacaccaccaccaccaccacgaccccaaccgccgccgccgccattcccgccaagaaccactccctcctcactaatcaagactcaagaacaccaccacactaccagacgcatcaaatcaatggaatcctccaagaattccacctccatttatgcccccaatgattgggcgatctcaaccaagaattgcacggaaagcaagccgcaacaactgaatttcaagaacacgaagccctccttatcccctcggacagatcactccctccgagtccgatgactagtcaccactaaccactgagccagtgattcttggggagaagaggagtagaaatcggcgcccttttcg

SEQ ID NO: 25645 - DNA, 1501 bp, Oryza sativa
gtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataatt

SEQ ID NO: 25646 - DNA, 1501 bp, Oryza sativa
tcgttggaatccctctcctcttcgtccccggtggttgccggtgaaaggattggggggagggggggtccgggggagtgctcaagctcgtcccatagtcgggtaaattatgttacagatcctttgtccccctcccccacctttcttgtaaagattaaaggagatgtcgacttctgtctcctttgtcctggcggtgtcatgccatggatggatctgctagacttggtctcggaagatgccgtctagctagcaaccgtcaggcttagaaccgatgctttggttatcaacatctgtaacatgtagtccttcaaatccacaagcaataaaaggttacgccggccattcttcaattttccaatgagcagacctgcaagggttggcgctcttccctgtggactttggtggtggatctcaaagcgatgattgtggttttcttgtttggccatgaaagcttcaacctccatcatggaggccttgattgggtttgcttcttgactatgccctttgcagtctgccatggtttcatcaccatcaccgtagacactggatggaacaatggaacatcagctcggtggaaggagttgaaggacctgatcacattttacttttctttagaggactttttttacatgtttcaaaatgttctatgaggggccttgtgtactcccaattgtgttttaataaactaccctgaggttgttgcctcagtttattttttaaaaaatcaagttcctatttaattagtatttagggcttagaacgtagaaatttttaagattttcatagaactagtttaatacatgcaaaagaaaaattccaaagaggtcttatagtagtttttaattttgaagtgaaatggttcaattccaacatacaataatttagattttagaagacttcatgcattccaacctttatattttgctaaaatctcgttttcgaaccaataattgagtggatttggtcgaaccaataattaattgtaagacaggtttgtattttgcatgtgccaaaatttgaggtttagtgaatcatgcctgatgatgctgcggtagacgcgtagagatatgagtactttatgtaccacatgtgtattatttggcattggagtaagatttttcacagttcatttgaacatgtgtcgaaggaggaaacctgacgaatatatatatatacattggtgtgtgggactttcatgtaattgagaagttgttaaggttttattcgcaattcctacatattaatttccttgattcaattcaaaacaaaagctaaaagatgtaaccatgcatctctcaattggtgaccacgatctcgatcatcttgaaacattcatgatcggtgactaggatcgatgatcatcgatctgtccctctgctacctagtacgtgctgttactgtatctaaatttatggctctcactattgatctattccatccataccttgaaccctaagtgctgtcagttgggggttgcaaagcttgcgacgacccctacagtaat

SEQ ID NO: 25647 - DNA, 1501 bp, Oryza sativa
gaccgtatgcgaagacatatgcatgggcaatatatatatgcaatcaggcatccgatggtagtcaccaaataaaatgctactgtatggcattggcaaccagcctggagtagtggtaccctttttcttaattattgattaacaggcgactgctccaacagcctgcagctggctccacctcattagcactctccatggacacagtctgacagctgggcccactcattgttagttgctcatagtacatgctaacatgtgttcttctagaggtaaatcagttgtagtataatccatttagggcttgtgagttaatcccctagtctagcagtaataagatgaattcggtacactatgtagaggtagtgggtaggtaatggttgctttgattactgttggcgtactggtagtaggggagtagtctgtattttaaagtttgaaagatgagtagttttgcagtgatgaaatgaaaagggggaagggaagtgtaacatagcaataccactggagtaacatgggtggacagcagagtagttggtgtgctggaaaggccatgccatgcatgatatgatgctgacagtcaggcaggcctctacatgtgacaaggcttcaatgaattgaaatgaaatttaagtatgctttgctgctgctgctctttcttctctctgcattccatttcattactgcctctaacagcattatcatatatgcaaggtaattaattaaaaattgttactccatgtactgtaatcctactgtataattcttccagtttactactgtactacacatgccattataagtgtaagtaggtaggagtaggagtagtgtgccgtgagtttatccacgacaattactgtggtactctaggtggtgtgcaggagtagtaaaaggttatcatgagatgcgaatgtgaatgaatgagcagagtgtcctaatcacatggagaagatgaagaagatcagaaaagccagcagggaaaaagaaaagaaaaaaaaaagaagagaagaggagagaagaaaaggcaggaattgctttgctggcagggtgatgtgccaatggtttctttctctttctttctctttaaaaagcttttagccgaggtggatgcataggccatggcaccctacgcactaggagaccaccaatactagggtagggtggcctgcgtgtgcgtgccaaggaggaggagtgcacagcacgggcatcttcttcttgtccagcttgggatcatccatatccagctatactatactactcgatcccttccattctcttctcttctcttctcttctcttctcctctcatggtcatgggactcatggagatggagtagtttggttggttcgttaagggacagagggagctggcatttctttaatttcttgctctccattctcattcccaatccatctacatttcctaagtatatatactccataccatacataggagtactccagtagattgccaaggccttactgctgcttctgtttcttgccaccaa

SEQ ID NO: 25648 - DNA, 1501 bp, Oryza sativa
tggatcttttgcggttttctactaaggcttgcaacagcttttggtcctgaggggtttataaaaaacaggaaaaacacatcattaagaagggaaatgaataggtagcatgatacggaaaagtgaaattgatttaaccaatggcaaatttctcagcgccgacatacctttacatagatcggcatataaaatccaggaaagagtggacgatgtgggagaggcagtgctatgacctatttgaaaaagtaagcataataaagtaagagaaggatacaactagcagaaccatgttatgaaaaatatgaactgttaaataaataacaaataatctgaagggagacgtttagatctaaaaaatgatggaaagacagcaaagccctcccttgataacagagaaagagagagcatgatacccttctagacttattggtagaaaacccattttcaagacatggcatgagttcaaatagctactcaaaagactacaatcaaattataattattttgatccttcatcacacctcaaatgaattgctcactttagtcctaaatagattgtgcatttcatttggcaccaatgcaagttcttgagctattcaaatttgtcatcgaaatatcatatgtactccattatacagtttggaggcactttttctcaatgtttcctagtatatcctcatgagtatcactccaagtaacaaataagctctccttcccaatcgcctcccacttcataacggcagaataattatttcatggtgttccttcgttcttgtgcccattaatatgtgataattagatggaatatttattcaattgaacaacacttttcagaggggtgcaagctttcataatgcattaccaagcatcgcaccagtgacttttctcaaattagaaaacagtactgaactaaactacagttcaggacaacatgttaatccctcagtgagcaatcagcattttcctctttctttcccctaataaatagaaaggcaccatgtttgagcactcaaaaggaaggagaaaccatgctgaggtactgaactctttgtgcagctcattcaaggcaatcacactaacctagttgatccaaaccaaagaaactctaccttagcattacaaaataatgagctaactttgagaccaaagtgtttccatgctcagattgagccatggacttacgatatccaatcaagggagtggccttccatgcttactctttggaaccaaattacacattctccaattacttaggacacaaatgcatcgggttgctattggctactgcaagcaactaaacaaacggttatgatccaaacgagtagagcgcgcaccgagaggcagtcctcagggcggaggacggtgggcacgatggcggaagacgccttgccgtccgcctccccttccgcagcaaccgcatcctcggccttagcttccgccgccgccgcctcggagtcgctcccggcggagttggagcagaagcgcgccctcctcccgagcgtcg

SEQ ID NO: 25649 - DNA, 1501 bp, Oryza sativa
tttaactaggagtaggacatgtacagtaaggcggaaatggatatgcaattcaaaatatcgatccacccagtgggcttataggttttttttgtcatggttaaatttgaattgacattctctctagtttttgttataaagctggatcgatctttggttaaaaaaaatgaattggtaagggtttttttttggataatggaatttaatccatgtctacgtcagacatatatacagcaacaaatttgagaagcaagtttgtaaaggtttggttagctagctattgtctgtcgtttatttctctctgtttttcttcttacttgaaaggcaaaggcacatagatctcctgtttgatatcgagaaatagtttttagtgtacacttgcatttattttagagccatggatatgtatgcagcgaatgtactatctcactcagaaatgtcatgcacccaaaaataaagagggttgcacacggccgagacatgatatctcattggatcctatgctaaagtagcggcagtatgtattgggttggggacacacagagagagagagatgaaaattattcattcatgcggtgagaagaacaaagaaacggagtttcttccggacccgcataagagtagcagtaagtgttcgatgctttgcatttttttgtaacaacagggcagctatatatatgcctctagatcataattcataagagtgactgtatgatgaaggcaggcatctgaatgaatgcagagttggctgtgagctgatagtagtagcagctagtagctttttactagtatcactatcatgtgtctgcagtcatgcaaatgtatcatgttctccagtccatattacataatattactgacaatgagctattactaaatgtgtgaaaaaggtgcgggtagcttgtgtttttattcattatttcgatggattgttcacagtcagtaatactaacagggcaatcgattgttgggtataggaataggaaggaaacaacggaggaggaacctgacgatgagtaaaaagttgcataggattcccaatgagcagtgctgagtggagtgaccacccatatatatatagggtgtgtttagttcacgctaaaattagaagtttggttgaaattggaacgatgtgacgaaaaagttaaaagtttatgtgtgtaagaaagttttgatgtgatagaaaagttgaaagtttgaaaaaaaaagtttggaactaaacacggtgatagaggagtacatacatatcttcaggctgctgcacggtagtggtacatggctactctatgcaactgcagggccccagttgccttatatatactgataaattactgagatactctctctgatcctataggcaggcatgcaggacagcataatgtacgtatatgatatggagccgtacatacgagcatatggtacgcacacgtgcatgtacatactcctatacggcaacaggacacgacatacgccgcttactttacgttttgcagcacaccacatc

SEQ ID NO: 25650 - DNA, 164 bp, Oryza sativa
tcccccccccccccccccccccaaatccgtgcggatcggaccgagcaatccgcccgcacgcggccgccgccggcatccccatgccctgcgagaggaaggaaggagaaacagagaaagagaaaagggaaagagagaggccgagagggtgacatggacacctgaca

SEQ ID NO: 25651 - DNA, 1501 bp, Oryza sativa
aaaattgggcgaaaaccacaacactctaacctaagctaccaacaccatgaaaaaagaaaaaatagcaaagcccaaaacagccatcgataaagagcttgttgtaagcgacacaaaggcttcgacttcatgaggcaagtgctatcgttgccgagcttgtcgcctagcgacacaacagtttcgactccacagttatcacatcatcgttgccaaaggcatcgtagaaaacaagcaagacaccgactgtccactttaaacatcagcccaagccacttgagcactactacttgtacacagctaacaccaacctttctcgacaactgcaacgtgttatcgttgccaagcttcatcgcaccccaataaagcagctccaacatcagtagatttatcaataaagaaataatgtggctgataggatagcatggatatattcggctgcagcagcccactacttatacgttgtgacactgttggtgtttggtaactacagcgtagggtatcgaaaagtcctaataatatcatgcttttatacttttaatattttctaaatataaagttaaagagaaatatagttaaatatgtgcattatatatatattgaagacaatatctatatatatgtttgccccaacaaattaaagtcaaccgaaccatatcatatagtatatcgtaatgcgctagctatctattggctgtcgtatctagctctagcctcctcatttgcatacgttgtgtagtaattaatttgtctactctactaatatataatctgcaaatacccactattttaacttaaaataatataataacaaaaagtccaagtagtgatcggtgaagtgatcaagactaactgatagattgatagatagataggtgtagatagataacttttattattttttaaattttaaattttaaaaataaatctttgtaaaattcatttttaaaatatgaacctttttgttatgccagcttatttggcgtgacaaaataacacattacgtcacctgcagcggcaatgatagttttgtcctaccatgccagctatattggtgtggttacgctagctagttacacatgactaaataacgttgtcacgtcatttagacccacgtgataatattgtttcgtcacgccttcttgattggtttggtcaaaaagatactgatttaaaaataagttttgaaaagatatgtttttaaaattaaaaactaaaataattttttttaaaaaaaatcgtaggtactccgtagatagatagatgctatatctcaaaacaaaaagttagatataggggcagcttagagataggtacccgctgacacgtgggccacccatccaaaccgtcctatgctataaataatggcgcccccgcggctcaccattgcactccaatccaaaagtataatcaagcaaagcagctcgatcgagtgttcgactgatcaccagttggagctaatcgatcgagagagagagtatgacggtggaagtggaggcggtgacca

SEQ ID NO: 25652 - DNA, 454 bp, Oryza sativa
tatcattgagttgctttctcattcttgctcgctgctgcgtttccgatcttctcatcacctcttccttttttttcccccaaaacacggtacagatgaccttttttttttctatataaacacacacacacatatacttatgaacacctctaagagtctggtccattatatcttgatattagtgatgtcatttctttcttatgaactcacacatatacaccttatcccattagttttttttttgaaagaatagtatttttgagagtttggaccaacatattttaagattgatagtcattttttttctacgaatgcacacatgcacatcattaccacatgagtatcttgttgagattggacccaacatgttttgagattaacgaagctattttttatatgattatatgaatatacacacgcacaccctatgatgaattcattgtttcgtcactgcagg

SEQ ID NO: 25653 - DNA, 199 bp, Oryza sativa
taagaggatttgaatagtcaactctgtccaattccagcaatactactgctgggctggggtcctggggacttacagcaaggataatagtagagctcactacccactattaactcatcttaaagccaacatatataataaattagctataaggttggctacaatctttttctcctctctctatctctcaagccattttcaa

SEQ ID NO: 25654 - DNA, 234 bp, Oryza sativa
atcgagaaatttcttatcatgtgatcaatcagaacccacagagctcaagccgtatttttttttcatggtcctcacacgtcagccctaactaatttagggcaggccacagcggctacgtggaagaaaagtggaagcaacacaaacaaattacagaagcgggcacaggtgcaccacacgcatcacccaatatacacctaaaccgaatccgaatccgaatccttctctcttgttatt

SEQ ID NO: 25655 - DNA, 445 bp, Oryza sativa
actctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagg

SEQ ID NO: 25656 - DNA, 1501 bp, Oryza sativa
gaactaactaattcagcatgcatcaagttaacagcgacacactaagctatagctagctagctcgtcatcgatccgtccggccggggcggcgagaatctctgataggtcgtcggatcagccaggtgcatgcacgaacgcaatggccgtcgccgtcgcgaagaagcccttgcgcgcattggctggggttttaaacttttggcgcggcgtgcagtggttaaattagtcgtagcacgcctcgccttgtccctctcgtcgccacacgcgtcgccgtgcgcgcgccgccacctgtagctgtagctctgtacatatgcatctcatccatcgcttaattacatcgacctgcaactactggcacacatgtgtacagctctcgctcatgtcatgcctcctctcgacgacgacgacggagacggcgatctctctaggtaattaagctagctaagctcatcctttatttggagtacggagtactccactatctactagcttgccaaaacctgacaccgatgtggatgacggcaattactaattgtgatcatcagcaaaagctagctaagctcaagtggatcaaagcagcaactgtggccttatctgatccattattgatatatatcaagtgctggagtatgtgagttgcatgccttttttttcctagccttttattcctttcaaacgtcatccatttatatatgtatttgtatacagagatgctgtgcatatatcgatcggaataataataagaagaagaggataacaaaaataacttcactttttcagtcaattaggtagaagcccatgctgctgattgccgcgccatacatatatatatgatgggacgagagagctagctaggcaaaagaaaatggatacatagatacatatatatataatcgatgctagctgctactgctgagatggatgagaataaattaaaggggtcattcgatgtggatatatggcggcgcagatgtatatattactccgcatattacatgatctagaaaaccggtcgaattaatgacttaatgtgacgacgacgacgaccacacaatctgctgcatactggtagctgatagttgctagctatacctagtgatagtatctcttgaccatttagagccattttctctaatttgctggtttcatcagctagcagccacacgaattggtgaaataaaaaaataattatcgatgattaatttgtctcgattgattactgaattcaacaacatgacctggcgtatcagctagaacctagcttgaaaatgattggaccggatcgagatctacagtatacagataacagatactgcaaaactgaatcacaagtacactagccattagtactaatgatgagaagtacctacgtacttcggccagtttgtcttgcatgcgtggagcggatctatagtataaggaccgatgactctcgataaaatctagtggcggagccagaaattatataacactggtagagaaaggggctttactcccggttaga

SEQ ID NO: 25657 - DNA, 485 bp, Oryza sativa
atgtgtttcattggatttgatctgtgatgtatgtgatattggatctgatctgggatgtatttgagttgtgatgcatttcttttaggatttgtgatgtatttttcgtttgagatttggtgatgtgatgtatttgtgatctgtgatgcatttctttgcaatatgtgatgtatttcttcccaaatctgtgatgcttgtggatgatttgggatatttagggagcaaatcgattgagcaatgaaacaacaacaaaaaaaaaaaaagaatcaaccgggactgctccaccatttttagtcccggttggtaataccaaccgggaataaagatggatttttagtcccggttatttcacccgggactaaagatgggtatctttagtcccggattcgtactcccggttgtataaccgggactataggggggtttctaaccgggagtaaagcccctttctctaccagtgttatataatttctggctccgccactaga

SEQ ID NO: 25658 - DNA, 1501 bp, Oryza sativa
ccgttgactttttaaaacatgtttaactgttcatcttattcaaaaacttttgtaaaatatgtaaaactatatgtatacataaaaggtatattatttaacaatgaatcaaataggaaaagaattaataaatacttaaatttttaaataagatgaacggtcaaacatgtttaaaaaatcaactgtgtcaaatatttagaaacggatggaatatgtatcgaatagattaacctcgagctagctactggcagacataccattgacaggtcaatttatagaactcgatctcgatcgaaagatgaaccatgcatggtggccaccttttaattatcgtgacatgcacttggaaacccttttgatctcttaggaaagctagctgcagacaaagtagtgaactagctgtacactctgaataagtagttcatctcaagaagatagacgagaataagaagaagaaaactttcatgggagataacaacgtgatgtttatcctctcctatatattgaccatatatattattttctctcattggccagctaattattagcgtacgtatatatacggctctagatcgggcgccacgtacgtgttcggattaatctctagctggtaattgatttggtaataatagtgctgagatagatagatcagctggacaccagagtccgacgttccgttgaagcatcgctaatgtcgattagtacagttatggtcttccaaggtaaaaggacgtacggttagattaattgtgctcaatgatgaatacagccattcccttactgtttgctgcgtccagtttagattgtgacatgaagaattcaaggcctgcatatatatatgcgcataatatatataatgtcgtgtagaggaagcttcaatgtacctgtaaagatccttaaaccaacttgagccaactctcccatttactgttcttattttcaatcaagaaaaataccttcatataagggcaggtgttgtgtaatttagtttactagctagggcatgcttgaaagtcattcattttgcaagcttttcatatggaacaatttgatttaatttacgagcatgatcgatgagtgtttgcatgtttacacggatctgacaaattaacttgttctggaaacggtaaacaaattaaactgaacttttctacgaattaacagctgataacgaacgcatgttctgaacctaacttttcttttaaagataactatcttttgaacctaactagagggtccaagttagatagggaagttctgtaagtgcatccatcttgagatactaaggctaagcactaagctagcaggaagcaaggtcagttaagcatcagcagctagcagtagtgtagtacaacctggcttcctaagaaaaagatggccagccagacacatggttttgaatggttggctccggtaattaccaacgtgatcgatgtaataaatcgtgttgatcacagctggtaaaaaaaagagagagagatgaagattaatttggtgagtttct

SEQ ID NO: 25659 - DNA, 371 bp, Oryza sativa
atgcgccttctgttcttactcaccgtcaaggtcaagcccaataaaaagaagtccaaattaatatatgtgacggcccagtagaaggcccaattaagcccacggggcaacgacaagagcccatgtattcagcgccaccaccatcaccgccggcaagcgaagcggccgcctccgcctctccctctcccctccgccgcgtgcgcccgcccgccggccacgctgctgggctctgcttacactccacgccaaggcctccgctactagcgctctcgcttcacgaaaccccatttgctattgctccctcgccgccgcgccgtctccgtcccgcttcccgcccaaaaccctaggctcctccgaccaccggtggggggcca

SEQ ID NO: 25660 - DNA, 1501 bp, Oryza sativa
ttgcaacttgcaagatcacatgatggaccatgcatgatgctggtccctctatagttaacccttgggtacctaaacaactgaacttatgcagtggccacatgatgaagactatctggtctttccttgctcctcttgcacaacaaaattcagaaaactagctctctcttttttttatatacatcaactcagacaactactcctagctagtactgcttgatgctaaatatatgttattagtatctcctataaaccaagattagatgggctggtcaatcagtcataaacaaacataacccaaaaataaatgtgcttcggagagagagagagtagtggagggaataaggccaagaagaaaacattggcaccacaaaacaaaacaataacgagtaacagttaagtactgttggatatttttatctggctgacgaaggaggggcttcctgcctaccgccagtccttactccaaaatactactttacccataaaaaataaatctaggaccggatgtgacatattctaatactacgaatagacatttatagtaataggttatgtcttatccagtactagtttagttttttatgggacggaggaagtactccctttgttagttattgaataattgacactgacactgttaaaattacactttaacctcttattttataaaaaaataaatactaaataaatgttatattatcaaagtgtatagcaggctaattgtttcgcctaccattgataaatcgtaaaacagtgtataaaaaagaaaattgttggtagaacttttatatatgtatgttattcatgatttaaaagttaatcatagaaaataactacgacgaagaaactctctaaatcaacttaaaaaatttaaattttaatagcaggttaaaggctgaaagctgcaaacaatggtttcatatagttataaatataaccttaaaaattttatgtgttggtataattatttaaaactaaagtgtcgtacctaacagtgtatacacttattcgagatcggagagaggggtagtattttcgttggaacttaagggaagagagactaaagtttagtcactctctctcaaacaccccctaaatagaaaatactcgtgcacttaccaacatggcaacatgcactttacaattgtactacaagtggcaagggaaaaaaaattaaaaatatccgtgtgcatccactcagctcttgtcctttcccgaaaaagatctaggcccattccaaagagagaaaaaagagtggccacgtagtgtactttcagtttccaatttcaattttttgtaaaaggccttcatgattcgtgccggaccgaagtgtcagccattcagctctatcacatgatgaatattttactgaggaatcacatgataaatccgaagcccaatgtagttcaaacagtagcttaattaggttgtgtgtgttttattgtgatgggttgagtttagataacatgcccaatgtagttcaaacagtagcttaattagc

SEQ ID NO: 25661 - DNA, 1501 bp, Oryza sativa
ttacatgttattacattgtttatccgctgactacgtggctatcctctataaaccgggatttcaatactattatggtggcatcatgatagttggatcaggtggcacaagagattttatacatatgaatatgggtggcgatctagtttacggataattgatagtcattaatctacatgttcttttatgcttggaaagggtgttttggttcatttggctgtatgcatcatatgcagagaccaggggaggattcagtgcggttgtatcatcttagtgtaattgactgagtcttaataaaacctctattatcttagaaaaaaaaggcattgtacatatcatatctttatcaatatgtgcctgcacatgccacataagatatacataccagacaacggcaggttttaaacaccgctccatcaccaagtactactctgggggcggtttcatttatgtctgattggtaaaacttcagctccagcttcatcttttctgaagctagagtccatcaaacggtttcaatttcacctaaaaagaaagcggagggactaaagtgctatcacataatgaactagcgacatgaagcgggtttcagactgttccacaactccatttcagaacaaaaaatgcaccttttcacaaaaattgaaaggatgtggttaaactagcgagtcaacaaatactcaccgtacatgtacggactcactcatatcccttaggtccaaatactagggatattccgattaatgtacacgtgccttcaattatatatccgataccaaagccaaatcaacacatcacacacatcctaaatatatctctgcagccacacgcatgattaagggcatacattgctttcatactcacaagtcacaattcatggtacatgtgtatatatatggagttcaactaagtatatttgtattccaacaaataataattagcagcaacacacactcttcatattcttatagtcccatatggaggactatcctgaaaatgacatatacagtacatcatgtactccaactaataattaacaacaacacacttctcatgcatattaattgtcacttccatggactctcctgaaaatgacaggcaccattttcagttccatccaaaaagtaaagagtgacaagctagaacatgttaataatatataaatttatacagcaatgcatgcatgtttaaccaacacaagttgatcggagagcctcggaggcaaatataatactaagagcggcggtaaagattctctagcagcactagtgtcgtccttgcatgtgtgccattcgttcattcatattctcatcactagtgaaatttacttagattccatctcactcatcacaactatcaaagcttagctaagctactagctgcttcttctcctataagtagggcgatctcactctctcgcagcaagccaattaagcgaattaagcacacatcaattgaccaaacctatctctctatctctctcgagctagcgagctctaggtgt

SEQ ID NO: 25662 - DNA, 1501 bp, Oryza sativa
ttcgaatatcacatcggatgtttgaccagatgtcggaaaggtttttcggacacgaatgaaaaaaataatttcataatttgtatggaaactgcgagacgaatcttttgagactaattaatccgtcattagtatatgtgggttactgtagtacttatggctaattatggactaattagactcaaaagatttgtctcgcgatttcctccctaactgtccaattagtttttcatttatctatatttaatgtttcatgcatgtgtttaaatattcgatgtgatgtttttggaacttaacggggcctaattttgtttttcatttcttcttcgcgcgcgggagtggacgatggatgacgcagctaggtgagataattaggatgcgtccatcaactaatcaatcgattagctagccctgtatatagcttccgttgcaacggacccaaccaaccgtgcgtgcgcctagctccctcttatctcatccgttgaatttactcgcaccacacaattctccttctttttgccactgagtgaggctgacatgtgggcccgggtggtatttgggaatgaaaatttgggagagtggcatttgagcactggtattttgagagagtggcaaatagtaaattctccccgtgctcctagtagctactctagtgtcactgtgtcacggctgctgcaaagctggctcatcaacaaattaaagtacaaacacccaattaatcctttcgtcatttaattaattccacgcgagtgacatttattatttgtttctaattagccagactcatctttctattttaatttaaaaatacatactatagtagtttaggtaccagtacttctgaccagctttgatcttatagtaacacactactaacatgtacactgtctagatatttatgttaagatagatggtactgcaagcagctctaccctgatgttaaccagattaattcctagtctgacccaagacatctcatgcatcttggttcttgtttagataaaaaaaatttggccaaaaacatcacatcaaatgtttagacacatgcatagggcattaaatatggagaaaaaaaccaatcgtacagtttacatgtaaattgcgagacgaatcttttgagcctaattacgccatgatttaacaatatgatgctacagtaaacatttgctaatgacaggttaattaggtttaataaattcgtctcgcagtttacagccggaatatataatttgttttgatattagtatacgtttaatacttaaaatgtgcgtccgtatactttaaaaactttacacccaaataactaaacacacccttgatgtatactactttcgtcccaaaatataataacttttggctatgaatctggatatatagttgtctatacttatagctaaaattgcttatattttgggacatagtaagtacattttaagtgcatcgagtcaatggttttaggtgacctacgggaactaactagctagtagctagtagctagtaattc

SEQ ID NO: 25663 - DNA, 1501 bp, Oryza sativa
taagtgtttaatgccggcttcaaggaaaggctgttgtttttgcaattgattttatttgaactcttttctgaaacaactaagtgagtgcttctcaaacgacacggatgagacagtgtgtctcgtccggtcggagtatgtgcaatgtatcagtcttttgaattgatcaagattggcacccggccaacagctttcaaacggccacccgggcctggctgatcccatcagccgcagattttccaaacatcaaacccattccacaacagcaatttcacaaggcagtaaacaaaactacgctaggaatcacctcacatccgcccatgaccgtgggcacggctgttcgaacagttttaataacctctgcagaggggtacactttacccacacgacattactaacccggatcacccagctcgtggtgatcagccacgtcgggagacctccaagctttcatgacaaggcatttccaaagccgacacaggtttaccatatgctgacgagaggggtcccagaccaacaacaggttaggtcccagaccatactgtgccaggaagcccaggggtcctccccgacaccaccccggcaaatccacttgtctctcagcatcaaggctcccctgattagctaattactcagccaggggtgtcccattccacccatgtggttgcactatcatatgctcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccgttgatacccgtgcagagtgcacgattgctgaggcgcaactaggtgggtacaagggaacatggtataacaattaacaaaggaaggatcaaatgcaacaaattaggtatgctcaccgttctgcctcgtagttggggcaaacatattaagtgcaatcctagcaatgcataatattttgcaagaaatataacttagttcaaatataggctcaagatgttcaaaggtggcttgccttgctcgagatcttgagcttgatcctcgaaatcctcgcactgtgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaatgaaaaggatttatttaaatcctttttgaaaaagaaaagaaaagaaaagaaggagggagggaaattagacttccctcgggcggctagggtgcggcccgagcgaaaggggcggctcggccgggcttaatgggccggccggcccaagaaggcggcccagggcg

SEQ ID NO: 25664 - DNA, 1501 bp, Oryza sativa
ctgttgtttttgcaattgattttatttgaactcttttctgaaatcaactaagtgagtgcttctcaaacgacacggatgagacagtgcgtctcgtccggtcggagtatgtgcaatgtatcagtcttttgaattgattcaaagttggcacccggccaacaactttcaaacggccacccgggccaacaacttttaaacggccacccgggccaacaaccttcaaacggccacccaggcctagctgatccatcagctgcagatttttcaaacatcgatcccctttcgacaacagcaaattcacaaggcagtagttaaacaaaactacgctaggaatcacctcacatccgcccatgaccgtgggcacggctgttcgaacagttttaatcacctctgcagagggggtacactttacccacacgacattactaacccggatcacccagcccgtggggatcagccacgtcgggagacctccaagatttcatgacaaggcatttcgaaagccgacacaggtttaccatatgccgacgagaggggtcccagaccaacaacaggttaggtcccagaccatactgtgccaggaagcccagggatcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgtaagagcgggaaaccgtacacccggtacgttccccggtccgcggttttggaaattcatttagttcacaagcaccgacccaggtgtcgggttttccaagtcttttgtaaaacccaagttttacccaagaagttactcagattttaagtttgaaggcgaccgtcgatactcgtgcagagtgcacgattttcgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgcctcgctcgagatcttgagcttgatcctcgaaatcctcgcactacgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggtcgggaagatattgaatttctaagattattggatttttggtctaaaggaaaaaggatttatttaaatcctttttgaaaaagaaaaagaaaagaaaagaaggagggagggaaatcagactttcctcgggcggctagggcgcggcccgagaggaaggggcggctcggccgagctaaat

SEQ ID NO: 25665 - DNA, 1501 bp, Oryza sativa
gtagtttgctaccgtgatgttgcttgatttgtgctcttgcttctgcacagaagcacaaatacatttcaaatgggaatgcttatcctctagattctaactcagcttggactgatctcaaacatgaagtctgacacttgcacccacagagcagctactaggtctgagaaccatatgctgtaacactgttgggattaccaaacttcgttgctgtactgtagtcatgggaaactgatgtatgcaaatgatgtgctataaaaaggatccgtcgcttgcaacaaaaacaatagtcatgcccttaatcatccttgcaatcacccagatcaacatggagaatttatgccaccactgaaatccagccatgccttcctttgaaacaaattaatcaattcttttaggccatttgaactatagcaagctccttatgctaaccaactcttaccaaataagatgatccacgagagattgcatgcttagttgccaagaatttttgcccatatgcaagtaaggcatctattatagtattctgaagagaaggccaaaagtagccatcatttttgcttcgaggcctcaaaattacgacattattcaggggggggggaagagaaatatctatgttagtaatcacgacgagtccatattataactgcaattgatcaatataattgtatacaaaatacaattgcatttatggtaatataagcaatagctgtatattaaatgcagtcacttccaaatcttatcttatcttatatagtggaagtaacaagctttcttacacgagaacacgccacatcatcaaaaacatatcaaccattgaataaagagtttagataaataatagccattggatcaaaaagttacatatgcactaaaaaatcaacaatttgataaacatatgggaatttctggaggtttctagtgcctcctcttagacacatggtacaaagagagagagggcaaagataatgaagaaaacaaaaaccaagaagcttatagtgatttctcatatagtacgatttagttaaatctatagttagctagaccaagggatactttgtaaataaattaactcatgctaagaccttctgtaactaatagatcttatacagaatcaaaagtagcgcaacgcgcgactacgtggcttgtaagcattaatgtagctttgcgcaaaaaaacgtgggaagttcagctagttcaagataaaaattgcttgtagtgaatacggtgtcgtaaattcatattaagtgctgtttttcccaatgtgtagataaagtgcttgaatttgtataccatattgtttgatctagttttctaaaaaaaaatgcttgttgcttctgcaatgcaacttgttttactgagtcattatgtgatcgtcaggattcatgtgaggatacaggagacatgaggatcagtgaagaaaagccatgcacagatcaggagttagatgctgatcagatgaatagttctagctttaatagttccagcgagtgtgagaatcaaa

SEQ ID NO: 25666 - DNA, 1501 bp, Oryza sativa
atttctgatatattttgagcttgtcttcctggctagttgctgacagagagaaccgttacacatcacctctgcttttctgccgtgcaaaagcccgccacggttgctattaatcaactagctaggctttaatttgggcaaatgcatcgcaccatctctatacaatttgtcggcttaatatttaacaaactagcccaagaacccgctctgctagatttgacaatataacgaatgtttcttgaattatttagaatacgttcacagtacatgtacatcagttgtacccacccatgaatatgtcttggtaacacgagcttaatagattgatactcacaaaatacctattgagagtgtgatcgtcactaactgtataattatattgtctcgaggtccatcttgttccctgtcgttaccagctagctaaaaacagagcaagaggataacattgtttggaaattgcacttgcaggacatgcctatacatgtagagtaaaattggtcacagctattacaatcattgcccattttcgtaataaaatttgtgaacaaaaacagattgcaaacaccgttgcaaaaatgaaataaatatatatataatcaccgccctctctttttgtccattacaagagtgtgaaatgactggactgcctcatttattctaggaagagagcaataattctggcccatggtaggccgattttaacaaattagtctgtgttcttccccttctttctcaactcaagctcttccgttttcagtgtgcatgtttttcaaagtactaaacggtatatttttttcttttttacaaaagcattctattggaaagttgctttaaaaaaatcatattaatccattttaagttttttagctaatacttaattaatcttgctctaattgtttgctttgtttttcgtgtcaagagacaaggttggaaaccttacctcccgaacttagccttaagctgcaaggacattcctggtgaagagttttattttttggttttcaagaattccacacaatctaaagaggtttgaaatggtgaatgaaacaaacgtcttcaatgtacggtttcatttgctagcatttaaatattaaatggtgtgaaactatttggttacaataagttttttttttcgttttcaagattatgataaaatgatttagtcccaatgaagtttcattctattactaaggcataggtaagtgtgtaaaccgagtttcatctttcttctctctcttcataagtttcttaatatgttactcctccgtcccaaaatataatagtaacttgtaggttgctatattttcactagtacaataacgatttttccatgcggtcgaagagtttgcgaaaatccgattttttcgtgcggtgacacacccgcacgaggaaataaaaaatcgaaacaaaaaaaagaaaatcaaacgccaccctggaaccctaatccagccgccaccgctggcctgccgccatcgtccttgtggtcgccggtgacggatctaga

SEQ ID NO: 25667 - DNA, 1501 bp, Oryza sativa
aaatgcatgacgaaagactgaattttttcctgcgtcatataacagaattgatgactgaattttccgtagagctcactgcatcgatctgaaaataaaaaaatcagataagaatgttttcgttcgtggatgacattttcctctagatttggtctttgcgtgctaaaaaatggacgcgtcgggtaatcaacagatatactaatctcctcaatgattagattagcttgcaattgattaattatttacttcacccggttatccttttcccatttggagatctacctagtgctacttgatgattaagtattaggcaacaacttgacgcgaatgcagtggccgtattctccactgttgaatatttcgggttttaaatgcgagctgatttccattttattgccaccattaattttcgtaattaatctagtggaaacaggagtactagtagctaacttggtatgataaaaacaaagaaattaattaaattaagtcgtcgactctgcagctaacgtttcagtcgccttctttctgtatagcaccacttgtagctgataggacagagctagctaggaagcttaattggtgagaaaacgatatgtagaatttggatttattaaccttgatatatcgatcgatgcctcatcataaagcttaatagtagcaggcggcagacagccacagcctttggtttggcttcatgcatacatctcccatcgcatattacactgaaaatctacagtggccattaattggccgttgaaattttctcgccgcgaacgaagataagcattggagacggaaatttagaaagggatgaagaaatcaacgcggaacaaagtaataaactcttttagttagaaaactaattaaaagagcagcatccatgttcgtttaatttggcaggcatgttcgagtgaagaatattctaaaaagaagccctttcaaagctagacctcctccactccaacccgatggatgaggaagtgtcaaacaatgggaaaaggagaatgggatcggattagtagattagattggtttagcgccaataatttaacctagttagtcgtatcaggatgagtagcatcattggcgcgttaattaattatagcaacaatattaggacatgaaggcaaaataattaccaggcagctattactgcagtagtaacaagtgagagatggatggaggaggcgatcgaggttaattagcaggaggcttatgcagcaagttggcttctccatcacggcactcgatgggagagaggaggtcgagtcctcttctatataagagccacctctcctccatttccttcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcgg

SEQ ID NO: 25668 - DNA, 1501 bp, Oryza sativa
aaggaggctaggctagctaggtatggaacgagaaatactccacatgagagatcaagggtggccatgcatcactgccggtgtctggtctagcagaaagcaatcgagatcaatgtatctctttcgatcttagcttgatcgatgttcagttcggttgggtggtgagccgctcaaaagtatttctgcctgcctgattgataaaagcagtcgacgcaagaaacaaatcgcaagtagaaaagaaagagagagagagagaggaggaattaggccaaggaatattaattgggcagaccaataatacaccataattagattaggttagatggaacaagaatcatttcttcatcgtcgtcgtgcagacggactgcaaagaaaatactgtataaaaagaagaaagtggcaacagggtaataaggcctattttgaggaagcccaaatagtacgaggcccagctcatctcgttggactgaagcccaagaaagcaagagagacgaggcgaggcgggggcctgcaggcgaaggcgaggcccaagcatcaggaggaggccactttgggcattgaggtcaggcccaaagacgatgaactcgctctccgagagcttcgtgctgtggtcgtcccgcacggacccggagccacagatgagagagtagacatacggttgttgggcaccggcgtagtataaactcatcagcagtagtacgtagtgcctagagatggcaatggggcccattcaccgtttccacgcggtgaattcacctattaggtgacggggataattaatatctattcaccaaggggaataaaatggttaaaaacctctcaccatcggggatgacaggcccctaacccgactgactgtactgtaccatggctttttagatgttttggtccataatactaaagcccatttaacaggcatatctatatctatattaatataaaaaggaggagttgcccccctccaatgctactggccaaatcattcggattaatctgaaccatccatccgcgcgcaacttatttccaccatacgatttcgcacccgaggattgcacaccgattggccgaagacatcgctcatccgtcctcatccacccgctactgcgaagacatcgctcctcgactcctcctcactcgctcctcttactccccgctgccaccgctcctccgcggccacgccggagccactgccgggtccttttcttccccaccgccgggtcctgcttcttccccatccccaccgacgcggccggcctcttcgctcgcgcctcctcctccccgctgccgccgctccgccgcatcctagacggagctctgccggagctccgccggactcttactcggagccgccgccggagcaggcctcggcccctcatcaagtaagttccttaaatcctgtctctttccctaatccctaatcttctccgtacgaacacgatctgaaaacaagtgaccataagtttccttttttgttgaagtttgatatgtttatatgcgctcagac

SEQ ID NO: 25669 - DNA, 1501 bp, Oryza sativa
aatcagcaagcagcaaattagtatctccatgaccctattgccaacatgtgagacccctagttagatttgtgaactaaaaacacctcattactgtaacaacaggaatgtatctctcatggcaacataatctctagtactaacaaatagaacatacaaagattaaatctattaaccatttgatcaaactggatgatgtaggatttctttcataaacatcacaaggaaaataaaattggatttgatccttatgggctttcaccttgtcaaatagcagtgtgcattaaaagtatcttattgttgctgctagcaaatcctgatgcacactccatttcttgagaatgtcagaaatatatgcaacttgatttactaaacaagcaaataattatgggtttgcaccttgtcaaattcaatatctcttcatcagctttgtaactcagcaaataaaatcagaaagtgtagttcttaccaaacattcccttttaagaaaataatcgacttggcttttatgaaccctcgaataaattaccagagacttgaattttaatttaagatatataaccagagcccagaggcaacttttctcaaccatgtgaataataattctcagtccaggttaaggaccagatgaataataggttgggggtttgttgaaattttgtataggtgagaaggcatattagaatagagctttagacatattcccaagtcccaacattcaattaagtgagtgtgcagagagaagttcacaggaaacataagacgcagactacttagtagtgctatgagtcaatgataaattactttactaagaatataatattgacataatcaaacttatatcagtttaaaggcatcaactttccaggtaatcaatgagcatcaagaataccttaacaacaggatgttatacacctgtactaatctggagtagtatggtcaatatgcctaaaaatgatccaatgagcatactaaaattatactattttttttgcttcaagcaagaccagtgaaaaaaaaagtcagtgcagacatgtaaatgaacatatctagaggtgcagtgtggaggcggatgatggcggacttgaggtgcggaggaactattattaggagatactaaatcaagttataacatatatactcagaatacgatagaaccttacgaacattttgttgagcagttcatgagcagaaaaaatggttactttgagtaaaatgtcttgtaccagtttagttcaacaaaagcagcaagctaagatttcccagcaaactcacgtgtatagctaaaaagatttggaacaaacatacctatatggaatcgatcaatcgctcaagcttcaatgcttaaaataagcattgagtgtaggtaagagaataagtagctaagaattatagaggctggatttagatgaatcatatctccgaagcgcaaatgcctgccagattccttatgaaccacaaggtaaccaatacaaaagcaaactggaaaaaatatagcgaaaca

SEQ ID NO: 25670 - DNA, 1501 bp, Oryza sativa
ggctcgtctcccctcgtcctgtgcaacatcccggtgtgctcgccttcgcctgtatcgccatggttcgctccgccgctcgccgccgtcgtccgccgtccgttccggccggcgtcgtcgtctacctcccgccggcccgcgtggcagccacataggcgccacgtcggcgccacctcggccgcgaccggatcggctgacccggccagccgctccctccattttccccccgtgcgcatggtccgcggtgagccgtgaggttgcgcgtgggcccgtcgcaccgcgtcctccgcgaaccgcgcgcatgcgctgcgcctccctccccaaaccctagcacgacccgcgtgcacctcgctcacggtgagccgagtcaccgacaagcgggtcccacccgggaccacgtgggatggacccggcccaccggctctctctctcctccccgcccgcgcgcgcgccctgggccgccttcttgggccggccggcccattaagcccggccgagccgcccctttcgctcgggccgcaccctagccgcccgagggaagtctaatttccctccctccttcttttcttttcttttctttttcaaaaaggatttaaataaatccttttcatttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccacagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccaactacgaggcagaacggtgagcatacctaatttgttgcatttgatccttcctttgttaattgttataccatgttcccttgtacccacctagttgcgcctcagcaatcgtgcactctgcacgggtatcaacggtcgccttcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgagcatatgatagtgcaaccacatgggtggaatgggacacccctggctgagtaattagctaatcaggggagccttgatgctgagagacaagtggatttgccggggtggtgtcggggaggacccctgggcttcctggcacagtatggtctgggacctaacctgttgttggtctgggacccctctcgtcagcatatggtaaacctgtgtcggctttggaaatgccttgtcatgaa

SEQ ID NO: 25671 - DNA, 1501 bp, Oryza sativa
actgacttgaaaaatatctgaggtgtgataactaccagaagaatggataaatcacaagtacataacacaaaaaataagatcgataaattgggtgggaagcacaaaatttgcagattttcatggatcttaccagttaccactaacctcacacggttggaaatgatgaaaagatggaaggacaagatgagaggagggagggcctgaatttcaattgggatggacggaactggtggcgaacttgtgccgcgtcgaagtcgaaccggccggccttctctccggcgggcggcggcgatcgtgtcttgaggagaggagagacgctgaacagaaggacactccgcttctttcctcggatgcgatttgtcccagttacagcccaatatcgaacagagataacaactgacggcccaaagtggggcctgttactaggtgatggcccaacagaggaccatgaatgttctatcgtagagcttggcgggcccattaacaatcagcaaccccgggctggtcttggaccacacatcctccaagaatagcccgttaacacaacacgagtaattcggaaggaataagtaaccccggcggcgagtgaccggagaaggcgggtgagcacgcggccggcggagcggagtggcgacagccgtgccatctgctgccggctgtgcatcgagaagattggagaggaaaggagaagagaagagaagaaagataagaaaagagaaaaaaaatagaagaaataaggtatgtgggacggtaagtgaacttattccaatatggaacggtccgacgtcacagcccatatggcctgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcccagcatatatgcaagttgaatcaagccccaactgtatgtgtttatatatgtgtcgcccagcgagaggagctcttattgccaggtaattaattaacttgtacaagatacaagcacaccacacgataatcatacggtacggacgagcataagttactcttagctacgtatataggtgggtagctagcagagaataattattctgcaccagattcgttgatatcaacttgagccttgatagagagctggatcgatgtatcgatcagctcagtagtagggctggatcttccagcgctggttgtcgccctcgcaccacttccagagcacgatgtcggtgccgtcgcggacgccgccgtggtacttgtcgccgtggaaggcgtcgaagttgaggtagatgttgttcaccatgcggatgcacctgaacccgttccccacgtcgcggctctccgtccacagcaccgactcgtccatcacctccgggttgtacggcaccagcctcacctgcacgcaagagcatcgtcgtcgatcgccatcaatggccggcggattcagattcagagaaag

SEQ ID NO: 25672 - DNA, 1501 bp, Oryza sativa
ccagcaagacttgtagaaacggcccgtaaaaccgtcaggactgggcgccttatcagagggcaaggacttgatcaccgcccagacctcatcctctgtgaagggacagtccagcccctcaagctgcgcagggcggaggccaagagagtggaggtctagggcgagttcacgctcgaagctcgtccccaagatggcgcaaaagtgagaggaggcaagctcttgcagcgcatcatgggagacgacaagctggtcaccatcacgaaggcgcgtgatgaagttcttccgcctacgagctctggcgtgcaggtggaagaacttggtattggcgtcaccctccttaagccagaccaaacgtgaacgttgacgcgcgatagtacgctcaagcgaggcaagaccaagacacttcaactttaaatctcgccacagccaggtctccaagggggaaagagaccgactctcctgcgcaacatcaagccggaagacaagttccttcgccatctgaagctgcagacgaacactgccaatgtgatgttcactccagctctgtaagcgcttggccgtggtagagaagcaccagggaagagcagcaagagggggtaggttggtagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggtgatagaagaggccgcttggaggaggcaagaggggaaaagctcctcccaatccgcagagaagaggacgcggtcgagcttaacaagcgtaggcgactcgcgctcattgctccaagtgaagcgacgtccgtgaagcagcagctcctggagttccaactcgtcgacgagtcgacgaaaacgacccatcatacgacgattgagattaaggttgtttttatcccgagcttcgagaatgaggttgaaatcgcctacgacggcccacggccccgtgcgagaggagcgcagcgaacgaagctcatctaagaaacgaagtttgtaaggctcctcctgtggcccatagacgatggagagccaccagggggcgacatcagaagagtgtcgaaccaacgcggtaagagagaaatccgcaaggtgaacatctgagacagaccagacagtcgtccgccaggcaagcaacaccccccactccgaccgaccgcagacaagaaggaataatcaaagtcgaggcctagcatttccagaatagtacgagaggggattacatccataatagtctcctgaagacagagaagagagacatgctcatcacggactacatcacgcacagcatccgggcgggcacgcgagttcagacctcgcacgttccacaccaaaacgttctcattgcatgatcccattgagggggaccacaccgagagtagaagagaagaaaccgatcagccgcacacgaccaacgcctccgcagccttgcccgggggcaaggagccgg

SEQ ID NO: 25673 - DNA, 1501 bp, Oryza sativa
tcagcaagccatgggaaataagtgtttaatgcaggcttcaaggaaaggctggtgtttttgcaattaattttaattgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgtagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgtcgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtattttgtaaaactccagttttacccaagttgttactcagattttaagtttgagggcaaccgtcgatactggcacagggtgcacgaatatcgaggcgcaactggatggttacaaggggacatggtatagcaattaacaatggaagaatcaaatgcaacaagttaggtaggtctaccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgaactctaagcgtgccattagatagatctcgagatttgagaaattttggaatttgaacggagtcaaacggatttacggttgggaagatattgaatttctaagattattggatttttggtctaaaggaaaaggatttaattaaatcccttttttttggaaaagaaaaagaaaagaaaaggggagagggagggaatatagacttccctcgggcggctagggcgcggcccgagaaa

SEQ ID NO: 25674 - DNA, 569 bp, Oryza sativa
taatggcgatttgaccgccattaaccgcgctgatgatgggggcgcctagggcgcgaaaatcagggggtcgacctggccatgcccagaatcgtcacccatgccgcctggactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatca

SEQ ID NO: 25675 - DNA, 212 bp, Oryza sativa
  unsure (1)..(212): unsure at all n locations
ccacattgcctgcagccccacttcggatgtccgacgcgtggataatataccaatccaacagcttgccttgtttggcactatccaacaaggctgcacatggcatgccttggcccggctcccaaaaggggattgtgcagatgtggaacgggacgactcgccttcaggcatgaccaaatcgctagcgactacntgggtggtgactacaaccacca

SEQ ID NO: 25676 - DNA, 524 bp, Oryza sativa
caggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagca

SEQ ID NO: 25677 - DNA, 394 bp, Oryza sativa
ttcgatacagcttataacgccatcatcgggagaactgcacttgtgaagttcatggccacatcccactacgcatatcaagtgctcaagatgctgggaccgaagggaacaatcactatttaggggaacgcaaagctggcggtgcagtgcgacaagcggagcctcgacatggtcgagcaaacgcccaccccacccgccacgtctgagccacctaagaaagtgagcaagccaaataagacgccaaagccagacggcaccatcaagatcgttccgctctctagtgctaaccccgacaagactatcaaaatcgggactacactagatgagaaataggaactcgcgttcatcacattcctccgcgataatgccgacgtgttcgcttggcagccgtgcgaca

SEQ ID NO: 25678 - DNA, 344 bp, Oryza sativa
agtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgaca

SEQ ID NO: 25679 - DNA, 597 bp, Oryza sativa
cataatagtgttttcccctataatgttactcttgcgaggtcctaaaggtaaaactagaaagcctgaagattctaaatgaaacattgactatgtatataattaactagactccggtcctcaaaaagcgcataactccataaatatatattctagaggtacatatctcatccttgaaaacaagtagaacatcaataattacactactggtaccacacacgtctcacataagttcataatctggcaaaatatatattgcaaaccatatatatagtggaaacatgtaaactacatattgttgaatcaaaatgcaaaatttgctacatgacacttaaaaacttattatctttgctggtagacgtcgtaagaatgtgattttttcctaatgacacttcgaaagcgtggtaatttgccataggacaccgagcgcataaaaatacaatatccacccaattgatgagagaaaaactatgtaaaatgtttgttttgccctcatcttcttctcccttctcatcttcttctcccttctcctggtcttcttccgacaataggcatcggcggtggagctatcatggacctctgccttacttccctcgcagg

SEQ ID NO: 25680 - DNA, 266 bp, Oryza sativa
tgcatagataagggcaacttatttagttattttgatacatcttaggcgggccggataaactagaacatgatactattcttttacatgtgtgtgtgcgcgcgcgcgtgtgtgtgaaatcttcttggaatcaaacagtaacctacatgtcacttcaatttagacagtttactacctattcttaaacatttttccttctgtatagtttacatgcagaaaaggtgcaatttcaccatttttaagttcataaaattgatttttttatcagg

SEQ ID NO: 25681 - DNA, 281 bp, Oryza sativa
cagagagagagagagagagagagagagagagcgcatgggctcatgctagcatatattatagcgaatatatatgatatactttttatttttatttagcactcactgaattatcctcaaatctatgcacagaacattgtgatgccattttaacactccaccaatttcactttttttaagtaaattgaattagttgtagtatctaagtagacaagtaggactgtgtacaaatacctatgcctttgtgtgtgatcgttactcctctttctctatatgaaatcggc

SEQ ID NO: 25682 - DNA, 1501 bp, Oryza sativa
tactcctatataagcacaagagagaaagaaaagggctagagagctgctttggtgtttcttgggccaagctagtgtgtgcagcaccatcagatcaagtacgtgattcctagtgctttgctgaattactaagcgatttatcaatatattttttccaacaatcaaattagaagtaaaaagaaaaaaataaaatatcagggtttatcagtacttatcataaaacaaacaaatgatattcacgctttaaaacatattgataaatatatgttaaatatttaaaaatgatagatagatttgataaaatattgtagtcggagggtgaactcctcaagcggagaactagaaagcccccattttagttcggcggggggcagcggatgagaatcgaggtttggaggaaggagtgatgtggaggggggtctggcccctcaagaacgatgagacaaaaaggggtttatacaggttcggaccgctaagaggcgtaataccctactcctgtatgtggttgattctgtgaggaacaaagtgtatccgtcggttgaaatccgagagctccctctcctcactaggcctggaccttcttttatacctcaaggggttaccacaggggcccaaaaatccacctagggaagaaggaaaacattctttgcatttattacatgtcttattcctctgacagagaagaccatgcgcacaacatctcagcatggccccatcagatcacgccgagcgacacgggggacgcctacgtcattctgcattaactgcttgaaaacttccaggcacccgttcccaccaaggaaagaataccccaatttaactggagcaggaaattgtccccagtttgtatacgaggcaaagggcttctcatcatggtgatgtgaccagatggcaccgggcacatgccacttgacaggcggtcagtgcgcggtcagtgcacaggtgcactcaccctgccacactggtcattcgagcgtcgtgcagcctatcagccacgcctacacgccacggccgtaggatctgccttaaatgcggttaggtgggcgttgggcgcgcccactcaacccgcacatgctggcggatgcgtggcctgacccctaactgtgaaggggtagccgccgctccaccccgggctcgacccccctcgggggagttccacgtgggtgtttgggggcggcctcctctctctagacatgatactccctaacctatatcaccgacaattgtgcaaatgatgtgagggtgtgatgattggatatgcttgtatgtttatttgtagaattaaataaattgtcgatgatgttgtatgcttgcatgaggttaaatatgtaattattgctagtgggtgatgatgtggtatggttgcatgttgagctttagatttagtgggctataactttatagaaagtatagataaaacaggagaagacgttgttacaacggagccgtcggtgggaaatccacttttgactccctcaaccataataccgtataccttatcccc

SEQ ID NO: 25683 - DNA, 625 bp, Oryza sativa
cctgctctaatggaaatttaagagagagatcactccgctaagtaaacgagacagaagattcggataaatatgtcgtatcctatttaaaatagaggcaacgaaccgattcaggtatgtcataccctatttaaaatagaggcaacgaaccaccaatccattagagcttatttaatatttaatagtatatttaatagtatatccaacaactcgctccaattaatttatagccaccaatccatttgagcaagtttaatagtatatccaacaactcgttatccaatcatttatacaatagttatttataagcatatattacaccattaatatatagtcctactttttatatacacacaacatattaacgtccgtgctgcaacataagtcgttatttataagcatatattatattatttatggtattaatatatgatcctacttctcatatatacacaacacattaacgtccgtgctgtagctggctataaatctatatatatacacaacacattaacgtccgtgttgtagctgactataaatctatagcccgctttcatgatattgaagtctgttcttagcccgcttccgctttctagttgcccgcttttctctctattctgacgctagt

SEQ ID NO: 25684 - DNA, 362 bp, Oryza sativa
catgcgattgcggcgtcacgatatgctggtctgtgtcgtggaccctgtgagcgtctgttttttttcccttaggtagtactagtacacacaacgctaataatcaactagccgttgcgatgtggcttactttaattttgttcctgctcttataggattatcgtaaatatgctttaactaaattgcatttaaagtttgtagtatatgttgatcctgtggacgttgccagcttatttatatatgagtagcctcactacctgttcctcgtgtgaacatatcgtaatggcatccgcgtgctcccctggacagcattttgtgtaattccttctgtattgacctgatggtacatgaggttatttgaattt

SEQ ID NO: 25685 - DNA, 1501 bp, Oryza sativa
cgccgacgcgatgacgccggcgtgcttgtcctccaccagcgctctctcctcctccttcactctcgggtgattcgtgtgctagttagcgtgcccagatcgattgagtgggggtggcagtgcgagtgcgagtcatgtgcgctagagagattgatcgctagggggcgagcctggagagatgcggtgtggagctgcgggccgatggatcgatcggtgatagagagcctagatttttttttcactttttggtcccttttgaaaacttatttcacaaatggatcttttgtaaaacttatcccaataatgaacctttttcgcggtgccaacatcataggcttcatatatgatatgagtggtttagcttccatggggtggctagggacgccgtcatgttagaccacgatgctaatgatgttactgtcgcgaaaaaaagtctaatttcagaataagtttttttagaggtctatttgtaaaacaagctttcaaaaaggactaagggctagttcactttgttgcccaaataaaccatttcacatttgggtaataaaactttagcatattttggcattaccaaaatttgacagtgttggctttatttgtgtcgatacctttggcaaattttggtagagttttaaaagaagaagcttctacaactgctaaaatttagtgagataataatggttgaagtgtgtatactttattgtcttatcaaaatttagcaatgccaatatttaataagattgaaagtgtcaacaaactgaaaatgccttggcatgtgcaaaagaaaaaaaaaatcagggctcagagccccggacgaaagtcatcaaaaccatacaggggacggacgtgatcaaaacgcatacgagtgccaacgaagccgcggatctctggactctggacacgactccaacttcctccccaacagcgccacacaaccgtaatctcattacaaatagggcgtacgtacgtccgcccaaccgatatatcctacccctacccgttttgtttttctctcgcaaagacacccaaaaccctcgacgacagtacgaggcactcgcgagatccgccgacgtcgcatctagttcggccggtgagttttttctttctccttggattagttaattaggttttagagacttacatgcatatgcatgcccttcttttaatttggtcttgattgggttcttttgatcgattaccatatataaaatcttcccttgatccacatctatatacgtacgtgtttaatttggtccagatcgatcagatttgataacttgatctttgtacgtaattaatcgattgattggtaccaatgtatagtgcaatttgataagttgaaatttaatcgattgagtgcagcctcataacacctctagaatcgctgtgatctgcgtgatcgatcgatcgatcgatcgatcacgcaaacataatgcttgcatgaatgccttcttttttttttttaccttgttctttagtttgctaattaacgaattcttatctc

SEQ ID NO: 25686 - DNA, 401 bp, Oryza sativa
cgagaggcgtcaatgggcttcggcatactttcttctacgagaaattttataggaagattacactggaaattttggtactacctccaagtacttatttgtagtactagaggtaaccataatttctagaataaaatttggtatctcagtagctcgaggtaccaaaaaatttcattaagaatggtaaaattacccttcttttaatgtttgagcttttacccaatcatcaaaattgagatgttcttgtccattaacattattactcctatgaattctaatatgactaaactaccatgggcaggtaattctaatgagatttactccggtccaacaaaaagtacctcgaggtaccggtacctcacggtactaaattatttctaatcgttagatcttgttgggcggga

SEQ ID NO: 25687 - DNA, 1501 bp, Oryza sativa
gcaaccggcaacaattttcacagatccctctgctgaaataataaagtctgttaggttagtgtttccaaactcaagtcaccgcctgtgtttgcggcatatctgtcataatgctgttaagcatttgaatcacgtaatttgcaaccatccagaatttctatctgattttaagagacgtatctatgaagaaaggtctgtaacgttctttgacttgaagtggaaggaattggttaacgcatataatctagacggcaatgattggatgaataatttatatgcaatgcgtgaaaagtgggctgctgtgtattcccgtgactcattttacgctgacatgatgacaatccaaaatgctgaaggcacaagtgatgcattgaagaattttcggaggaaactctgccttccagaattcttagaggagtatgagaagtgcataactagtttccgccaaaatgaactagaagcagattataattcccgtcaaaccagtccggttccctatgttcctgatttgcctatgttgaagacggctgctgagtcctatacaaggaatttgtattcgcattttgaagaagaattcaaaaaattgttcactctgtcttgttcgttgctatcacaagacagaacaatcagtacttacaaattgacacctttaaattctgaagaagaagcatatgttgtttttaattctgaggatacaacagtatcatgttcttgcaggatgtatgagtgcacaggtatgctaccatattggttatgtttccaaaacgtaaaagtttgattttcttgctataatcggagattgcatgtttttgtaggtatgctatgcaagcacgcgctgcgagtccttaactacagcaatatttttacattcccctcacactatgtttacaaaaggtggacaaaatatgcaaaagccggactatttggctgcagaaacaattcccaaagcggcaatggaagttcgatgttaagatgtgcgcgtatatctcaaaagatgcactcagttgctctaagatattcgatgtcagaaaaggcgcttcagtttttggaaagtggggtagataagttgacatgtgaagtagaaaatttacttagtcacataaacttaaatggaaatggaaatgataccggtcaatcttctggtttttgcaatggtgcaatggcagaaagtttaggccattcagaatcaatgtacagcgaaggggcctaaccgcctaacctgcaaaaatactagaaaaaagtgttctcaaggaggaaaatggaaatgcactgctagaaggagaggcacctacaatcaactgttattttctgtttatgttaaattcaaatctcagttcttaactgtgtgaggcactactccaaaaaggaaaaaaaattcaaagagaatcatgttggtctcatcatagatagagggcatccaattctctagttgctgtagttctcttaactttttctcctctttgttcagggatgaatcatacataattctgggcatatcatcagc

SEQ ID NO: 25688 - DNA, 316 bp, Oryza sativa
cccccgttggtggagtgcccggcggggagcggggcttgctagctgtgtggggggcttttcgtcgcgaggagtgcacgccaccgtgcaggtggtggacgggacggaatggctataaaatggggcgccattgccaagaatcccaagaacaccagccaggaatcagaagccagaagcagcaacgctcgctctgattctttctttcctcctcgagctaggtgcgtagttgtcatatttgatcgatcggttttagttcttcttgtttaattttgattgcgcttgtagcagcaggaagtagttttaattttggtgtgatcga

SEQ ID NO: 25689 - DNA, 760 bp, Oryza sativa
ctaagctacttcattagtgattagttgaaatgtagatcagaattaccttttggttatagaaacacctgcaaattggtgggtgattgctaatttataactgttcgtatttttagaggtctttcaaatgtaggaattttgcaggcttttctattatggaaaccaactagcttgagaagtatagatagatagatagatagtgtctgtattactaaaagcatcaaattattgaccaatggatcagtattttcttttataacagtagaaattcttggggttactctgcctaggcttcccggatggaataatgtgcccaatcgtcagtatttttgttcttaacaagcaaaatcatagcaattttttgtttctgtaaaaaaatgatctgtgttgatcctttgaccaaatccgaaactaccaatgtcatgttcaccattatttttttttttgccctcccttgtagcttcttgttgcaatttacgattgtctggtctacttgaataaggcaaagtgataagttacttatgctatggcatgtttttggcaccgaaggattgcaattcacattgattttagtataccatttatatataaaaaagccttaatgttggcgtgaaacattttctgtattttaatgtttcggacaaagtgttgacgtgaacttggttcgttgtgctttcccttttctcccccttggacttatgctttgttcatatacatgaattcctttatgctctccttacctgttaactttctccctgacagc

SEQ ID NO: 25690 - DNA, 1257 bp, Oryza sativa
ctgcgtgcgtgcgcagttcgatcagttgctccttctcgaggaggaagaaacggacagtggccgtggtcctgggcaggtgcattcatgtgctctgcgattttcgaaggtaggcatgcaagcaatgtgctactggttgttaggaggctgggatggaatggaatggaaggcgtgaatcgaagcattggcaatttggcgtcgggcaaagaaagaaagagcatgagctgcaaagagcaagggaggttttgggctttttggcggtgttcatggaaagcggagctggtagattagctgtacgtagtaacgtaaaaggccgtaacgtaaggggctagaatagataggtggctggagagcggagcacggagccgcgcgcgcacgcgcgggggcacgtttgggttgcccggcgacgaggctggtactcgcgcgcggggaaggttgtgggcttctgtgcgtgtgcgcagatggtttattacgaaaccacttggttttcgcggaaacttaaataggtttttttgttgggttgagatcacaaaaccgctcagtaaattggtcgagctaggaaaaaagagtttaactagattttaaagttttggtaaaagttaattgaatttcacggctagtcaatggtttttaagatggttttcgtgaaaagcagagggaacggacttcatagcggttttggaaggtgatttggtttcgtgaatccatgcagactctatgtcagaatgtatatatgtgaatgaattgtgcggacaaatatcgcacatcggttgtcaccatctaggtaatcttgtgtatggccacacaggtctcaaagagtggtttcgataaaaaaaataagaagagtatcggtatcctagcaagatgatattcagctggttacaaggtcttaacagacaatggaaaaataaaaactctcattttctgtgatacaatttcaaaattgaaggcgagtttttttccccttctgaagtgaaatgataaatagtaatattgtaagaaaataagacgtaactgataaaaaaatatccctttggactagtaacgagcaaccgaccattagattaggagctatagttatcaccaggatttcgatcgtagtctttaactagtgttggtatagaaaaactattagtggtacggttgacaaaacccacacagtggatatgccactgctcaaaatgtgagatttgttcttttctcacttgaaactttgggtattgcatacatttatgccactacgatgatagaatctgacaa

SEQ ID NO: 25691 - DNA, 176 bp, Oryza sativa
tttttggacattacatgctcgcactgttctcttttttcttccttttttctattacagaatatgtctattgctgtaaatagaaggcgttcaagtatgctttcccatgatgtttttcactttactaagctctaatttcaaggacatcacttatttgatatttatgtgctctcgccaga

SEQ ID NO: 25692 - DNA, 358 bp, Oryza sativa
ggcctaggcggcggctagtgggtgcctaggtcggatagtcagatccaagaaattagcaagcataacatgaaaattagttatataacaccaaaatagcaactaaataccacccaagcaagttcagctacctaatgcaccatatagggggtgcctagcgccaacttttagaagacagtctccgtatattagggatgaaggggctagatggctatgttgaggtctttttggagcaattatgatggcgcaacattcaggagtcaggacatcacaaactccataaatatcccacttggcaaataagacaatgttaactatgtttccgtgctgcaaatctcatgtgttatttttttcacccagg

SEQ ID NO: 25693 - DNA, 1501 bp, Oryza sativa
ccaaggcccatggagccaactctagggcagatgaacagcgcagtgggtactgtggcagcggattaggagataagattagggaattgggaaataagataaggatgggattgtattcatttggagttaagcaatgaaaatcaattagtctaatctcttcccctaatgttcttctccccaacctaagtctacattccttctccaagagccaacaccacttgctatctctctgaggtggttatcctgtcatggccttgggtcgtggcacatctggaaatcaaaatttgtttgctctataatgaaacgatgaaaacatagccattttggataatcgggagtttggagcgccctactgaagaatttcactttttaaaacccatattttactagaggaaacaccatattgcccagcccattgtacggccaactctttggtcctacactacacctacatcattgttaatttgtcattaccccacagcacttttggccaaattggatctgcagggactgaggtagtctcacctcagtccctgcaggaagtgaggatgttgttaaaagctaagttatttgctgggtgtggtgttttcctttttcctgcttttcttgatagtaagttttttaggcaggtgtgaaggaatagcatcattcacaagctgcattggatagatactttcttataatagctttattgaatgctgcggtacatttcaagcattgtttgcttgtgggttataaatgcaacatatggtatggtgagaacccatgaaaaatgtctatagttctccatagttacatcaacccagttgtaaaagagcattatcattagctattagctcagggcgaagtaaatatttgcatatactgctttatcctgaattttatcatttcatgacttgatatttcatataactttgtagttgtgctaggcctggtattatgagattctggcctacggaggtaccacatcagctagaactgattgtccatggcttgggtttgatttgtgcttgatttatgttatggacgctgattcatggatcgggtaatggtctgaagactgggataaagtccatatcattctcattggcattggcttgtccgatgttcaggagactctgatcaatctacctaagtaacctaactttatgattttcctgcttaattaatgatggggtacatgggctccctttatatataagaaggattgatttgacatctgaggaacaaatctataatattatagacactaatctgatctatctctaatttactgacaagctttatctgtcttaactagataatctcctacctttatttgacttattcctaatttgatgattaacctgctaattagctgtaagggctgtcctggccatgccatgacatttatcaacagtttggtgaaaattgacaggtttttagaggatgaaaatttggcctcaggtgataattttgtcaagagaggtaaaatggacttgttccattacttcctggaaacgta

SEQ ID NO: 25694 - DNA, 692 bp, Oryza sativa
atttcgttgacggccgtcgcccgagagcgaacggccgtctgccacgtcattttcgccgccctctgagagggcggcggtaggcgactacttccgtcaattttcaaaatggaaaactatttttgtaaaacttttaataaaaaaaattataaataaaaaaaattcgcactccaccgtccggagacggcgagcggctgacgtgatgtgggtaggaagaacgcgtactacttttcaaataatccccaaattccacctgctctcctggtcttcctctcaatccgcttgccatcgatcggctacccaccaaactccctcactccgctgagtgtttgacctgcttcggcagcggccgcgagagcttccttgggtataatcaattccccttttccactcgtaattgctggcttcttgctcgctatgaattgcatgttcttgattggtctgtggttgtgatccgtccgtgttggtggtggattgggagtttgggggaaaggggaatggttggtgatgtcgaggttgatgaaggaacgggaccggaggattcggtgttggagttggtggcggccaggagaacgcacgccatgtgttcgtcggattgtcgcagccagctctgagtattgaattcttgctaggggagagattggagcttcgttgctgttgctctagtggtttgtttgaccggaagcgaggccata

SEQ ID NO: 25695 - DNA, 280 bp, Oryza sativa
tacaaagtatctcattgtttgaatatctaactgacccaaaaacaaagtttagaaaaggaatcaaggaatattagaagcacatagtctgaattttgcaaatattcatccaacgtaggttctgggttagaaaaaaagacagaacaactataatgggggcaaatccaaaagatacagatatagcatatctgaactaaatccacaggcataccatcacctgaatagtatgtaaactgggtattttccattctactaaatccgcatatccactaatatacaacaa

SEQ ID NO: 25696 - DNA, 1501 bp, Oryza sativa
atttttaaaatttaaaatagttaatagtaatcaactaatcatgcgtacgtttttttcaaaaagtttttatatgaaagttgcttaaaaaattatattgatccatttttttaaaaaaaaagtattacttaactaatcatacgctaattgaccgctccattttctgtgcgcaaaagatttgttcccaactagtctcaactaacttagcctcagcctagtataacttatcatttctgtgaaaacatactcctacttactaaggaggtcatcatcatattcatacatgtgggttccatgtcattttaactctagaacttagtattgattagtaatatacctgctggctgatttattatttaaaaaaaactcctacgaacatgtgggttccagacatgttagacacaaacaatacagccgatcgatgcgatgacctcctcacatcacagtcacagagtcacagttacagatctgctcgctggtcgtggtgatcgggcgcaggcgcagcaggtcgggaagggagaggcagcctgagccttgcaatgaggagcctggccacgttttccgctgcaacggcccccgtctccatggcgctcgctgcgctctcgaatgtattcacgtagtacagctgtttaccgtccagtattatcggagcaaatacttctggagcttcatagtgtggatacgcaggccagtttatccggatcgtctccttcctcccactgttgttgttgttgttgttgttgttgtgttacagcattcattaattaccacacaatcaattccagcaagattaagatatgtacgacagcccgcttactgcttacctgaagatctggtccagcaagctctcattcagcttcacacgcgagaacaccttgtaagtcatgtcctgctcgctgtacttcttcagaatcgaaatgcttgaaaacgggatctcagggacctccatggttcctatcagctttggaatatctgataccgagcttagaccgaaaaatttctgcaccataacaaacaaagtttcagactccctcatactttacaaccaaacaaggctgccctttcatcaaccaaagtttcagaccatgctatctgttacttgctgcatgttcttcatttaagttgctgccttggtgcattgctgtgggaaactagtttgttacagggagcaccatacacacttacaggattcaagatgcccctcacgaaggttgcatgggtatgctgcgtcttcctcgctggaatggagattggggggctgaatgtaatgttcacctcgtcaagtggtgttgcaaccaccgttgctacacaattatattcaagacctttattcgatttcagaatatagtgatcccctgcatattcaattgagtctatgccttcttgcagatgcaaggtggcgttagcagcctcgagcaatccagcagctagctgccagttgccccctttgacagcccacagtcctgattcagaaccagctaaagaaaccgcaccagcaaggcca

SEQ ID NO: 25697 - DNA, 1501 bp, Oryza sativa
tcattcaggtgattactctaaactgtagtaaagttgtggagtgccaggaatgcatgaactatacagaatggcctgaggaacgtggtttgatgcaggaatctgaagatggaagctggcatgtaccaacaacaaatggtgatgatattgagaaaccacggcagtggatttgtgctactaggaaaatttcagggaaatcgtctcaagcacttgcaagggcagttgggtaagtgcgatgggttgcatctccattgacgggattggtgcatgggaatggcagccaaatttcgggccaggtatctgcgctgctcctttgttgaattggaggcggcttgaagagaatcacaccattatgtaaggcggccggcagatgttgatggaattgagggctagctgctgagctgacccaaacgatggctgtcaagttgtaggaagcaaagtaaaagatttctgtagcacatgaaaaagtttgccactctcttaaaatgtggatgtcatggttgttttagctggccattggttgtacatgtacatgtattttcctcaaggttaaaatctgaaacagcgaggactagtcaaacaagaggtcgtgtaactgaaattattattactagtaggagtaaagttgaaattgatggagagaatataatactctagtgtacatatggttggtccgtccgttatccttgtgggtggagagtagcgaatgggagcaggccgcgtggaggcatggagcccccaggcaaggcgcgtcgcccttccagccacaacatccactgtctctctctctctctctctctcgctgctcttcatccgattcaactcggaccaccagatttcttccttccttccttgcagaatctttcattgttcttgttgggaggaaggagacgaggcgcgcgaggcggcgagagggaggaggcattctagcatatacagatacagagccaggggaggtatggaggagggccttgcacgagcacgacgatgccaatagaagctgtggcggtcgcttctttaccgatggcgtcgcgcagcgccgccctgtgcttctcctccgccgccgctgcccggagccggagcaggagccggcacggcaggatggccgtcagctgcgacgccggggcctcagatctgctctattcctctctggtactacgttgtactccatccgtttcaaaatgtttgacacatttaactttttagcacgtgtttgaccattcgttttatttaaaaaaaattaattaattatttattcttttcatatcatttgattcattgttaagtacacgtatagttttacatatttcacaattttttttaataagacgaacggtgttaaaaagtcaacggtgtcaaacattttaaaacggatggagtcctagtatattatctctgtctcaataattaggatactaattaattcatgtgtcgctgataaccttctgaatgaatgttattgttatgaggcaaggctgccaagctgcttggccctcccaccagc

SEQ ID NO: 25698 - DNA, 399 bp, Oryza sativa
agtacatttttatccagattaagtggaaaaaagagatatttacgccaaatatagctaaatggaatcggacgaataaatgtagcgacttcatcgaatggaagcgtttgcgttaaccacgcttgaacattaaaaggtttaatatgccaatcagcgattatttgatcgctattttggtagacaacgcaataatactcagcattttcggcaagaccaatctgccgtttttttgtttctttcttgcatattttgctaaagatattcatttatggctgttactccccaaaaaataagtgttttttaagcagttttttcatcatttttagcttatacttaacgttttgttggcctatcttggctataaatttctatttcgtcatttatccaaagagaatttttcga

SEQ ID NO: 25699 - DNA, 489 bp, Oryza sativa
ccttgatcttgggcataagcagtacgcttgcctatttatattagtatgccgcgcactaattaggatgtcgcattaaacattcattttcacccgtagggaaagatatttccttacgggaatgtcgttctctatttttgggacaaacaatatgaaagttgaattgactttagaatgttttgccggatatttaaacaatgactttactaatccgattgataaaaccttggtagatgagatcaagacgcaagcacgtcaagcatggcctaaacgtcctagtgataaagaaaccattcgtattttagtaaaaatgccggcaacttgcggacaacattttcgttatctgaaagtgcgacaaaaaaacgaaaatacgttacaaatctatcacaatgcgttattgaaataacacctttcatttattcaccccggcgggaacagttacccgtttggggactgttcccttattttttaggagaacagtcatgaaaaaat

SEQ ID NO: 25700 - DNA, 272 bp, Oryza sativa
ctatacctaataatgaaaattggtatttaattaaaactataaaattatttaccctgatgttttattttaatcatttaacttaaaaatgcaatcaaaacaaaaatcacacataaatatataatttgataaaataatattgcgttattttattaagttattagaataattatttttagactccgagcctactttcataagtcttattaaatttgagcaaatcataaaggattttgagaaatcaaacctcctctcgtatttagaaaggtgtccta

SEQ ID NO: 25701 - DNA, 512 bp, Oryza sativa
taaccgttcatcaagtggtaaatgataaagtgactaattcagattggaaagaagtaagcacatccgtttcattaccaaaagcagcattaacggcggatattaagtcgcttaatgattttggtagcaatttaaatcaaacacattgtagtggttgtcacgctccaattagcgccaatcattacacagcaaatcaatggattggtgtggttaactccatgaaagatcgtacctcaatgtcagcagacgatgttcgtgcggtgaccatttatttacaacgtaatgctaaagatatggcaggcagttcacactaattcagttaacttaaacgataccgagcttgttagcctaagtctattgataaggcagcaaagcctgcaatataagcggtcgagttgatgaaatatttagctattaatcgcttattttgcacaggatagtaaagaaatgcactatcctttcatattcagaaaggtgtcaaattttcattcactttcagaggactatccagatga

SEQ ID NO: 25702 - DNA, 340 bp, Oryza sativa
ataaacaacaataaaaagctcaacttgtttatctaaccgcaagtcatttttagtaagaaactcacatactgcgagcatctttttatggttatgaatactgactctttcaaattgcataaaatattaattaatgttgtaaataagaaaccttaataataattggcattctaccccaaaaaaatcaccacttctaatcataaagaggtatttttgatttttgtcaagaatttaaactattacccaaaatgctctgtgtatttgacaattctgaggggctagacaataacaggcgaataatggacaataaaccatcgctttatgatccattcttacgctatta

SEQ ID NO: 25703 - DNA, 1501 bp, Oryza sativa
tatttttttaaaaaaaaatagctaatacttagctaatactccgtttttcgtgggcactgttcgtgttgggaactggctggtatcgaacacagccttattgacggccactccgttccgttccatcaaaatttcacaatcatgaagatgaagtaagattaagtgtttcacgcaaaacgagtaataatgtgtgatgaattgaattttaattattataaacttgaaaaatggattaatctgatattttagagcaactttcatatagaaagctttcgcacgaaacgtaccatttagcagtttgaatacgttgccatgttggagaaactaaagcaacctcagttcgatagggactgtatgtattgtttaaagcctgtttgtaaaacacataaatttataggagttatataaattgttcgtttcattccatttgaatttattaaaaaagaaccagtctttaacgggtttttccaaatcttgtccggataattgaattgatggtttaacttttgaaccttcctgattattttaaatttcctttattttacttttttccctttattcgtcgtttgaaacctagtcttctaatactaatttacaatgatctttcggtggtagatgatgtatttgttaaaacatagtagacgacgtatctgttaaaacatagtaactttactaatctcacgatatgatgacataaattttcggagttgcttataagtatactagttataaagcgtactcacgaagagtaaggaagtagccctccagaattgagcctaagggcctatttattttcagcgacttggatgagattttccacgatataaaacatctaattttccacgatactggttataaagcatttttaactaatatttttagcaactttaatgttacaataatgaaagtctatatatgtggagtcccatctatatggactgcttttgctatatacattgttgctgcccatggagtagttaggtaaagtctttagtgggtactgtacatcactgctcgtctgcccagggtttaccaaaccgtttggggtggggttacagccccttccgatttgatggttagggtatcctcaatgttgagccacacaacaaccattagatgggacccacgtacatatatctttttactttacaaccaatgctacaatgtttaagatcttctattgaccttaagctgggacccactaaaaataatctatataaattcttttactaattcttttactatgaagaattaatagacaaagtaattttatatttcttatggctaactttaagctttaagattagtcatatcaatatcctcttacaaacacacatctctatgcataaagttgtattaagaatattattttattgcgaagtgagcatagctcaactagttaggttccttatggtggaactagcccactcgggttcaaatcctagatttgacacgggtgctcgcggcgcctatggtgacttcatcaatctcaagatatgccggc

SEQ ID NO: 25704 - DNA, 1501 bp, Oryza sativa
gtagtgtaccggctcgaagagcggaggaggaggaggcggccttcttgaggcccttcttcttgatgatgaagctggcgccgatgaaaaggctggaggagagggcgagcaggaggcccttgatgttgtcggcggtggacatgccccccgcgtaccacctcccgccgccacctcgcgcctccatctccatgcctctctctgcccttacccgcctagggcttctttcctttttcccgttttccttttttgcgtttatatttactccgtagtaatccaatccagttaattaattttactctacaaaatactgcatcagcttgctttgacgggagggaagcgaggggtctacaattctgaaagaattctacctacatcccatctcgtggaaaaaaaaatcaaatcaatcagcagtcggatatattacgcttttaactgattgcgattctctcttatatggagtatatatagtagtgtaatacacacactgttacacagagatagatagaaacactacacggcagtatcaggatgcttttaacataaataaataaataggaataggagtagagttatctatcctgatcctagatggatggatggatgatgaactcactcttggtttggcgaattggtttcctatactcctattacagatgattactagagtttgctagatggtgcaaggtagttggagtagcgggcttgagcaatgagtttgcccgatttcttcttgaggtccacgagcgccaccccaactgccttgccggcacgaagaacctttgcttcgatctcaatctcttcctgcgagtgcgaaacaaaaatcatcaaggaaaagtgaagcagtcccgtccctagtgttggagagggaaaacaaaattagagacagatacatacatcggggaaagctgcatccaagtaggagatgttcatctccaggggcgaggtagagctagagctagagctgctgttgccggtggtgtggaagacggcggaggcgacgaggtgaatgagcgaggccgtggcgccgccgtgcaggaagccgcccgaattcttgaggacacaagcaagtgacgagtcagatggatcagatcaggtggaagaaaagaaaagaaaagattactaccaggagtcgggaggggacggtgaagcggcagaggaggcggccgggctccgcggcctccacgcggatgcccctcagcacgaaggcgtcgtaaaacccggagggcagcgccgccgccgacgacgcgtccgtcggagtcggatgctccagcacacgccgggccggctccatccccgatcccattcccctctctattctcaacttctctcttcttctgtctattctagtctaacaacaagagatactagtagagagacaaatttgggtgtgtttggcatcgccttttctcaacccctctccctcgtataaaccgttaatcagtattttttaaaaaaagtttctatgcgaatgttacttaaaaaaatcaaattaatcaaaatatct

SEQ ID NO: 25705 - DNA, 209 bp, Oryza sativa
attttccatttcagcagctgtattttcatggaaccattttatctgtgttgacagacaatggcatgttcttcccttgaaccgcagcagagtcgacagttgaacctgaaaagatcttctttctcccagcaccagcactagcatcatcaccacagggcgaaggcatgaacaacgtacgtccttccatggtctcgttccaggacagcctcttc

SEQ ID NO: 25706 - DNA, 1501 bp, Oryza sativa
agggcccaagagatcgcaaattctcaaatttcctaaaatcaattacccaagaataattccttacgcttttatcaacagcaaaaaacataactaaagaataatcgggttctacttttgagaaataacttgcttgtgcttttctgttttccatagccatcccaaaagaaaccttttatattgtttacacctgaacatgcaggaaaaataaaaacaaacggagccataccatttaggagtatgcaagaactagagagagtgcttacatcatgtgcattgagcctgtttgagtctgatgtaataaaacaagtaaaaaaaagagtagctacattaggcttgatttttagttgcaaataagaagaggttacaggttgtctgggatccattgagctcagatgtgctttactttctaccgagtaatgagaataattaacaaaaaaaaaggtaagcctttggggacagcacttgtcttgtgtaaataagcatttagacgacgagtaaagagatttcaagtggataatccacttacttatagtaatatgggatgaaaactaagtgcagcttcaatatcaacagttagcccaggtgctgtatattcccgcagctatggggggctggctattttaagctggcgcttgacttgagacccgtgcttaggaggatcaataaatgatctgaacagggtcatattggatccgcgtgatcagtgcagtgtgataatggtgatgcgtgatacaagaaaagaagaatgatttggaactgaaactgagacttaattaggacctgtgtcccagatggcaagcttgagttttttgccaccggtgttaaccatcttgaccttgaagtcgacacctgaatatacaatccgaacgcgattagcaagaaaaaaaaatttttgtgggggggggggcgcataaattttgagcgggcgagagatgaaagtaagcaggtgccgggggatgatccctgttacctatggtgggcgagagatcctcgaaagagtcggaggtgaagcggaggaggagactgctcttgccgacgcccgagtcgccgatgaggagcagcttaaagaggtaatcaaaatccggctggctctgcgcctgggtggacgacgatgaagacgaagaatccataataacctcctcgtatgggatgacgaaggtggggggatgagatctgatctagggtttgatctggttgcggaggaggaggagaagaaaagctggaaaagggaaagaggaagacgaagacgaagacgaagagaaagaagatgtgcgtttgcggtttgcctctgcatccgcactcgactaccggacctagggtttgcctacaggggcccaattacgcacacccacttctatcataggaataagttcactttaggtacctcaaaatttatcgccaagtctgaaactaatcctgcctgcgttcctcaactcgcaaaaacagtgcagataaggccccataatggtttggacgtgatttcggctgacatggcgcctat

SEQ ID NO: 25707 - DNA, 1501 bp, Oryza sativa
gtacaaaccgcgtttcgatgtcgtgcaggtgaagatccaccagctcctcctcagctcgagatttcgaacatttgacaaggacgaagcggatctcttcttcgttcccacctatgtcaaatgcgttcggatgacgggaaaacttaacgacaaggagatcaaccagacatacgtcaaggtggtaaaaccttaccttcacctcacgcgccttcatttcttacccatctcccctctctgcttgcaggttctcagtcagatgccttatttccgcagatccggaggacgcgaccacatttttgtcttcccaaggttccacctcttcttcttcttcttcttatttgacttcctgttagtatgtttacccaaacaatagccactgaaatccttccaattacctaaaaccggcaccgcccttgttttcttgcttgtgtagtggtgctggagctcacctgtttcgctcatgggcaaccttcctgaataggtctatcatccttactcctgaggtacacagccatttttgcattcatcttcttatttgcttcgcatttcttaagacagagtaaagtaatgctccatatatccccaagcataacttacacaagttttattgggtttgccttctgtataattgttaattgttatatctacgaaaaacatgcccttattcagaactgttacaacgattgctgcaattttgttaaatccccattaaatattaccgcgcttcaaatccttaactgcgggaggatcaaggcccgtaatgcatccttagtccatcccatccaaatgtgcagcgtatatgagtcagcttgctataatataacacggcagtgtttttcacaaatcctagcgtagatgatagcagttgcatgccttggtctaattaaattctgtatcttcagatgtcctcaatttgtttgcgagtaataagtgggttcatgagtggtcttctagtcttctgttaactcgacatgcaagcaacttctgacatcttcttaacgaatggttctatgttcaatttttttttgttagggtgaccgcactgataaacgaggtataagcgcttttaacacatggaaagatattattatacctgggaatgtggatgattctatggtgaagtctgacaggcttgctgtcaaaccgatcccattaacaaaaaggaagtatttagcaaacttccttgggcgtgctcagggaaaagtaggccgtctccaactggtgaagcttgcaaagcagtatcctgacaaggttcggcttccttctaatctccaaatgcaacttaacattttatgatggtgtaagccttcctctgaatatgatcagaagtagttatggcagaaactttttaatggtgtaattaactttaagtgaatcaagtgatgataaaaaaaagttcatttctgatgtgtatttgggttgttcttatgaacagctggagtctccggagctgaagctctctggaccagacaaattgggaaggatagattacttcaagcacttg

SEQ ID NO: 25708 - DNA, 1501 bp, Oryza sativa
tgaaccggacactctcagggtccatattggcaaaccgcactttcttaagcgcaacaactttgccgttctctagatcgtgggctttatacacgctactgtaggtaccttcacctatctgaataaataaaagggaagtgtagcagcatataatccatagtttagaaaggaagcacatagatagataatatggaattgaacagtcatatcaatgcaattatgtagtttgtacagcaattatcaattaggagtacctcctagcatggcaattcgatatctctattgcacagagtaaacacttataataaagaatagaaagattttgccggtggtccggtacgacatgttggtatcaactaaaaagattagagtcttgaaaaactatcaaactactagtagaagaaaagctagcaccaaaagtgtaaaggaaggaagaaagaataacagagagcaagaaaggaaaaaaaacaaagaaagcgtagagaaagaaacaaccttgtgcagcttgtgaaaagagtcagatttccgtggcagccagcctcggacagcctcggtggccacctgtgtgagccaacggggccagccagcggcaacatgctcccaatccaccccattaggaacatgggccacgaggctgagttttggttttggctcaggcgcggcattggcatcaacaccaggtgcctcctccttatcagtcactattagtacttgatcaggtaatgccaatggtgttgccgctgtggaatcagcggcctcctctggctcctcctcctcctggcccttggttgaatcgtaggtggcgaggtgcctgagtgaatcggaatgattggaggtggaggacggggggcgggcagatttgtgcaggttggcgccatggaattgcttggagccgacacagcccatgggatgagatggaatcggatcaggggcaacagccaacagggggggagaagaactcaaagcccggccggaatcagttgcagttgcggttgcagctgcagcaaacaaggaaattaaatgggatcttatcttacttgcgcacggagacggacggacggactagatagatgacatccacaagggccaagtaacgaagaagcagatcgcgcgcgatctcctccctctccggctccggcggcgacctctgctgatcggagcggatccgacacttgctgttggtcgtggtagtcaatcagtcagtccattccattccattgttgagcgagacgatgatgatgaacaggacagatagcccagcccagcccagccaccacacctccactccacaagaagggatgggccaaggcgctaagctagctggcccaaattgttcttaggtctgggaggcccatgcatgcgagcgaatatccataccacatgtcacgtgaaccaacatttcagaatcgatcacaaatccatccatcgtgcatttgtcgagtgcatatgcatgtgagtgtgacaaacctccagcctccaggtccacgacgtcgtacaggggatc

SEQ ID NO: 25709 - DNA, 197 bp, Oryza sativa
ttgggagagattaatcctgtgcatataccatccgcttaaaagcgatacatccacaggagagctatgggcgttgtggttatcgttttaacaagcttgaggcaattaacattgctcatgatgcgctaacaggtgagcaaattattacgcttgctaacgacccttatctagagcttgtaccagtagttaagagctaatca

SEQ ID NO: 25710 - DNA, 1501 bp, Oryza sativa
caatgatttcatctggtttagtgagcggaatgtaattacgtatagtaagtgtgttaactgaagactaattggccggtgggattcgcttccaaacagtagaagacgatgggacgagagcgcgcgtccaagatccaaccaacacacttgagtccgtgactgcccttttttctccatcatcataaaaccgatccgtcgtaagtcgaagcattttctgtcggtatgcatatgcacacatgcgcgtacacagcagctatatgcatcatcatcgatcacatgcatagatagtaggattattttatactcctatcgataatcagcgtgcatgcatatcaaccgaactgcaattatttaggattaatatatatataattcatgctattgattatatatacatttgctcttttttttaaaaaatattataattcatgtatttacgaacatactattacaattgaagtgatatccaattgtgcaactaattaccccctcaatgtattttttagattttcttttaccaaaatgccattctgtcgtccatcctctcttcttttgtccctacctctttttccacgacgggtagacccaacgagttcgtgacgctggcagcagcattggatatattacctccatattttaatatatgacaccgttgactttttaaccaaacgtttgaccatttattttatttaaaatttttgtataaatataaaaatatttatgtcatgcttaaagaatatttgatgatgaatcaagtcacaataaaataaataataattacataaattttttaaataagacgaatggttaaacattgaataaaaagtcaacggcgttatacataaaaaaaatggaggtagtatgacactgcacacacgggcctccgggcctctacccttgcgctggcctcttccctttcctacgacacgatcacgcaaactcctattggatcagggagggagaggccatatgcatggccgcgcgagcgagcacagacgcaacctggcttgtcgatcaacttgcgttggcctggtcctggacgtacaggaaggtggatcgatgcacgcccgtagccatcctggccctaagttcacgtacggtcattcttaatttgttgtgcactctagcaacgatctggaaaatgttgacctccacacccccggcctctcccgcgacgcatgcaggaagatggcggcaacagctccatacggcgatgggacaacgaatcagatctagcgcgttggggatagcagtggcacgcttgcactgctgaggccggcggtggccggcgcggggcagaggtggaggaggtggccaccgtggccatatagttcatcagaaatgggagagagggggaggacgaagggatatgaagaaagaaaatggcaaattggtccaaaaattcatcgaatggataagtggtggaatgtcaatcaaattagaatgacatgttttacatgatttgtaatgacctttttttttgaaaaaaaagatacatatataa

SEQ ID NO: 25711 - DNA, 1501 bp, Oryza sativa
gacaaataagtgagctgaaccatataatttgattagtatatattttttttaaaagaatgcatcagagcaagaactgatgtgtggttccaggcaggaaatgttggccgcaacggccagtgaccatacaaatcaccaacatctgtttggcattgctcccagcctccaagctggtaatttagctttgtagggcttccacaaggcagtagggcttcagcttactggacaaactaaaacacaagaggcctatcaagcgctgacttcaaaatctatactcctttaaaagagagtaatggtggtggtgagtggtgaatctactgccaccaccaaactccccaaattttgatatgtgggaccactatctatcccctccaaatagttgtatagggccagaagtacaagtcaatcgagtccgcttgaaactttttacagctaaaatacaaaaatatgataaatctctaaataattctaaaattaagctctgaaattcaaaatagatgtgtcttctttgcaatgttccaacgtggtatttttaattccgtaacatatggccattttgctagtttagacaaaatatacctttagtagttgtgtaacatacccaagcctgtaaacctgagaactaaatttaatttaaatgcatcatgtggttgtggagtgattttaattgtttttggatcttaatcatctcatcatatgcatcttgataggcctagagtcacaaaaacaattaatctggtaattatatgcatccaaaacttccacaaaaattctcaaaaaaaaaaccttgatatgtcagaaatcaacccacaaattttcagagtttttcagtaaggtttgctaacttgttgatctcctttaatctctccaaaatcctgaaaagaactgcttagcagattcaaacttgctctctctgtaaaatttatttcaaaacctctttttgaagtttggtttcagccaaagtcttctactaactttcttctaacaccctgaggagtggcacaccctggatcactctctaaccctttcttctctccctccaaaaatccaatcagctgctaactgcactgtcaactgctgctaaccaacactgtcaatacatgttcatcactccatcaaacctaaaccagagacttctaacccaatccacttcagcacatttactctccacatcacccctgaccaagaggatatctagcccagatttcttgctgcacaaaatccaccttgaatcccctccaaagatccttggcaggcaaccctctttgacttagcctccaaggctattttcgaatttctttcactgacagtgggccccacaccctctgggacccacatgacagcctcccactctcccctcacagcatccaccgtcccccatgcccaatggatgcccaaggaacacaatgaaagcaccagccacctctctctctcactcccccactccactcttccttatatcccaagccaaagcaccagaagcaacaacacactccccacatcg

SEQ ID NO: 25712 - DNA, 1501 bp, Oryza sativa
tgaccgctcttacaaatgggctccagtacaagggttaggtgtgtttagtcttgttgcttcttggcaagtgggcccagtcatcaggccgcgtgccagctatcggaagaaagtgcaatatggctatgggtcggagcgcagcatggtaatcaaccgcatcgcctgatcaatccacgtcatgtgccctttgaggggtgacgatggcctgtcctagtgttggcatgtgttgtcttatcgtccgtagtcccgaaagcatgctgggctggtatatgtcaccctgcattgaatgtaaggcttaattgggtcaatgcattgcttctaccctaagcgagccatagggatcgagctcgaggacaagtggtagatgtgtgttgatggttgttaagtgcaaactttaaccgttaactcctgcataaggaatataaaatattgtattaaaacttagtgatagagtctattactaaccatttccactatgtcagggttacgggtaaagtataccctctacccttcgatatgcgtcacatatcgatatggcatgcctacgcgtatatggacgttctctgcatacgttaagaaaatccatcacggatttcacagatggaaggagtcctactcgaacatgattgggtcgtcaatgtatcgtgcagggtccgatgtttctgagtcctacttgaaaaccgcttgacctgcgatataaaagggaccccctgggaggacctaagggatcgaatctgatagccaacacatccaccgcagtctacgaagtcggagcctacaagagccaagtcaccgggagatctagtcaaaccagctcgattacgatctcgccagtaccatcgagttccactactccctttgtaatctgtgattttccatcatataatcccatatcaactagattatggctattacctatcaaggggcctaaaccagtataatctctgttttctgtctgcttgatgtcgtattacgtagattctcgtaccagcgtaccccaataccctctatatccggtctacggatatcccccgtcgacacactagttttagtaaatatatgtacgaaagtcattcagagttagactttttggctcataagctggcttgtaaagctaaacaaataggactttaaaaatacgtaacaacatgtgaactgtatattatgaaagtttttctcaccgtgaatttaaaaatataaattttgtgttgttaaactatgagtttataaaaaatagtgattaaattaagactaaaatgtcttacttattaaagcataatttagaacgggtatcaaattttcagtgatagcaccgacatcttttgtattccaaagatatatcgggtgaaatctccttcgggcttcggagaagatgaaaaggacgacgtttggcaatctcatcttctctggaacactcatcccaaacttgtggagcgtaagcttgaagcagcatggcaagagcattaggtgacagaacgactacacatagtgccaaagacgaaca

SEQ ID NO: 25713 - DNA, 1501 bp, Oryza sativa
ttaaaaaaaatttaaaaaatgtatctactccatctcttccccctctatcctctctcttcccttccctcattctctattgatctctccacatcgtcatccttattatgccttcagtgtatgctccgaagggtgaagatttgagcctttctggttttgttgcaatgtacaacttagcgaaaattccaacatacataccatgctgaggtggaggatggcgatgcaccaagggacatcagcacgacgaccgccatgcacgccttcgagtcaatgagcgtcttcgacgcaaccaccggtagcgaggagtggagctgtggagggatatcgatgcggtcatggatgtgatgcccgatggcgcaaattccggtgcaaagcgtggcacctaagaacgtggtatccagcgtgacctatactgagaagatgatcaagtcggtagtgagcaccacagagtacggcatgaagctggtgatgacggtgtaagtaggttgccggagccaggaccgtcatcgctcgcaagatgtagcatgacagcaagtgatacagaacgtgggcattgccgcattagcgtggcaccgagcgagatgccaccgccaccgttcctacccctagtgagccgttgagcgagcaacaggacaatgagggtgtcggagtgtgaaactcctctagcgggggaagctagtactcccgttggagattcatccagggggtgagtcaagtccatatgctaatcgcgcgagagatgaacacaggagattatacaagtttaggccacacgagtttgtaacaccctactcctgtgtgtggactatggatgctcgaaatgagttaccatgagtggagtcgaggctggaagttaacttgttgtagtgaaagctaagctatttggactcgttgaaccccctagggcgagggcccatcccactctttttcggccttggtcctccttttatagttgcaaggtgatatatcacagtgaccgctcttacaaatgggctccagtacaagggttaggtgtgtttagtcttgttgcttcttggcaagtgggcccagtcatcaggccgcgtgccagctatcggaagaaagtgcaatatggctatgggtcggagcgcagcatggtaatcaaccgcatcgcctgatcaatccacgtcatgtgccctttgaggggtgacgatggcctgtcctagtgttggcatgtgttgtcttatcgtccgtagtcccgaaagcatgctgggctggtatatgtcaccctgcattgaatgtaaggcttaattgggtcaatgcattgcttctaccctaagcgagccatagggatcgagctcgaggacaagtggtagatgtgtgttgatggttgttaagtgcaaactttaaccgttaactcctgcataaggaatataaaatattgtattaaaacttagtgatagagtctattactaaccatttccactatgtcagggttacgggtaaagtataccctctacccttcgatatgcgtcacatatcgata

SEQ ID NO: 25714 - DNA, 1501 bp, Oryza sativa
ctgtgaggggagagtgggaggctgtcatgtgggtcccagagggtgtggggcccactgtcagtgaaagaaattcgaaaatagccttggaggctaagtcaaagagggttgcctgccaaggatctttggaggggattcaaggtggattttgtgcagcaagaaatctgggctagatatcctcttggtcaggggtgatgtggagagtaaatgtgctgaagtggattgggttagaagtctctggtttaggtttgatggagtgatgaacatgtattgacagtgttggttagcagcagttgacagtgcagttagcagctgattggatttttggagggagagaagaaagggttagagagtgatccagggtgtgccactcctcagggtgttagaagaaagttagtagaagactttggctgaaaccaaacttcaaaaagaggttttgaaataaattttacagagagagcaagtttgaatctgctaagcagttcttttcaggattttggagagattaaaggagatcaacaagttagcaaaccttactgaaaaactctgaaaatttgtgggttgatttctgacatatcaaggttttttttttgagaatttttgtggaagttttggatgcatataattaccagattaattgtttttgtgactctaggcctatcaagatgcatatgatgagatgattaagatccaaaaacaattaaaatcactccacaaccacatgatgcatttaaattaaatttagttctcaggtttacaggcttgggtatgttacacaactactaaaggtatattttgtctaaactagcaaaatggccatatgttacggaattaaaaataccacgttggaacattgcaaagaagacacatctattttgaatttcagagcttaattttagaattatttagagatttatcatatttttgtattttagctgtaaaaagtttcaagcggactcgattgacttgtacttctggccctatacaactatttggaggggatagatagtggtcccacatatcaaaatttggggagtttggtggtggcagtagattcaccactcaccaccaccattactctcttttaaaggagtatagattttgaagtcagcgcttgataggcctcttgtgttttagtttgtccagtaagctgaagccctactgccttgtggaagccctacaaagctaaattaccagcttggaggctgggagcaatgccaaacagatgttggtgatttgtatggtcactggccgttgcggccaacatttcctgcctggaaccacacatcagttcttgctctgatgcattcttttaaaaaaaatatatactaatcaaattatatggttcagctcacttatttgtcttcatgtcatcagtgcttcactacaaagccaagataccatatgcttgtaatccatcaattcaacgaacatatacataaattttcttccaaatcatgtcttctgatttgacagatcatttatttttactcatatcatcagt

SEQ ID NO: 25715 - DNA, 1501 bp, Oryza sativa
tgataaaaaaatactgaacgtacataaaaatgatatgatgataatgaggtttattttaatcaccgatatcttcttatatagtcttaataatctactgaaatgctcacatttgctgaaaaaagggaattactaatgaaaaataaattaaaaatatattaaagagcttttacaaacacatggtcggtgggttgtaaatattccatccagatcaagcattttaagtgaaatatggtttgtgattttaaaaaaaatgtaacatgcatctatactgcacaacagactaaaatcatagtatacattaagtgttatctccaaacaagatggttagcggtctcagtggcagagtaagatgcagagcaaggttatagctccttcaaaaagactatctatacaaaaaagaatcacaaatttcagatatgcatattcatattgtccactaaattttgcttacaactatgattcttccgtcaccatcgcattggagcagaaaagaaagtgcagcatatgcctaaaaccttgttgtactacttcatcaaaagttattgttggtgacttcgataattcagagttcccatcttctccccttcttgtattgcattgcataatctcgcatagaccatagtagatatgttccgtcttcttccattcttgtgccaaactcctaaattttcaacaaaccttgctgtaacactttgctctagaagtccttctaaagactcatcttttttgtcactgggaacccacaacagctctttgattggcacactttactattatcactttctacctgcatacttacaacacccaactaattaccacttaccagaacagctggtaatagcagtgtactgttagtttattaaccaattatttttctgcaaatggtagcacagtgcttaaaatactgaaaatttagcatattgtgtatataggattaattagaagcacattagatttaatagacaatactggaacctgtagcaaaaaggagttaatttgacaaacccttttctttttatgtgcataaaagatatctgtgaaagacaatttgttctggtttgtcctcttactttatatcagattattactaatttgtctctgcaataatgtagtagccagattttagagatatacaggcagggtgctgaaatggcacaaatctctaaatagagcaatcaaattgtatacacctgataaatttgtcctcaatattatttacgtaaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcaggcatcaacggccaagcaattactccctccgtcccacaatataagggatttttagt

SEQ ID NO: 25716 - DNA, 1501 bp, Oryza sativa
tgtaacttgaaacagagggagtaacatacaaataagaaaatctcgcaacatattacgaaatgaatcaaatcgaaatctgccatgctagatactcgtatctaacatacaaataaggaaatctcgcaacatattacgattatgtatatatataaaatgaatcaaatcgaaatctgacatgctagatactcaaataacatataagtaagataatctcgcaacatattacgagtatctaacatacaagtaaggaaatctcgcaacatattacgattatatatgaaaaaaaagagtgaattgcactttgggccggttattattgcctgtgttttattttggactaggttatatctaacgttttcactttggtctaggttttcttgccttatattgcacattggaccacttttttgtttgccactccttgatttcattagcgagcttacctgcaacacaataaaccaatcattattccacatgaccttgatttctttactcattgatttagctgcttgacttctaccattttttcccttaatttatcatgtgagcttggaacaagtcactgtattgagcttgcaagcgacagctacagcagccagctaccaccaggcttgattttgctggttcctcaagctcgggaacagagcagagagagaaggaaccctggtgctttgcttgatcatccctcagatccatggcgcggctgcttaatagagaaaaggagggaagattgatggagaagaagggtggtctaatttaaaacttctgtaaatttatctaatccaaagtgatgaagataacttcaccccttgtccaaagtgaaactttggtaaaaattcctagcccaaagtgcaattaactcaaaaaaaatgatgttgaaatctgacatgctagatactcaaatctaacatataaataaggaaatcttgcaaaatattacgattatatatgaaaaaaatgaatcaaatcgaaatctgacgtgctagatactcaaatctaacatattacgattaaatatgaaaaaaatgatatgaaaaagatgttgaaatctgacatgctagatactcaaatctaacatataaataaggaaatctcgcaacatattacgattatatatgaaaaaaaatgaatcaaatcgaaatctgatactcaaatctaacatataaataaggaaatctcgcaacatattacggttatatatgaaaaaaaatgaatcaaatcgaaatctgacgtgctagatactcaaatctaacatattacgattaaatatgaaaaaaatgtgttgagagtgggatttgaacccacgccctttcggactagaaccttaatctggcgccttagaccaactcggccatctcaaccgttggtaggattatcggtgaaattaaattttataacaaaaaatctcctcctttctgaaaaaaaaacttgcgctgcgttccccactcccgactccccacccagtccccactcaccagcccgtccgttgagtagtcgaaga

SEQ ID NO: 25717 - DNA, 836 bp, Oryza sativa
ttttctttaaatatttttgatggagtgaaatatcaggttgtagaaaaattatctgagattagctagaaattaatagcgaggtttctatcttagctattatttatccgtaaatattctacctatttcgataggtgggatattttacgcctaactttaatatactattcgcattaaattatatatcgttgaaaatttcatcattcaaactactaaaaatattttccttgataatcttcagcctttaccacacctgcatttcatcaaaagttaaaaattttcaaaaaacacttgacaaaagaaagtgcttgacaacccccccctctctttattttacatttttgcccacagagaatagtcccctcattaggatttttactttttaagccataaaaggtttaaaaatttaagagttttaatgaggggatttttattttctatggcacagcatttttcgctatctgcagaggcacgccacttgtctatacaagtggacgagctttctgatgtcgaaattttgtcgttgctgaaaaccgctcgttggggcaatgctgataatataaatgatattgaatgtccgcattgtcacgttagacacgaagcctacttcattaaaactcgccaacaatggcaatgtaagcattgttgctatcgcttttcaattactgcaggcacaatatttcaccttgctaaattatcactgcgaaagatattaaaagccttacgttattttgcacttaaaagcaaaggattatctgccattgagctttctcacgaagtatcaacgttttaaacgattcacattatttaatcgcagcataacaattgaggtaacacaa

SEQ ID NO: 25718 - DNA, 256 bp, Oryza sativa
tgcagcccaccatgaagacattccatcaattaaatcacgaccatcttttaagcgaattttcacgccgttagctgattcaacggggtaaacggggataggatcagtcattgaagagtaagggtgccaaatatgttgctgatctaggtcaataagctcacttactttcatttttattctcctgattatttactcgaattctagcacaaaaaggcatatgggtatagaataggacaactttcacttataaagaggttat

SEQ ID NO: 25719 - DNA, 350 bp, Oryza sativa
aaatcatatcaataatgcgttctttttcaatacgagtaatatttgatgaatacattgtttcaggtacatcaatcggcaaacttaatccgtttaacactaattgatttgcttcgtcccaagcattatctgaaccatgaccataataaatatctgaagcattaaaatagctataactccaacgcatcatatcttggattgtttttagatcttctttcgttgatgaatcaaatatttcttccaacaattctaaattatgttcaaacatatataacctctttataagtgaaagttgtcctattctatacccatatgcctttttgtgctagaattcgagtaaataatcaggagaa

SEQ ID NO: 25720 - DNA, 185 bp, Oryza sativa
cgtaagggtataggttaccgaaaatatatcaccttccttagttaggttaggtaattttatcaatgggagtgaagaagcccgttgatgaaaccgaatctataggccaggaattgtaccgcccgaaagaacctggtattatcgccaatagttttagaacgtcagagttaaatttcaactgggaacta

SEQ ID NO: 25721 - DNA, 163 bp, Oryza sativa
caatcaaatttctttttttaagcgcgtgtaaaagtgtcaacatgtgcatttattaaccataagaaacccatatttaaaattatctaattttcattatcgattgtccatttattctcatcaagcgtataattagcattcttttgaaaaacacatagtagaaaaa

SEQ ID NO: 25722 - DNA, 220 bp, Oryza sativa
cgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaa

SEQ ID NO: 25723 - DNA, 932 bp, Oryza sativa
tgcaagaaatccaccaagagatgtaccataaatatgaacctgttttctccaatgaaaaaataaataaattagtactaaataactcaaaactcaacgaaatgaaacaaaaacttctgctgacatacaaggaacaaactaacacactctactatagactccttaataaagaagtgaatcatgcaaactgggaattgcagaaagaataagcaaaagcagtctttcacgaagtagtaggtaacatcaaattgatttcacattgttcagagctgactatagcatatttatattctcactgctatgacaatcctgtatactccctccattccaaaatataaggcacaaccacccttaacccaaagaccaagaaataattattatcatcttctagtttgaatcatcctaataaatataatgcatgcatccaataggattagataacatgagaatggagtatttaaaaaagtaataatttaatggagaagatgtaatagttaatttcatgcttgcatgcatgccttatattatgaaacatctaagaaaagtggttgtgtcttatataatggaatagagggagtacatactttgctgcgttctacactacactttcccaatttctatttcccttgttttccatgcgcacgcttcctaaactactaaacggtgtattttttacaaaaactttatataggaacgttgcttttaaaaaaatcatattaatctattttccaagtttttgagttaaaaattaattaatcatgcgctaatccaccactccgttttgcgtgctggggagaagggtcccccccccccaaaacaacaaaacgaacacagccttataggttgcaagaggcacaagaagagtggaaatgaagaatacatggcttaaaatatgaatggttggacagttctaagactgcaatgcataaaagaaa

SEQ ID NO: 25724 - DNA, 786 bp, Oryza sativa
tctctttttcttctcgtttcgttgggactactaggtgaggtagggcggatttcatagcctaccattttgatcctgaaggtgtttttccttcctccgtccattttccattgcactgtttgtaaaccaggtgaaattatttctatcttgatgcatgtccatagctaagatatgtgccgcttggttgcagtgcgccgtaccgaattgatattgaaatcttcaaaagcctcaccctttgttttttatttttattttttggccatcgtatgagtccccatgtatcaatcgttcaggaaaatcaacaatatatttcgtacctgtacactgtcagtttctaggattatttctgtactcctatttcttctgttagctggaaccagcatcttcgctagcgtagcatcgttgtgaagtacttcattccgttgattagtgcttaattaagaacttatagtacactggaggcaagtagaacagccgctccagtggcatatacagagtagttattgtataaccaatattgttctacttattagtctagtttcctctcatctctcacgaagtactgtcatcttaaagatataaattgtacgagcaataaggctaaagtcacatggctacagagaatatccatcttaaatctcatgtgtatcattttatcatacaaaattttccatagcaacaatcagggttacttgtacgaatgtacgattgtagtttcagatggggcttttgttattcatcatttgcctgaatttttctaatctagtaccatttttttttcacaacagc

SEQ ID NO: 25725 - DNA, 1298 bp, Oryza sativa
catgatcagccagagtatacaaacaacaaattgataaacagatccacgtcttacaaaaaataataaataattcttacaaacgtagtggaaataaacaaataatataaacttaatcttcacgaccaaacacatagcttcctccataatccacaggcatcctcaacgtccggaacaagcttaatcctcaaagaactcaccatctgaacaattctctgcttctggggtggggaaaaataaagtaaaactgagtaccaaccactgtactcaataagtcataccaaaaggaaggtatgatgcaagatattcacaaaggaaaggctataaaatatttgcacaaaaagcatcatttataaatcataatttgaatacaataaaacagtagatataattaagcaatgttagatatcactgccaacactaaactacgttgcaacactaaattttctgttgcagagttccatattaccaaatcctgataagcttttttcggcaacaactaaacatgtcctaaattcgttttataaatggaaatgtcctaaattcttttatttgaagggaaatgtcctaaattctctatactaataatgcactataactgtcctagtttatgtaagtgttccataatattccatggtagtgcctgtagttctgtactaaaactattgcttccttaaacataagtcacttcctgctcagaccaattgggttgtggaaattgacttcgactttagaaaagtaactaccatccaacatacaaatggaatatcactattaattctagtgggaacatatatgttgtgtatcccacatgccatgaatttaactaagttcatattggtcctaatcattggtttaatagtcctttttttctgttcttttaatatttttgtcaacactaggatagcaaccccccagccaccgtaacagagagccctgattaggatggacatgagccgatggagcacatcctgattgcataaaaaaattaaaaattgccacgagtgaaccttaataaaattgaacgaaatttcgatagcataatcctgtgataacatcgtaacaacagatgtacgcgtgatcagaacagaggcacacatgacacttacacattccctgcaaacaaataaattttatgcataattttctcgtaaaagcaaaatgagatatagctcaactagttaggtttaactagttttttatgataccaccacctgagtttaaattctaaacttgacacgtgtgctaccttacatttatagctatttatttttatggtaggtgacgtacccttcgacagc

SEQ ID NO: 25726 - DNA, 1501 bp, Oryza sativa
catttaacaaatatttgaaaattgtaaaacagtagagtaactaatcatcaatattaatcaacactgaacaacacacccatgctgcacaggcccaactatcctgaataaccatatctggctgtacagatctatctccaaaccaggaatgtaccattccaaactaggagctaaattaattactatcaattaccacattattattaatgagtagtgtgggactaatcacaaaagtcattgttagatcctcctataaccgcgggcacggctattcgaatagttttactctggccagatgtgtaccactgtacccacaagacacaactccacaatatgtcaccatatcatcatgtgcccatactgaacatgtcaccatttgtgtagttgtgacaagacccctcacatagctcaactcaaagcagcgcacctttcctggatcataatcaccccccccccccgtgggcttatctccgccacttctcagtatggcacaccataatgagccttgctatacaaagtgtccagccgttgcccattttggcttgtggttggcacggttaatgtttcacaaccgaagctcgtgaaccggtccttaattgtcatgagcacgaccatcaaaactatgtgctcacaacccaccattatcaagttttagttggcaaattaattaattaaccaatcacgattagccatcatgagctatgattaaatatccatcattaagtaatagtgaaacattagttatcccaattgtgtgctaatgtttctaagcatggctaagcaattatatctaatatatctagttgaaccaatatataaatccaactagtcaaattataacccgaggtaatcaagaaatagagtgatcaatgcaaattggccataacaaaggaacaggttcacaccacccggtgacattcaaaaataaatgcacagttgaaataaatagagaatttaaatataggatcaacatgctcaaaggaattgtgtttgggatatgtgtgacttgccttgcaataaagggtcttcaattaatcttcttgaatacttccggcgcactcgcgaacctttgaaacgacggaaacgacaagctaacacacaaaacgaggaaaaagactaataaaaaccaaataaacagtacacataaagtaaaaaaaaacatgtagatcatgattttagatgaattatgagacttgaacggcctcattccgacttcatatgaattgattaccaattttacaagattaaatctaattaaagcctatttaaaaaggattaaacaaatttaacacaatttatggataattttaatatatagatctttattttataaaacttttgcaacttgaaccacattaaaccgagttacaatgaattagttatgaatttctaaagattaaaccgcattaaagcatttatatgggttttaattgaattatgacgcaataaagaattattttgaaaataaaaagggatttattgcgtcatcaaagacggtccacag

SEQ ID NO: 25727 - DNA, 500 bp, Oryza sativa
ccaccagtacaagtgaaagtagcaaacggttccatacttacttgtcttacttcagtaccaaggtgtgaatggatgacccaaggatgggtgttttatactgacttaaaggtgttaaatctgggaagttatgacatgattttaggcatggactggttgatggctcatagtcctatgcaggtcgattgggttaacaagctcttgacagtttcctggagaaaggaatccattacattacagggaattttgtcagaaactgaacagtgttctcaactctcttctcaacagtttttggagttgaaggatagacaggccatctctcacctgattcagttgtgcactctgtcagaatcttcaaacaaggagcaaattcctgtggaaattcaacaagtgctagcagaatttggacaggtgtttgaagaaccttctggattaccaccgtccagggtttttgatcatacaattccacccatgccaggagctactccagtcaatgtgcgtcc

SEQ ID NO: 25728 - DNA, 191 bp, Oryza sativa
ccgtgcaaatatctgtccatttatgaagagaagaaaagtccagtttggaaagagaaggggtgcatgtggtatccccttgaagtataaaaggaggaccttgcccatagggaaagggggatgatcttttccagattcggaacttagaacaagtgagaggttggctcacactttgtagctccctcatacacaga

SEQ ID NO: 25729 - DNA, 554 bp, Oryza sativa
aatgtaatccaaagaaactatacacgacataagcaataaaatgaatatataaaacttatcatgaaagattattcataagtgctatagacaatacattgtgtaaaacatgaccaagccatattccaaactccaaagagaagtagctcagttggacccgaagcacttgaaactccaagcgcacaagctttttctttcctagagctacttagttcctttctttttttgttttgttgaaaccaatagctggtgattaaaaaaacaaaataaaaaaatatctaacatcacatgaaccataagccccaaccaaaagctaacaatgcagaattacagatacccgaacttaagaaataaaattgaataacaacatgaccatgatggccaatccatattataagtctaattcaaacactaaattagtagtaattacagggaatgtatcctatatattacccaagctgcacaaatttctcaaatatgtcactaataaaaccctacagctgatcagccaatccctgtgaatactctaaaatcaaacaaatgttcgccccccaagc

SEQ ID NO: 25730 - DNA, 1467 bp, Oryza sativa
agcagcgggctacagatctgtagccagctacagcatggactccaagacataatgtgtgtatgaaaggtgggaccagatattaatagtataataagcaactattgtatgaattggctattgatgttttggagctactccctccgtttcacaatgtaagttattctagcattttccatattcatgttgatgctaatgaatctagatataatatctatctagattcattagcatcaatatgaatgtgggaaatgctaaaacgatttacattgtgagacggagaaagtagcagttagctatactattaaacttgctctgaagagaatagaaggagctaggcaggcacggtggatgaaatgcaattaatgcgccagcatatatcacatgtaatccgtggaacgtgtgttcacgatacaaatatttgcattggtcccggtcggaaacgaagcaaattgagtaaattttacaaaactacaggtattttgaccaagttatcacaaaactacagatttaaggagttgtatcacaaaactacacatttagcaccaaatttatcacaaaactgcggattttaggttaagtatcacaaaaatgcatatttaatattgaacttatcacaaaactacaacttttggagtttaaatccctagcaccattgttatggtggagctataaacattattactttgtgattaaattggttctaaacctatagttttatgataatttagttactaaatatgtagttttgtgacacttcatcttaaatatatagttttgtgataaatttggtattaaatatgtagttttgtgatacaccaagttaaatctgtagttttatgatagtttggtcatagtatccgtatttttgtgaaatttactcaagcaaatttaaacgtacaggtccagattacgtacgccgccagccaatccatcgagacgacacggtggcatgcagctcggcgcgcgttttgttgcgcgcgcgcacgtccgcgtgtgcactaaccatacgaccacctgttttgcccgaaagaagatcgagttatcaatgattgcccaaaagggaaacccgtgtgcttcatctttttcttttttggggctctcgaattatttctagaacagtataacctacctaaattggtcaaagaccaacaccggcgtgcaacagttctcgatcagacgtctctcctgcttttctcaaccctttaggagaccatgcatggctaatccatatctgctgctgccaagatcgatcatatatatcttcttatttgggttaacttgctaattaaatatccgtacttttgctacagataaaataaaaatatattaatgtcttatatacccatttttttatagggaatatttatcttagtttaattttgtatacggatatccatttagattttttaaaaaatattaagagctcaaggagtaacgtaaaatttataatgggaatagatgccacca

SEQ ID NO: 25731 - DNA, 1501 bp, Oryza sativa
ttccgtgcgcttgcggatttatctgtggtcgtaagaaataccaacacatacaaaacggaaccgtggcggcaaaggggttggtagatacgacgaaccgcgaacggggggagtgaaccgggaatggttcacgaccaaaggagggagaggaaagaattattaattcaactcctgacattttaacttgacagtattacttcctctactctgtatattcctctgaacgtcctgttaatgatttaaagcaaagctaataccaaaaaaattctccctgaccattccaattattaaatgcattattaattagggtttcctcctagttaacagagttatatagttaacagagttatagatgattcaacaatgatttagaaactacgaaaaatggaaaaactccaggtgtgatagccgccaagtcaaccatagctagatgcacttgtgtgattatgatgaatataaagcaacaccggcttcgaccaacaggagtatggctattacctatcagataaggggcccgagcgtgtataaaaattcttgtctccatcttttttacttcaatctcgcatataccttggtaccgacaatctccatatcatgcaaataccatagtcgtgactaaaaagtcaacaattaggaaaaagtatagtccattttattccttgaatttcgctcgaaggttatttttcacccccgaaagttggttgtcacacccaaacttttaaaacaagataaaataacaccgtaaatcatatttcattgtagttttatttggtaaaatgaacttcaagctgttaattttcatggttgtgtaattaattaacatctacattaacaaaaatatgcataataagagtatgggatagaaaactgccgcatttcagataaaaacatcaggaatatgttataggatgtcactagtctttgataactgaggatgaaaaacaacctgcttgtattgaaaaactgaattttgaacaaagttcaaggcccaaaaaagggctttacccttgaaaaaaaaattacaataggaatagttagcatatttttttaacgatcctagaccagtggcttgctcctggtagctccctaccagttgagctatccactgtttctagtcagcatatttcatatgatatagaacatattttttagaaaaaagaaatataatctaggatgttatttattttattttgaaagttaaggatgaaaaataaccggtttgtaatttagggtgaaaaatatggactgtgaacaaaattcaacagtaaaaaatggcccaagaaaacatcaaagttacaatctgaaaaatcagaatattcatatgttataaaaataatttttaacaaattaatattacaatttgagtaggaaatttcggaaaaagcacaaaccaaaaacacacacagagacgaagaaatagccaatagctcactctttctcgaaagtgaaaactgaaaacccaaaagcccaaaaccctagctctggtgcccggctcggctacccc

SEQ ID NO: 25732 - DNA, 1501 bp, Oryza sativa
atagaaatttcctcttttgattgcagattaaatcagtctatacaagaagggggcctgggggctcactctgacgcgcccgggtagccggcctagccgtcgcggtcgtccgtaccatcgtcaccgcattcctcgtcggagttgaaggcaaacacgagcccagcggccgctcattattttcggttggttttctcttgccgatgcgcgtaatgtgcgaccgctgggattctgtccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgctcctgccatcctccgaccccgaggtcatcggcacagaagacgagtgcgccccgagaggccacttggacgaagaacgccccggggatgcggcccctggcgaagaggatcggccccgccgaaaggtgcagcggcctgtctactttgttagtgaggccctccgggacgccaagacccgataccctcaggcccagaggatgctttacgctattctgatggcctcgaggaaactgcgccattatttccaggcgcatcgggtcactgtgattacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaacccccgaggccagcttgggcccatcgcagctgcctcacaccgcccactgggtgatgtagttcgacggcaactgtagagaccggccccacctgtcaccaggccttaggagtggcgtcacgcccgaccgcttcccttgagaagggcgatcgccctggcataacgccgggggctactgtcggtgatatgggaccgggagtatcgtgaccagaggcttgaggcagacacaatcgcccatgcggcctggcaccttcggggacgtcgggcccgagggtgaggtgtccgccctcctcctgatttcccccgagggggggtcgggttactcctgccccggccccgagggccgaggcaccccgacccctcgaggaagtttgcgccacatatatgggataggtgaacacggcagtgctcacctaaccgcatttattgtaagtctggtcaagcgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccagagctagcgtgtaatctcttagagatggcacgttagccctggttagatttataccaggctccatcccaaccattacagcctata

SEQ ID NO: 25733 - DNA, 1058 bp, Oryza sativa
tgtttgatctttgttgggatgaagtgcggttgctcgatggatcgtctcgagccgatgcagcgagctattttttttgttcgtgtagcctcaaaggtaccggttcctaaaccggcgtctttgaggacacctcaaaggtgctgactaataggtgctggttgggaaaccggcacctatagcccttttttagtagtggtatgtcacgtataaaaatactaaattttgaacaattatttttatatctcacaaatgaaatcgagtaatttggacaatatttttcacaacaaacatctcatctttatatgcaattaatttgtttggtgaatttaaatgactttttcgttggggttcacatgagtttccatctatttaaattgagtatccaccacatatttaccactttttctaaatgtctcggcacctatatctcctcttaactttacaatgtaatactcaagccctatttctctttaaccgtctcttgcaagaattagctctatgtaaactatgaactaaaataattaatgatcattgaaattggactcaaccattaaacatgcctccatgtttccttggattatttgggaccagactacataacgtggaaatggggggagtacctagctcgttctgacgacgcttggatctaccgctctatgtgacactgaggtggtctcccttgaagtgcttgtgctggactgctggctgggtacaatgcatccacgcaaaactctcctattttgcatccacgaaaaactctcctataaagttagaaaattttgataacatagattaatacgtgatatgatatgtcaccctcataaatatgagcaagttcacatttattaacttctacgtgttgaaaaaaaaaaacagggcgagtgcacgtataattagagtttattttttttctacaacttgttgcgatcgaaattgaacttgtatggttgtgaatgtttcccaagttacaaatcacatgttaatttatcttattatgttagaaaaatcatagctcttcgtattcccctcgaacgattagaatcggtgtcctgacccatgca

SEQ ID NO: 25734 - DNA, 1501 bp, Oryza sativa
gcttgatcggctcactggctcagctcggtataggtaccgtttttttagaaaactaaaacctataaccgacacctataataaattataggtacccttttttaaaaaaaccgacacctatagtactataggtgctggtttttctttagaaccggcacctatagttgtttaaaggtgttggttttatgtgttttcagcctacggaggaggaacaaacactataggtgttagtcttaactgttttgagacctatagtgccgatctctatgagttttattaagaagtggagagtttagtgtttggacaggattttctctaacatcatcttaattatctacatgtgtgattacttttggtgaaattagatgaatttttaaatggagtttacacgagtttaaacctaagttctggttttcacttttcactgtatattttcctatgttccatggaacatatctgcgagattgtgctataggctggtaagagtgcacatgcaaatgtttcattaagaaacggcacttatcttgggatcctggctaatgcttattgattattatgtttgagccttagtcggctagtatgttcacgagaatatgttctattggagtaatgatcgatggggcgcagagcaatacaatatcaatatgtgtcaaaggtctatgtgatgtgggtgagcaataatgctgcgagatgcacaacatcagatcattatcatagttcagcggagtgcacgtgagcaactatgattttcagagccttgaatcagcattgtggttcttcctgaagttgcgagtgaatcagaatttatctgattatgccaatttggtctacaatcttgtaggacactttgaaacataggatctaaaaatcacacacgaataaagaaggattttggagaaattaaacagaggaccgagaaacaaaacagtatggaagatgtccctttggatgggcattggaacgaacgtatatagcaagtaaacagtaattaactattttatctgtcgtcattgttccctgatccaatctcgttgacgttaattacatccaacgcgcgctgcattacatccaactctacctttcccattgctccatcttcataatcactactacgcaaattatttatctggacgagcacctcaataggttgcagacggaacgtaagtatacgtgtctgcaaacatcgaccctcattttcgcatacggctccttaagagacccatatacgaaaatatattttcgcatacggccctcttaagcagccgcacaggaaaatagggctattttttcagacgggcctcttaagcgactgcacaagaaaatatattttcgtagacaggcctcttaaaggtccgcacagaagtctgagctacatcctctttccttttcatcatattcaaaaacaattgaaaccttatctctgagtttctctctcccttatcttcttctcacttcctcccctcctttcattctcacctcctctctctctcttcctcacgacagc

SEQ ID NO: 25735 - DNA, 859 bp, Oryza sativa
gggagtagtatttgttttcttgataggactggtcagaccggggtttgtgtactgttcagaccaaacaaaatattgtgaatagtgtttacaatgaacaggtttttttttgtcgtgtgaagctcttcagaccgaaatgcaacgtgcagtcagaccggctagcccaacggtctgaccggcataattatataattatgattagagtcggtttcgagttgtttattttgatactagtgattatctcgtggttatgacttctagataatttatatacgtgtgtaacattgttttgtgataatgttgagtcacgctatgaaaaaatttgtgctcggatattgtttcttgtttgattcatatgtaggtgtgtcttgatgcttcagaagagtattgccagtgatggattaggagtcaacttgagagaatatggcgttcagacgatcaagatatcatgcgggatgcttaggctaaagaacagtgcacgtgattagtgaagatttcatgtggcttacaagaggaggttgtgtgcatatggatgaggagttgaatttcgagggagtccaaatttttgacaattggagttagaagagttggatacttgtatgggaaggtttctgaatgcattagaagtactgctacgagttggaacgtggcattcgtacagccatctctggatataaatagaagaggggttgatgtctttgggtatcgattttggagtgagttgagttgagtgaatagttagggttttaagtttactcgaattttgagagagtgaagttgttgcactttgtgacacgaatagaagcaataaaggtatatctattttcaagagttctttaatttgtgtttgctcgtgttcagc

SEQ ID NO: 25736 - DNA, 1501 bp, Oryza sativa
ttctttccagtgctgttccgtggatacttgccaactcatgtgtgggaagtgttggcagaggtaagcttcttttatcgcaaactttgcgcaaaacagtttgatcctatatagatggcaaacatgcagtctcaagtaattgttttggtttgcaaattagaaaagatctttccacttggattttttaatccaatgcaacacttaatgatccacttaccatatgaagctagcatgggtggacctgtgcaatttagatggaattaccccattgaaagaggccaaaagtatcttaagagcaaggttagaaaccgagcacgtgttgaagcatccatagcagaggcttacatactagatgaaatctcaaacttcacatccatatactttgctaatcaagtgcagacaattcacaatcctgttcctcgatacaatgttgctactcagtctattgattgttccctaaatctattctttattaggggggattctactagccgtggagtccctcgacacctaactcgtgaagagtggaatgctgccatgttgtatgtgcttacaaaccttactgaagtggatgactacattgggtatgaactatgaaattgatatgagttacttctagttcatagctgcatataattttactttaaatcattgtgtgcatttttatcttgcaggaaattcatagatgaggaatggactagacgaggtatcccaacaaggcaacaacaagagaatatcttacggaatggtgctgggagagatcgtcctaatttcgtatcttggttctatcaacaagtaatttctttagcccagactttacttatattatacacttagctatgcatatcctttcagatcagattaggaaatctatctagcttagttcgatgtaatatcttgcatgtgtatacatactttcctaactgttgaacattaagttctttcatgaatgttcctgcaacctaggtaatccccatcaaaccaataaagtattactgctaaaactctaaatttggtgacttcttatatcagtgctataaatttggtcctacaacagtaaagcacatttggattagtgcaagttcctagtatgcatctgcctttttcatagtacaatccgagttaatttttttacaagcattatgaaaatagtactgaacatgtatgtacatgtcattaatatggagacacttctcaattgatcatctgttaggtcggaaatctggaaagaataaaatcattgccaatttctactaacaaaaagaacctagccaattaataacttgataacttcagttttgaaattcgatacctcaataatcaatagtgccttcttccattttctttttgttttcattagtttgcagtttaacacctgttaattgcatttgtgtcaataacctaataatacttgtgtttttctataacataaccttcaatattgccataatagaacattatgccacaatttattgacacattatttcctttcatttcactgcta

SEQ ID NO: 25737 - DNA, 1501 bp, Oryza sativa
gaatatggcgttcagacgatcaagatatcatgcgggatgcttaggctaaagaacagtgcacgtgattagtgaagatttcatgtggcttacaagaggaggttgtgtgcatatggatgaggagttgaatttcgagggagtccaaatttttgacaattggagttagaagagttggatacttgtatgggaaggtttctgaatgcattagaagtactgctacgagttggaacgtggcattcgtacagccatctctggatataaatagaagaggggttgatgtctttgggtatcgattttggagtgagttgagttgagtgaatagttagggttttaagtttactcgaattttgagagagtgaagttgttgcactttgtgacacgaatagaagcaataaaggtatatctattttcaagagttctttaatttgtgtttgctcgtgttcagcagttacatcggcaagcatatagcggttagaccggcgactattcggcggttagaccggcggcttcctagcggtgtgactaacaacatcaggcgacatcaacgaaggcaaggaagttggaccggagatacaccatcggtcggactgatggtatcctggcggtcagatcaccgcatctacaccggtcaaaccgttctccatcaagtttgaaggtaacttttaattccgctaaaagtgttcttaattccgctaaaagtgttcggttctttatgttctactatttaatcctctttggtaggcttagttcttgttattcgatcctacgtaaacaaaaaagatataacgattggttgtcctagattacatgcaacattcactagtacaaaagtgatttttgcagatagcccaaaagaggttttcgcatgcagtagggcagcccgcatgctctggagagtctgcaaaaattgctatctttgcatattggggcattttcgcgtgtgagtgcttatgtcgtctgcatgcaaaaataaaaatcgcaaaaaaaaccaaaactctagcatcccagtggcggcgactacggcagcggatagccggattgagctgcctcctcctcctcccggccacctactcctcctccttgtcggcggcacacggcaggggacggggatggcgccactcccagtcgttgcctcgccggtggctgtggcgccgctgttggtatttcttaacaacattaatagaaatataattcccagcaatggcgtagaaatattcatggtatactatagttacatatcatatccacaagcgcatggatataccattgtagcatttcacctgagagtattccaagggtatcgtatttatttaatcccgagggaagatttataagagagaactatgctaataatttatatggtacttgtaatagtcagtccaaacaggagttaatttaattcatgggtatagtgacacgaagcagaagaactaaacactctcatacatactaatgctagactaagtggagaaataataataaaaggattcattcctatacctct

SEQ ID NO: 25738 - DNA, 1501 bp, Oryza sativa
gggtgggtgaccggccatctagagaagacaaaaggagtaggatcaatgcatgctcaaatccaaatttaaacaaagcaataaagactcaaataagggaatcgaataagagcgaaattttatgcatagatcattttgcatgagagcgaataaataagacagactcacataacgataaaataatgagaaattagatacatactaatgataacaaataaagcataaataccttgcaacccatgttcctgagctaagacctaatgcatttcgcccatcaaatcccaaccgactgacgaataaatcccaatagttttactaaaaccctggactgacttgttttgaaaaatctcacttaaacgagcgaccaagatttttcccaagaaccacaagaacagatcccaattttcccggaataaatccaattgcaaagaacatatgcaatgagaaaggattcagagggctcttaggtttttttttccgtttggcttgtcctacggtcaaggtcggctctgataccaacttgtcacgcccagaaattcccgaatagaatttcaagcagaatgtgtattaaaatccccgtccaggaccggccggggtacacaaacgacaatgttgacatccagatccacgtcttacaaacatcataaaagtcttacataaatgcagcggaagaaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaagagctaaagtggttcacttgcataaagcgagcatttataaacagaaattgaaagatttaaacagttgtaataatgaattaatattaatcatccgctgtccaacgttaacccacgttgcgacaggcccaaccatccactaagctatccaaattaaaagattacactaagatgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacatctcaggtttcacccccgtccccagcgggcaacgggcagtcccctctcgtgcctaagtgaatccggaagcgacagaggccgtcgcagggcccaccccgctccatcacgcccacccttgcctggatgcgtcgactagaggaagctacactacaagcccagccgttgcccacgctggcttgtggtaagtacgataagttcttccagggcatcccgcgaaccggtccttaactgcca

SEQ ID NO: 25739 - DNA, 249 bp, Oryza sativa
atatgcatacattcaggcattgtttcagctcttctgaatcagggcatagctacttcagcaaataagtaaacaaataatgctactggaataatagaataggaatgttatagcactatcaactttatgacatgcctttctatctgttgtttttctcttataagcattatcactttgtccaactcaacttcgtcctcttgccatcctgttgttgaagttgtcttttatgtatctcttgctcaggatgtgttg

SEQ ID NO: 25740 - DNA, 1501 bp, Oryza sativa
gctagttgcagtacttgtgcagccttttgtcagtgttagtgtttattctcttgatggtgaacgcatgtgcttgcatttgttgttcctcctgggcaagctcgagtagactcgaggctcgttcgagccaagcccgagcttaactgcaaactcgaggctgttcgagctcggctctgagttcataacgagctcgagcctaatcatataaactcgctcgagctcggctcgttgacagacctaccccactcaaccatccatcctcatcgcatggagggagcctccctgtcccgatcaccaattccaccactggcccatcaacctcccgaccatcaattcctccccaaatccagaaccctaaccctactggctcaattgctaatcgccgctgccacaaccgacccattgatctccctgaccactaatttatccctaattcctcccaaatcaagaagcctaatcctactggcttaactgcgagcgacagcaccggagtggaaccagagctgaaggggacgaggccggtgcacaggggtaagattcgcatgattttgtccccgagaatatcttttcttacactgtaaacagattacaagttgacggagaagagggcgataaaagtttgagctttctgtgcacagatcgatgacgatgccctttaacttgatgatttagctatataggtcagtggatctggttatagtagattaaagcagagaacaagctgaaaatttaaaagaggcataccggcctggattcgccgccgccgccgccggcggcggcgtttcatggacatgatcctcgccagacccagcatccccatcttgtaatagacgacacgacacgacacggagaagtttccaagtgttgtatagtactactctactctagtcctgacgccgactcgtaaagttgtactatctccgttttgaaatgtttgacgccgttgactttttagcacatatttaactgttcgtcttattaaaaaaaataagtaattattaattcttttcctatcatttgattcattgttaaatatatttttatgtaggcatataattttacatatttcacaaaagtttttaaataagacgaacggttaaatatgtgctaaaaagttaacggtgtcacgtattttgaaacggagggagtactgatcggaagcagcagcgactcctgtcctccccatcgtctcttggtgcaaggagctacggcggcggctggagcctggaggggaacggggcaagtaaatcgtgttcaggcacggccagggagacgagggatgtatagcccgcccggcccagcaagccacgggccctctggtggcacggcaactgtagcgggccgtgccaaggccttagcccaagcacggccaaaagagatgctgggccgtgccgggccagcacggctactgttgcgaatttttttcatttttaatttattttgttttaatatttacagaaatattataccgacgaaaatatttacagaaatagagggcgacagg

SEQ ID NO: 25741 - DNA, 182 bp, Oryza sativa
aagaaaaacaggcagtaaaaacggtaaaaaagaaaatgatttggtttttgattgattaatctcgactctttgaggagtctgaggcgacaccaactcatccctcttccccaaccgcggcccacctcgtcgtcctcctcctctcctcagatcggcggcgagcggcggcggcggcgcacgggcga

SEQ ID NO: 25742 - DNA, 198 bp, Oryza sativa
gaaataccagcccttaattccccggtccttttcccccaaataacagtaattaagcggggacacacacacacctgacacgcggcgatcaaaaaaacccaacccctcctctcctcgccgccgccgcccatggccagcgaccgccgctactactacttcgaagaagacgatggcgatggcgaggaggaggtggagtggctg

SEQ ID NO: 25743 - DNA, 494 bp, Oryza sativa
aatacctcaaacgttattgtgagttttatgtttaaaataatattcgatattttacaagaatatgttaggaaataaaggaaattgtccattttttttggactttttggcattttcatcagaatttgtgtgagattgaaatttaatcggcgtaaccttgtttgcattgtttttgtacagcttatgcaaatgaaaataaaaatcataaaaaaataccgctttttttgcaaattaactgaactttatcagatcacgtcagtcatacttaatgctaacttgacggaactcaagcagtttttttcatttccttaggtaagacctcgcccgatacagaattttttgtgtcgggttttttttatgcaatttatttatctatcagcgctattagcagacggcaattacattagcttgatccattaagcataaatttcctgcaaatttgcctgcttgtctatgttataatattaatcatttgatttgttatttgagtaaggcga

SEQ ID NO: 25744 - DNA, 155 bp, Oryza sativa
tctcagcagcacagcgacgcggttttgtcgatcaacaaacctccacagactctacgaataatttagcggatatgtttatattggccggtttaggtgattttagtcgagccgttttaactgccgatcgattactcacattttaattatgaaaaaat

SEQ ID NO: 25745 - DNA, 223 bp, Oryza sativa
aataactttaccaaagatcaacagaatatgatgttgttgaaatcagatagcgaattttcccgctttatgaaagcaccaacaaaataaatttatcataagcccgattgagatcgggttttttcatctgtattttggtttatggctgtgtaacctatctttagagatcagctataatcagttcaaaattcaatgtaaattataattaagaaagaggcaattccta

SEQ ID NO: 25746 - DNA, 171 bp, Oryza sativa
tgggttgcacggaaaacggagcattccatttgcaggtgagtaattaagtatttgctatttttttaaaaaaaatagatcaatatgattttttaagcaacttttgtatataatttttttaaaaaacacaccgtttaatagtttgaaaaacgtgcgcgcgaaaaacaagagaga

SEQ ID NO: 25747 - DNA, 236 bp, Oryza sativa
attattggtatttatttcgacttgttagacaatttaagaaggccataaatgggttttgtgtacacatctttagtagtaacaaccatctttaggagtaaacatttgttctttactcccagttgttactaccaaccaggactaaagatatctttagtcccggttgaagccacgaaccaggacaaaagattaccgggtataaatatccactgcatcggcttccccgcgccacacttaga

SEQ ID NO: 25748 - DNA, 1034 bp, Oryza sativa
caaacaccacatgtagcaggcccaaggaacaagacaatgtgctaacaagatggggcttgacatcttgataagttggccaattatccaatagttttattttatactgttgaagattttccccctaaaacttttgcatttttagatcgttcgaatgtactttgagattcatacggggagggaaaaaaatctacgctatgagcgaggcgggattggagcagctgatctcatgggcgaaagaggagtgcaactagctaacctagctacatgtgtttcatatctatcttatatgttatatatacgtcgcattgtaaccacactagagttgcattgtaattatactagaattacattaaagttacatttgaaagatttggtagatttttatgttgaaagttgtataagtaatccttatctaaatagcacacgaccaacttatccatataacatcatttttttgcaagggaaaaaaaatcatattttcatccaaattccgtactaattattaacatatgccaaattttaaagaaaacatataccaaatctttatccaatcaaatttacgaatttacaattgaagcaaactaacaacatccgatcagttttcgtccctacttctatattactataatataagatgacaaagtagtagttgtattctcaatttatacatggcataggcttgtaatttcttacaaactcctagggcaaaggctatgaaagatgcagaagcggggcctttgcccaacttaaattgatgggactgggcctagctaactgactaggcctagttgggctttccgaaagcgccccacatatcgggcccatcaagcaacgttggcccatcacatcacgtatttcaattcgtatttcttcagggactcggatgtaaaaaccgacccagccaagcctcctcacccccacctgtcgtcccgtccccaagagagattcgtctcgtcgccgtctagggttttagccgccgccgccgccgccgcgaaaccctcgccgcctcgcctcgcctcgcagcggagtcagga

SEQ ID NO: 25749 - DNA, 1501 bp, Oryza sativa
tcagtactgattgatgctgaacctttctgctgtttcttgtgctatgtatgccttgatgcagtgataagagcataagacctcttctcctgtgagcagaagcaaagcaccggggattgattctggcacaggcatataatgcagtaatatgcctcaagacagatcatctcctttcggtgctttgaaattttttcgccaaccagcaggtgcgtgcaaataccgatttgcttctcctgctagtctgcaagcagacagccattaaacaattgcacatgcctaaatcagaagcaagccatttgattgggaactccatcaaaacaatgacaagaagattctggtcctcacatcatgggagcactaagctatgtcactgtcactattctggaaatttctcaaggtatttgatagctatcgcgatttctgtaggccttccagactctgttggaggagttttatcaggacctgtgtcaaatgtggcaacaaggtggtactttggtatttggtagaaatttatattgaaatgatgggggaggatcggcattctaatttgggctgtgtttagttcgtgtgccaaattttttttgaagtatacggacacacatttgaagtattaaacgtagactaataacaaaacaaattacagattccgcctgtaaactgcgagacgaatctattaagcctaattaatccgtcattagcaaatgtttactgtagcaccaccttgtcaaatgaggctaaaaaaatttgtctcgtgatttacatgcaaactgtgcaatcggttttttttttcgtccacatttaatgctccatgcatgtgtccaaacatttgatgtgacggaaaagttggaagtttgaatctaaacaaggcctttggttcaaatgtgaaacttcaggaagaaattgagacccgtgcattccccaaaggtgcttctccattacagcacatggtcaacaacattacttgctgtaggaaatgaccttatcatcatgcacactggtggtcctattcatatatctagtctctttcgcagttcccctaatttttggactgaagttatagccttgtaatgatgtgatgaacaatgagattgcgctgtcacatcaagggaaccccagtccctactaatgtaatccacataggtcaaatggtggttaatttggcactcttcttgtaccttccgagccatgttgaaagttccacagaaatattgggccatccaagtagtttctgaaagcaacatgaagaccagaagcatctatattagaacttgatcacttctcttcagcctgctctgggttgctgaaagaagttcttgtttcttagagaactttgaattttctgaagataacagtaaagaaagggctcctttcgcaatcttcacataaggggagggttcagtaacaagttgagatatgggaaactgcgccagctttactccaaaatggtatacatctgatctcgctaaaggtttcctgtcatactattgcctcgcatcttttgata

SEQ ID NO: 25750 - DNA, 1501 bp, Oryza sativa
  unsure (1)..(1501): unsure at all n locations
catgaggagaacctgctggcatctggtaagagccattttaaatccagctgataaaagtttgtaagttgtttgattaatagatttttaagtctggttataagtatactaatcctttcagcttgtaatatttgacattattaacttttagacatagtttgattattcattttattcaaaaatgtgtgcaattatgtaatagtacaagtcatgcttagattattggtaatgataaaataaatcacatcaaataatagttgtgtagtaatttattaaagcttggccaacccacaacaacaaactgccaacataatccaaatcggtgatgtggcgtttccaactctttgctaatcatcgatgagcctagcagctgccaagtgcaaccaggctcgagcgccggtggtgtttagctaacactatctatttcaaaagggaagactagatagtatcggtagagccaggaacattaaaaaaaatgttaggcgccgatagtattgatattgttttaagaattttctttgttctagtaaatacaacaaaaaatttcaaaccatgggacaggccaagctcatggtcgcctctccttgtctttgccgatgctaggtagcaagtgagttggcttagttacaaacatccattgatggcttgttttgcaaatgagattatgaactaaagggtaaggttcaataatatccatccattatttttattgggcttcccctaatacatgagtgatcgtgcacatcaagatacgtgattaggaaacgacaaaaaacagcccaccctagcctatgtcactggcctaactcatatgctctctctttctcttttcctatcctcttcttctccgccacaaaaggaaggcgagcttacgacgatacaacaaggaggttgatcaaggcaacgcggcgacgaccttccttgccccttcattttccctccagcaaactctagatctaggtnagctccactctcccacctcctccgccgccctaccatccttctccgtctcacttttgcccccgccacaaactctagtctactgcccgctaccaacccagtggctcgcggccgcccacccttgttcgtcacccaccgtcggtctgctgcctcctaggtaatccctcttaagcttgatccccacttccttcctcctcaaatctcacccataaaactctaatcctaatccaacctagctgcttctcgccacacagtcgaaaagtgatcgtgtgcgcgactgatcgcgaggtaacattttaacttttagctcatatataataatccactcattcacattttccaatcccatcccttataagttataacccattgccaaagagggcctaaatagatttctttagccatttaaaaaattctcaaatttccaggactgtgagcccctttctgtaaaatcaccgagaaggcctcgatgaagaagaaaaagggaagaaagagagcgacctctcaccgtcgctccaaaaaaccacatcactattcacaacag

SEQ ID NO: 25751 - DNA, 480 bp, Oryza sativa
tctgtaaatacatattgaaattgtgcaataacatgtatatagtactcataaataagaagactgcaatagcatgtatttggtaagagacaatatgtagataaaaatccctacagtgtctgccccatctgcccatcacatgtataatttactgggtgcttcaagcatgtgctcttttgttttgaaacagaatatcaactacatacagaacaggatatcaaatattcatttatctgattagatattggcttggtgtgcctccaaactggtaaaaaggtaaaattgttggcatgcaagcacatagtgaagatataaacctctataaattggtggacattggcggtaaggaataaattatccatgacaggatccagttaaaaataaaattgctttcttgccttgaaaaggccaggtatgtgagaagtcagaaaaatacagatggaaatgaaaatgtaatgtggaatgctcttatatgaactaaaa

SEQ ID NO: 25752 - DNA, 1501 bp, Oryza sativa
aactgaatggagtatgccggagcgccctcccaaaaccaaaataaaagggattgcatctctattctttaaagactcctgcttccttccagattgcgacctcttctttgattgcacccaagaggctgcccgcctcctggggaacaaattaggtgacacagcaatatagtataaaattgaagttaaaagagcatgaattaaatagcatcgatctgaggtgctaccaagtgaagctaaattgaaagggaactaattaagggcagatgagaggattgtagatgatgcaaagttaaaattgaaaaggaactaattaaggagatgagaggatggtaggtgatgcatggtggagaggggaaaaagctagggtttgcaagaagttaaaagttaaaacttactctctcgggtatcggcgaccttgtaaaatctgtgccaaaaatcgtcgccgctgtagatcgatccatcgctatgtttgctgcactcgaggatgaacgcgcgattcaccccgtcctgactacctgctgctcgcctcccattcttctccgcctccgcctccgcctccgcttccgcttccgcctccaccagctcaagctcggactctgcccgccgcttcgccatgacatcccctcgcgattccacccggcctcaagctcgatctctctcgtttgcttcatcttctccctcctcctccacccgggttttattttgatttttgcggcaacaaatccgaaaccgattcgtattgaagaaaaagaatacgattcttatatcctctcaaataaatactactactagcagtcaaaatcgatatgggctgatttatgggcctgtatatgggccgtacggccatctaccggtaaggcccataaaagatgagccttcatccctaacctccggtcgactccttgatgctgcgcctcgcgatcgagcggctccagccctaaatagcctctccctgtctcagaatcataaatcattccatcccccttcatggctaccttgctgggatcaggagtctgctgattggattgggctgcggacctgcggtggagggattcagggtttctcttgtccctgatccactgcctccacgtccaacaatggaggacaacgttcttgtctcctcgaaaatccatggaaggtgactcccaactcatgcacctttttctttatttgcttgtgattttaatacgatatggaatctaaacaaaggcccccgcaaaaaataaataaatagagaatctaaagaaaggcatccttacatggcagaattccatcacattatatgcttatattcatttatttgtgtactgttactactaataataatgcaaaataccctctgacatatgtgttattttgctaaaaaaaaagtttcaagaagtcaattctgtgtgctacttaaaacttctgaaagaagtatcattgcatactggcagagcatgctgattgttggtttcaggagtaagagcacaacagccaaaaggaattgtataatttgcggaca

SEQ ID NO: 25753 - DNA, 197 bp, Oryza sativa
aattactttttttaccaattatgggtatatttaattgttattagtacattaatatttctaatattattaaaataattcgaaaaagttcccatttttttatagaaaatattttttattttgctattgcacaacaatttttctctttctacaatagtgctttattttgcttaattttaaatcgttataagtaatttagt

SEQ ID NO: 25754 - DNA, 1501 bp, Oryza sativa
acacatttcattgacgggagttcagttgaagattcggatccacgatttgcacagctcaatgatgaagcactggtatcttctacttctaacgcaacatgtcgtaatgagtcaattgaagagaaatcaagtgaagcattactggcaggaaacgaagattattcagaactgccaaatgaactgttaaaatcaggagatccacagactgcagatagttctgagattcaagtgcaggttattgatgctacaggtcactgaatgatgagacaagggcctaaaacaaggccaaacagccaatttctcagagagatctgtaaagcatagatagtccagtattagctctctgaacaggtttcttgcccccctttgttccaacttgctctatggcgtctggatttaacttttcctcttcttaatacaaaatgtgcagcaatcatgctgtttttcttcaaaaaacttttctcaggaagtccgtaatgtcagaaatatccaaggaacaatggatgtccatatggtttctgcttgtttcttctcttttgtttatgcttatttggtttcggttttgcgctaataggttagctatgagagtagatgatattgatatgaaacaccagttgcagttgcggtgtgatatccagttagtcaagacgatctttctgtcgctgcctatggcatagtttttcttgtctgccagactggcattggcaacccctgatggtaaaccgctggactggagttgcagcttctgcagtttgctccttcaacagttatccagtcagtaattaagtaatcaagtaatgcttccatagatttacctcctcatgcttatctgcttgttgtttgtggtttcgttaagaaaatcacagttccttagttaaaaaaaattcatagttcattacattacattacatgcatgatgtttatgttgggtataccgatctggatctgaggcgtgttttgttgggaaaattgaagatacgctactccccaggaacctttttcaggaaatcactcctttagcttgactttgctaaaatggattgtttgcatgatactaaaaaatacatgaatctttggtgtagaatcgcattgatgaataaatctatttttttttcatctgtttatagaaccatatcttacagatgagagcgtggcattcttcgactgttattctgttaaacaaataaaaaaattaaatatgtactgaacatagggtcaaacatttgacaactagccaacacacaggaatatcattattttcaaaatcacttcaaagttgaccaagacaccttcagcagtacacgggggccaccaagcttaagctctttcatgtcatatccatgtcttctagctttgaatggacaattttcagagacacgatacgagccatctccctgatcaaccttgaagaccaatggacagtattcagggatatcataatccgagccatccctatgaacagccttgaagattaaaaacaaaggtgtattctccaccacagcaa

SEQ ID NO: 25755 - DNA, 1501 bp, Oryza sativa
ctatctattggttggttggtttcaatataaatttttcaataatctctttggcgttccaatttttcctacataacaggcatgattcatgcaatacactgactgaaaaaataatatggcttcaaaagccattaaaaggaagccttacactgctgatattgatagaagcgaaaaacagatggagacgatcataccagattctgtaagagaacctcttctaggaaacagaactcatgaaagcaaatccgaggttagtgaaatttctccaaatcatatgaatccaggttattaaccgcattttagttcttcatgcgccttaccccttttctcgtactttttttttagagacatgagcctaatatgcagccaaatttatgggatggaaaaggacaagagcgccttggttggatgcatattatatcgacttttattgctcaatctgtaagaaagataggtacctatcatgaatatgattccagagaagtggattttttagtgtcttactgccctctcgaatgtacacagcagaatgcttaaacttgaccttttagaacatttactatctgaaaaatcttctttttttttccaggaaatgcgctctctcagtttggaccattgctagcaaagttctttagtaggtcttgtgcttcccatggttcacatgatgaacaggcagttctacttgatctcagtccactacaggtataatcagtgctggcacatgcagatctcctatttccatttaaaataccatatgattgatgggttaagtttcccatcaaaagcatgaattcttatgagtatcagatgtgacatgttaatttcatgtaaatattttgagatatttcaaaccttttactgaagtatgaaggaaaatatcttttcttcctcagtagtttaagcatttgaatgagttgtttcaagcatactctcgacatctttgatgctcaattcatctttcatttattttttatccttttttacaataataaaagttcttgtttgcttttgtgattattcatggacaaaaatgttggtatatccatgaacaatatcatggtaacatccatgaaacttgttatttcttccacaacactcatttagtagttgaattgcatgctttaaaaattcaaatgaattcttgacttggtttattaattccaacccttctgttctacaggagcaatgatggcatctttatgttattcttgactgtttcaagtttttacatttaggaacttttttacatgatactacggttttgacagttccatgtttactttataggaagagagactgaggttcttgagacaaagattaaatgtgccatttgacagttcctctgtcaagcatcaggttccgcttctgtacctaactacctataggcctttggtattcttgttctattgttctcaccaatgggacaccaattttcttgctcagaagaaatgataaactgaacaattcatatactaacattcatgatagtaaaatatttcatttt

SEQ ID NO: 25756 - DNA, 1501 bp, Oryza sativa
ggctccaagaaagaaagaagagcaaagagcatgaaagattggatgaaagaatacgtaccgaaagtacccaggtagaggtacttgttccccaggacccgccctatccgtgcctcccaccgcccattgtggtgatgcctgaacaaaaccagacaaaaaaaaagttcagaaatgaattactaacagacagctactagctctgaacaaaatggaaacagcaagttggtagcactggcaccacaatacagtaactgatgttggaagcagatttcatcaagaaagagagaagcttaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaagggcaaggtcccccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttcactttttctttcattatagtacattatactgtaaaaatactcaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccga

SEQ ID NO: 25757 - DNA, 1501 bp, Oryza sativa
aataatatctttgagatttgcgaagatacaggacaattttacatagcatagcagatgacgcactggcaaattaactcaagataacaccttgttttttgtatttttgcgcgtcagggctctgctggacaccgaagattagcaatcaatttcgttgcacttattttaattggtttctttttgagagatttcctctgttttaattatattattaacgagtctccaccaaaaccctggtatatcaaacaggcacaacattgagaacatttcttatgagccttgaaatttggtggggattgttagaataattgggttaggcccaacttataatattaaatctcaaaggcccataataagtgttgaggataataataccacctcaggatttaagcgagaaatatctcaacctaaatagggagttattggaggctccctgttgaccagttgaggtgggggtcggaatgccacacgcgcgcacgcgcgcgcgccgggccgggccgtgggcgagggcgagggcgtggctggcttttgcagccactaacccacgttcccacgattccctccgcaacagcgcttccacgttctttctcctgatagataaggaggccgcgagtccgatccgatatcatcgcttctttcccggtgttagtttctccttctccgcgcctgagttgctctcgcttcctcgcttctgatctcttacgcgcacgagagattggaaggagcagtgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtgaacgacaacaacaacggaggcaattctgcctcaccatccagcggagggccattctcagggtataatcttctcctcctgctactattgttagcgctatcgctatactatgtgcgctatgttcttgttcctgttctacatgatgcctctagcatgttatcgcgttactgttatgttcctgttcctgacattcatgatgtgcatagtatgctactggttatgtgaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 25758 - DNA, 1501 bp, Oryza sativa
tgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgtaacgaggcctgacatctcatttgctgtaagcaagctgagccggtttgtcacaaatccgggagatgatcattggcaagctttggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaactaacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggggtgatagcattggactatgtccaaacggctagaaatctggcatatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttttatgatgtgcttctcttctttcctgcatggtaggatggcttatgtcttaatgtgatccgagtggcttttccaagtagagatgttgacctgcagaacatctcagaaggaacacacctatatgagttcaactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactcacaattcaaggcatagtccattgttcagttgtggtctaatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggtccataataagtgttgaggataataataccacctcaggatttaagcgagaaatatctt

SEQ ID NO: 25759 - DNA, 1501 bp, Oryza sativa
tcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataacaataggaatatgaaaatagctacaagatgccaattaatggagagcaaagactgtactatttctgaaccacatagtaaaaaaatttaaatgtttaaaagaatgttgatggaggttgttgggtacttcggttgatattcctaaaaagtacttcatatctcaaaacctcagtgaagtgaaccagcattgatttgctaacctcattatgccaatgacgatcagttggatagtgggtttctgcaatgcttgatccacctttgtcaaaagatgtatttctgttcttttgtgggatgttcacaactgagtttatttgagggtcctccagtgatgagaaatcagtgctatccaatgtcgagatcgatacacattcctcaaaataattcattgcctcttcagccaaatgcttcgatactttcagtcgttctacactactctggtaccacaacatggaaacaaaggtcaattcaaatacaaagaccatctatatttatgagcaactgcacttatcgtatctttaaatttcagaaaactacaactttaatgataaaaccatctatatttactgtagcagcatactccctctgtcccataaagaagtaattcctagattcccaatgcaaaactaaagagatagataaatgaccaaaataccccttattaatagcatattagtattgatggttaggtaggtaaggagtattgaagaaataaactttttcgatttgtgaaccaagtgtgaatgagaaggtagaagttgatttattttgtgacaaagtttgaattccagaagttgatttattttgggacagaacgagtataacgtaaaagttgtagttttgtgataatttttcacgttattgttgcagcaaactgatacttttatcactaaagttacagttttcggaaatttactcttctttaaaactacccttaaaacaagcattgaaaaccaaattcatggtggataacagaatgaccatgtagaaatacacaataccatactttcttatacttataagtcaaaatttaaatttt

SEQ ID NO: 25760 - DNA, 1501 bp, Oryza sativa
cagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaa

SEQ ID NO: 25761 - DNA, 1501 bp, Oryza sativa
tttgaactccggaaaccaacacaaaataatggcatatcttgagttaatctacccacgcaaccaatgtttacagttgcaccacttgggacaagtgttcagcttgattttctttctatgaaacgttttctctgctcattgttcttctggctagttttaccttttccgtatttcttaaggcattgtttatctgtgtgatcgtgatcattgatgttatatcttttatatgtatttaaaatagttgatagtatgtagataattaccgatttggatatttctatctcagaggaaatcgtacaatggtaaatccatccacttgacaatatatttggtgagggcacaagaaatagctgaagtcaatttcagtgagtaattgtcattgtcgatcttgtgcatcaataagaccgaaccgaaccgagatataaagtagcggtttgttcaggtgttcggtggtgcgaatggtttttattttcacgcatttcggtactcgttacacagctcggtttggatctttgttaaaccgaaaataccgatgagaaccgaagaacaatcaatcagccaaccgatctgtcaacccttcatgaccaacggtccatcaaatccctaataatgctatttcccccaccggttcgtgtccatcaacgccgccatgcggaattgcggagtgcctcactactagagaagaagtctttggagggtcagccgatttccacaatagtcccggttccaaaacgaaccgggactaaagtggcttattagtcccggtttattacttcaacgggacaaagggatctttagtcccggttcgcctcctgacagggcatgtcagacctctgtcggggggcttgggatctttagtccctgttcgtgttaccaaccgggactaaagattatatctttagtcccggttggtaatacaaaccgggactaatgtgatttgagatctttatgcccggttggtgttaccaactgggactaaagttgcacagctttatatactccttcttcctcctccagcccgagccattgcttcaaaattaagctttgagggagggaggtaccgtcaaaattttaagcaaattttttttgtggtaatatacaaatttgaggtcttcaaaaggttagtaacttcatcctattctttgttttgcttagcatctacatttggagctatttttttacatatttttccctctagaaaatgtgatggaagatgatgagagagaaagtgtgtgtagggaataaagaagattataaatacttgtttgaataattaaatataattttgtatgaaattataaaactaagctaatttaatattaaaataagaaaaacatattaaatatttgtttataatgtaattaaaacatgaaaaatatgtacaatgaatttaatagtaatgattaattgtatgaataattatattcaattattgtattattatgtaattaccttgtaaatcttggattttgtataattacgatttatatgtatttcatataga

SEQ ID NO: 25762 - DNA, 1501 bp, Oryza sativa
gccagagcggagggcaatggcggtggcggcgcggatgttgtagctaccggtgggaggcggagggtgcatgggcgacggcgtctcccctccatcctcccagatccggtggaggaggaggcgaagggaggtggcggcagcggctaccggtggtgatgacgaggagggtagaggcggcggcgtcggcggcagccctcccctctggatctggcgtggcgacagtgaccctcccctccgaatctagccggtggcggcgacctcccctccggcgacgactgtgatgctatgtatttgttttgattatgaactattttgtttctatgttaatttgtgatgtttatgtgaatttggtttgactggatttgatgggaaataggaaccgaattggatggggaatgggaactggatttggaaacatgaagctgcagccggccgaaacggcgtggctgccatttttttaacgctagaaactctttttgcaggcggaccaatcactatttttacaggcgttgcgttgcacgtggaccagttgtccgcctgtgaaaactgtttagcccgcgtgaaaaaatactttttctagtagtgtgctgtattagctagctgcgatgtcatatacaccgagatcgactacacacttcatcaccatcgacaaggcatagcccagtgcatgcatggtcatggaacttgctgtcgttgcagctagaaaatccccaaccaaacttgctaatctccaggagctgcattccttacagatgcgtgagccccactacctcaggactggaagtttatgccatttaattatgagagcctgacgatcacttatcaatatcctattctgcttttattctccgaagatccgaaacatgccagtcttaacacgtcgcagtcatatgttgatatgcattatatattcggaactttaattcacgtggccactcagtcgattgtgagatcaggggtgattgtgcagagaactaagttaattaactatctcaatgatctctattaacagctagagagtctcaagctaaatatgaaaaaaggtatgatgtaagattggatcgattgatatcgaattatatattacgatatgtcatctctccacagcacgagttgatgcatatttattgggtcgttgattctcctgaaactcatttgatagtgaagatcatgttcaatgcatgagtgcggtgattgttcagaaaaaaataatttaacaaccacaagactatatatgtttggacaaaataggacgaaaatatttcgattttaagttccccagggaacatgtgatgattttttgagaatttctccaagtcattaaataatgcagacagagttggggctagctagagccagatagtcgatgtaatagtataaatccacatagccagcaccaagagtttccatccatagacgcatcacataatcatctctctctggcaactaatttcacaagcacacattcttccatttccatcgaccatgcctggagcagctacca

SEQ ID NO: 25763 - DNA, 362 bp, Oryza sativa
ttgagttagcaatctagaattttgaacaatttcttgctgaatatgatcgattgttttttctaaattcccaacaaaattcgaaattctcgaccggaaaaatgtcctactggaagacctgctagtagacctgaaattcaaaaattacgttgtggaattgtgaacccaaattattagcactgaatatatgtactatcttataatcatcttgattgggtagggtatgggtatgaaaattataaacgcattcatagttttaactggtatcttcttcatgtctgttctacttgggttctcaccctgttctagtgcatgcggtggaacccttagggttctctgattctcatgtaccacattgacggtgt

SEQ ID NO: 25764 - DNA, 453 bp, Oryza sativa
ggaaaaaattgctcttgtctctttctgtgatgtttctgtggatgtttctgtgatctatcatctgcttagaatacctgtgcatcatcttgtgaagattggcttagtctcctgtttcgaaatttgaatttcatcctttgttacgttacccagaagttcctgtcctaaaacaccggaagttccgggcctggcagaccggaagttccggtgttccttaccaggaagttccgggtctatttgaattttaccgctgcgatttgttttcaagttttcagggacagcctattcacccctcctctaggcttcgtcagcacgttcaattagtattagagcaaggtactcttgattcaagcttcaccgcttggagtgatccacaatgtcgcatctagagggaaccgaagggttggatgacaagggagacgcttctagcaccaaggatactggacccaagggagc

SEQ ID NO: 25765 - DNA, 1501 bp, Oryza sativa
gtgctaccccttttattattgctgaattcatgtttcaacaatcgatatcatatttttcttttaatcgccgaatatccgaaacattaccagtcttaaccaatgtcgcagtcatgagtgatacatattattttattcggtacatgattctagtgaccactctgtcgattatgagatgaggggtgattgtgcggaaaactaagttaattgactatctcagtgatctagattaacagctggacaatcacaagctaaatatataaaaaaaaggtatgctgtaggattggatcgatcaatatcgagttatatactccctcctttcctaaatgtttaacgccattgactttttaaacatgtttgactgttcgtcttattcaaaaacttttgtgaaatgtgtaaaactatatgtatacgtaaaagtatacttaacaataaatcaaatgataggaaaagaattaataattacctaaattttttgaataagatgaacggtcaaatattttttaaaaagtcaacggcgtcaaatattttgagatggagggagtattaagatatgtaaactccacagcactagttgattctcctgaaactcattaatttgaaagggaagattaagctcaatgcaggagtgcagtgattgtgcagaaaaaataatttaacaaccccaagccagctatgtttggactacaatgatagctcgacgatcgcaagctgcatatgaaaatacgaattaatgctgaaatatttgggtacggtatcgcattctaaactagtttgctctacaatattatatgttagtatttattaattacatactctaatctatagtctatcgtgaaaataagatactatatatattgaacatggcagggatatttttcctgttatctaaaaataataacgcgcgatgcaatggaattaatcatgatagcagccaggtacgtagcagctccttctaatataataaagctcgtgtaaagattttgctcatttgatactttgcacgatgttagaggacatgaagtggaaaaagggtccttgatccagaccacagtagctgtggattgaatggcagacccaactttaattgtaaatttagagtttggaagatatgtcttttatagttctcttaatgtatgattttgttcatggccatgtgatcagggtgttactacatatattatggtattgagttatatatatatattatatgtggtctatagaagaaaaatatttctatttcatttcattaaacccacggaacatgtgacgattttttgagaatttctctaagccatttactaatgcagatagagttcgtggctacctagtgctaggtagctgatatgcttagtataaaaacacagagacagcagcaagaggctccatccatagacgcatcacataatcttctatctctctcaggctaactaatttcataagcacacatcttccatttccatcaccatgcctggagcagctaccaccgccgccgttgttgaca

SEQ ID NO: 25766 - DNA, 1501 bp, Oryza sativa
ctcacatatccaacttatagtatgtccggatacttgttcataatcatgtcgggtgatcaagctgacaacgctcgtgaggaattatccgttaacaattttctctcaaatagtctagccgtagctggcgctatacataagataagtcgtcagtttttgttgataggttgggtgcgacaactcagcatttttcgagaacgttttcgataatggggtgtactcgaccacatcctactcgagtgctcaattgttcctgaaaaatattttctagaagacaagatatatagcagagaatatagagcatgtactcaaaaaactgcatgaatcttctagtattatcaggatataatgagcaaattaaatatcagtcattatgaaaatcgtaaacaaatatgatttatattgaagaaaatagagcaagcccctagtattaaaccgtagttggcttaacattgaaaactctcgcacaatagatattgtataaaaacacgctctaaataaacataataaattattgacctgacaatattttatatatctgaaaaataggtacgataaattgtatatataaaatattgcgtacctttgtagatacatgccgctacgaaattaataaattaatttaataaatcaatccactaattaccttttagccaaactaaattatccttagcgattagcacgtgtggatggcctgcctatatacctatgtgtgcatacctatggctaacatagccttcggtacacaccatgcaataccgtacatgggtcccaccgcatgcatgctaacatatgtgtcaacgcgtgaagtagtcggccatcttcttgcttggctgtcctgctgctgtacttgagatcgatccaatctgaccacggcaagacaatacaggcgacatgtaatagcattctgtttgtcagtagcactttgtgtctgagacggaacactccagcacttggcctcaaagcaatcgaactcagctggcggtaatacggcagaaaagtttggtgaggatgtcgtggcaaaaaacattgaattaatgtcctccgcgacggcgatgtcccgtaacttgcgcgatcttgacagattgaattattggtgatgatggttccgatctcattggatccggtcaggttagatcttctcacagccgaagtcgtcgagtaacttgttgttgaagaattcatctcttgaatccatctcgtcgaaaccttgaagcaccaaaaatctttctacctggcgtgccactcaggggcggtaccacccattaggcggggttgggcggccggcccagctacggaaatgaggacacacctagctcggatattaccatgactaccttatgtatgaatcaaccaaaggtgcatatgttctacattagatttacttgttatatatttgaacaaacgttgctacacaatgagtttcgtgtgtttttgtttgcagaggtacttgcttgggcgaaagaaaagagaccgagcgtaaagaatgcatggatgattgaag

SEQ ID NO: 25767 - DNA, 404 bp, Oryza sativa
ttgtttcgaaaaaaaaaacattttactagtgtggctgtgggctgtggccgaggcccgtacagaacggcccaagcgcccgcctgtggctgagatttcttaaaccctagacgttcagcaatctcatactcccccaaagtatgagatttcttctcacttctccgaccttgcacccgcctcagctgatcaggtccgcctcatcatcttcttcttttttgatcgagagccaataatttactcttcttttgctttatctttattatcttatctgaggtatttatttgcttgggtttttatgatgccatcttgggcgattcgaccgcaggacgaggtactcctccttccttcctcacaaagtcacaattgtttccgatccaaagtttgagtttcggttgattgaaagacga

SEQ ID NO: 25768 - DNA, 1501 bp, Oryza sativa
tcggacgactggtaattgatcgctggttaggagaaaacgtgcgcgcataaattggattacacgttagtgaaagttgctggattacaacaatccgctgtgatgagtggtggcccaagtaaccggtccatatgaagttaccatgtctagcccagcagtccaggataggtaatcatctgcacaaggaataagtccacttgaggtccctctcgtctaagtctcgagattggatctcatccctcaaccacaaaactgggtataatgcatccctcatttattaaaaccagtgcaaatatagtcccaagatggttttggatgacggtttaagctaaaggcacccacgtggcacattgacttgaggctcggtggaaactacctggcggggaccgggctcggtggagaacgaggtggcaggggctagctcgagggagaacatggtagcggcggtcgggctcagtggaggacgaggccacgtcgccgaactcggtggagaacgaagcgggggtggcgagggcgtcggctggaggacgatggtgtgttcgcaagtgcaagatggcccatccctcctgcacgcaaaacggagcagccttttaacacatgattaattaaatattggctattttttttaaaaatggattaatttgattttttaaagcaactttcatatagaaaatttttgcaaaaaatacaccgtttagtagtttgaaaagtgtgcgcgtgaaaaatgagcgagaggggttgggaacgtggggttgcaaacacagccaatggctatatctgaatagtgaatgatgcaatcctgtttgggggagcttgtcccagctgcagcttttcccaaaagatgcttccgctagaagctgcctcaaacagtccacagcttctgagaatatgtagttatagattctgaaaaataaactaagaagttagaagctgggttttagagcttttccagattctcagaagctggctaccaaacagctacttctcagaatctaaagctccccaaacaggccattagtttgggcaaaacacctccgtaacgggctagtacttcatgccgtcactgacaatagccatcagtgtcgggcttcaaacacaaatcgtcaacggagagccatttgtggtgttgattaatcttgcttttcgtttttattgatcgagatgttgagggattgaatttgctaggttttatttctagttttgacgtactctcaagatgggtagtaacttcgaagtgatcaaaataccacattaggacatatgcatgagggtgcttggttcgtttttcattcatctatcttttatgtccccggtaggtcttatcggagaatctgaccggtctaatcgtagtgtctgggccagtctgattgagcccgactcggtctaattgggcgcctagcgagtcagttgggcggccataaatgacttggcaatctagagccaccagagccgataccggtctgagcaagccaaggttggtctgagtgactggatgatgtgacca

SEQ ID NO: 25769 - DNA, 959 bp, Oryza sativa
ttggtggagtgggtttgaggctttgatttgcttgctctcctctagatcatgcaaaactcacaagtttctacccagtttcgggcctccctgaggataacaatcctactcctacatttcctttttttggattgaataaactagggatatacaaacccaaatcatttttcctacataactcgagagtctgtcttcaaatgttttcaaccccttcatggggaaccctcggccctttatatagtatgatagagggacaaaaccaagagaaccgtgcaaacacccatgatggtctaagccctagttgctgtgctactaccacattgttgagtagatcagatgctagctaatcctgtcagcgggcaggatccactatgtcccccccccctagggatttctaggctgccatccgctcatagcccttgggaacgccgtgcgttcggcctaatccacctctgggcagtggtgtaacagacggcctaggtttaccaatctggggggtggtcccggtgggaccacacaaaaaataaggcaaccgacccaactatatatagaaaaaataatagaaaaaaagcgcatgaacctggaattggaaaccgaaacgtcgcgcgcagcatcacacgattgctacgcgtcctcttctcacttgactactcgtttttcgcgctgcctcctgccacccgcatttgcacaagcaagtccatgtggagaggagcagaggacggaggactgcgactccacgagcgcgggctgccgccgccacccgcctatcaccggccacggctcgcaaagcagagtggctagcgtgacgagactacgagtccactctccgctatattgtagatcgctaattgttgaaacatgcagcaaagaaaaatagttttaaattgctttcttccccagttgtggtataggagcacactcaggaccaagacgttgagaagatgtctcaccacccccgccgc

SEQ ID NO: 25770 - DNA, 204 bp, Oryza sativa
tggtgatcggagacgaagccgacgccaatccatcccatctggctctgtgcctctcccgcggcccgtgctcgccacacaccccaaatcctccgcgcggccacgcctactcacaaaacccatccacgtttcgtctccccccaccgatcactccatccatccaccaaccccaagaaacccccctgcgcgagccaaacccaacaacca

SEQ ID NO: 25771 - DNA, 383 bp, Oryza sativa
aaaaaaggaggaaaaagaaaaagaaaaaggaaaaaggattttccctggaattaaaatattgcttgctcaattttaattggttaaaattatttctagagctctgaaaattccactaaaaatcctgttagtgaatttcgacatgtagaactcaagaaaaattccacatgtcaattccgattattatctgcattgatttaaaagggtttactcttgctttgcactggtattttcttagggtcatttataaattaaattttaggcttgggaggagaacttcggggtgtgacattcgggcccctgaattgtcaggtaatagccctacatcctgttggccgaagccgaagttccactttattcaccataatcacaccagtacaatattt

SEQ ID NO: 25772 - DNA, 914 bp, Oryza sativa
  unsure (1)..(914): unsure at all n locations
cgtgggcttgaaaanttgattagctagctcgtacccttaacttcatattttttggggggcgatgggggccggccgaccaccaacctgcacgtttaactaatgggaatcggggggatgccgtggttaaccgcccccctggaggcacaatttggcttaacgcttacctggggacagggttgaattaaaacaatgcacttggcttggtttggtaattccggcttcttaattgtggttggccactgccttggccctccgccgggggacgcacgcagccgttgacgcgtttcttccttggcatctgacaaaaaaaagaggggtctgaggggcgaaatagataatgaggagcgaaatagataatgaggagagagatctaaaggtgggccctatcgactttttaataaaagaattattgactagactaccacgtaggatcaaaaccgcttacaaagctacccgtggtggtttttcatctagtattgatagttaagggtaaaagatgtctggattttaggtctagagaggtaagtcgtactcacccaaaagttcaggggtgtaattcaaacttttccttttttttcttaggtagtattgtgttttatttgtaaatttcatttgaagtgaaatatcaataaatatagggtaatttttatacttggggaaaaatggaagccaaacagaccggaagaaaaaaaatacataaaaaaaaataaaagctgagccgacgggaagtggaaaaaaggaaagcagaagaaatctctcgtttattccaatcttctcagtctctctattccccacgcttgcactgtgaaaggccttatccttttcccttttagggccctttgaatcgtatgaatgaaaaaacacaggaatagaaaaaacacaggattctgacatgaatacaattataaaacaga

SEQ ID NO: 25773 - DNA, 1501 bp, Oryza sativa
attttttaggggcggagggagtacaaagtagacgttcataacatgcacacagtcactgctatgaacacatagactggaccgacatatctcgagactaacaaagtcacaacagatgcctcactatctaccactgaaagaataataatcgtaaatacgagtatatgtataaaatctagagcttaaacctggatgaaccgattccacaataagaaacctaaccagttgagctacgtccacttccaagcagtatactaccacttgtgaaaccatgttttttatagattcgagttttttttcttttttctttactatcctacaaacatttttagtatgggacaattgcttatttgactccgtttcgatgcctataccaatctgacccttctttcaatctgacccttctttttgtactttgcgtttttgaccctgcttttctaaaacgaacctaccgtctgaccctgtttccatttcatcgttatggtttgaattaaaaataataaagaaatacaattattattcgtaaagaccaaaataccctcgagaaaaccctatccctgtctaaccctatcagaatagttccgtactcccgtttctctctccctctctctctcgtaccagcggcggcggcgcatggaggagaacaaggtgcaccggcatgtggaaggaggggccgtcgcggggggcgcgaagggagtggatccggcgccagtggcggctcgtggagggagcggcgacggtggtagggcccggattgaggggatctgcgccagcgctggctcgtggaggtagggtggcggcggtagggcttggagggagggagagtggggccgaggctcgggttcgtgaggcggcgggggagggagggtcgacgacgtcttagtgacgaggaggaggagcggcagtggcaggcccgggcggagctcgggctgcgaccggtggatccggtgaaggaggggcgacggcggttcagcgacgacaaggagcggtggcgatgggcccgtcggtggagatcgagctaggacggctggatccggcggggaaggggcgatgacagctcagcgacgatgaggaggaactgcggcggtgggctcggcggtagagctcgagctaggaccactggatctgatggggaaggggcgacaatgtaacgccccgattttcgttcgggtttaaaaatcattaaataatgcatttcctagaatataaataaaaaaagttaagcaatttaatcaagtgaattattgggagaattaaaattttcccttaaaaatcattggccgggaatattttgtaatattctttgtgccctaatgtactctccggaattttccgtgaattttcggagctcgagaaatagttttaatagcacaaagatcattgcatcaattaaaataaaaagaaaacaaataaaatttcccctctttgtctttgggccgctttcggctcaagatcttctccctctccatcctctcgggcccggccgccctccttttcccctact

SEQ ID NO: 25774 - DNA, 159 bp, Oryza sativa
ctagatgatcgcggttattgattattatattaattataaatcgcgctataacttcttccctgttacaggcaaatatttgttacactttgcctctatttttctgttagtcataaattatgagtaagaaacttttaaaatccagcataattgtcagtacta

SEQ ID NO: 25775 - DNA, 219 bp, Oryza sativa
ccacaattgaagaaaaagaaaaaaacactttcacaagaatatcacctacaccaatcatccataaactattattaaacttactattttaattaaatctttgaggaaaatcagcttttctgttgcttttataaaaagaaataatataactgtttcaaagtatattgatttttgttataaatgtaccattttcaaatcaatattaacacaaaggagtgttta

SEQ ID NO: 25776 - DNA, 257 bp, Oryza sativa
tttagtccattgcccggctattttttaccatctattcttttttttattttatgatttcaaaatgctttattaagaataaaatcgattaattcatctataaaaattaattgagtattgtagcactaacttattcaactggtatggcttttacaaaaatttaaaaatactaggacttatcactctcttatcactctgttattgacatgttgtatgctactatataatacatgtttttaacataactctgatcgttatta

SEQ ID NO: 25777 - DNA, 1501 bp, Oryza sativa
agtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggact

SEQ ID NO: 25778 - DNA, 1501 bp, Oryza sativa
gcggatccgaagagataaactttttatctactactaccgttttataatataagtcattctagcattttccacattcatattcatgttaatgaatttagacatatatatctatctagatttattaatatcaatgtgaatataaaaaatgctagaatgacttacattgtgaaatggaggaagtagatagatacagaaaagaaaaaaaaagaaactaaatatactcgcttgtacattgaagcgctgctagatgttgctccgtagcgctcaatgtggggagcttcaccctgacgagtcgtgaagaagcagagaagattatggttggaacgccatctccatctccatctgcaccagttgctgtttcaaggcggtacagcttctggccagcggcgaagttgccaagcagctggtaggaggtcgcggagccatccatggtgaggcagagatcgtcggtgcacgccgcgagctccttttgtgtgcggtagatgaagttgagcgccgcggcgacctcctcctcgaagcgggagaaggggctcgtggtgtcgtcgtcgtcgtcgaggcgcagcttgcggagcttgcagaggccttccccgagctccatcatggcgccacggtggttctgtgtttgtgcacgatcatgtctaatcacgaattttacagaagtgtttactgattactatgcatagttaaatgtggaaataatgagacgatgaaaatatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgctgtgaggaggcggcggcggcagcggaggtcacgacgagaggaggatcggcgctgcgggtggtggagcggtggctgtgggcggagcaagaggccgcccgccggcaacagtatccgcggtgcggtgggcgtgcgctgctgcggcagtagccgggcggcgtgcagcgaagcggcggagcggcagggcgccagcgccggcgccataggaattcaacggagattgctctgcttttgtccggtgaacgaatcgcgcgcgtgtgatgtagtagcgtaggaggacgtgtggactcaaccagaggtgagccgttgagacactcgtgcatgcagaaccaatcaatggagtgagtcaaagtgtcaaacccacaaaaatatctaactacaggcccaataagcaacagcccatctggcctagccagttttcccagcgtttcgggtttggaataagtctattctaaaccctcctgtcgggcaatttaattgacgtccctaaaccacggaacccgaaatctttctccctaaactatacgaaaccatttgaatcaaat

SEQ ID NO: 25779 - DNA, 1501 bp, Oryza sativa
tggaatgatttatgattctgagacagggagaggctatttagggctggagccgctcgatcgcgaggcgcagcatcaaggagtcgaccggaggttagggatgaaggctcatcttttatgggccttaccggtagatggccgtacggcccatatacaggcccataaatcagcccatatcgattttgactgctagtagtagtatttatttgagaggatataagaatcgtattctttttcttcaatacgaatcggtttcggatttgttgccgcaaaaatcaaaataaaacccgggtggaggaggagggagaagatgaagcaaacgagagagatcgagcttgaggccgggtggaatcgcgaggggatgtcatggcgaagcggcgggcagagtccgagcttgagctggtggaggcggaagcggaagcggaggcggaggcggaggcggagaagaatgggaggcgagcagcaggtagtcaggacggggtgaatcgcgcgttcatcctcgagtgcagcaaacatagcgatggatcgatctacagcggcgacgatttttggcacagattttacaaggtcgccgatacccgagagagtaagttttaacttttaacttcttgcaaaccctagctttttcccctctccaccatgcatcacctaccatcctctcatctccttaattagttccttttcaattttaactttgcatcatctacaatcctctcatctgcccttaattagttccctttcaatttagcttcacttggtagcacctcagatcgatgctatttaattcatgctcttttaacttcaattttatactatattgctgtgtcacctaatttgttccccaggaggcgggcagcctcttgggtgcaatcaaagaagaggtcgcaatctggaaggaagcaggagtctttaaagaatagagatgcaatcccttttattttggttttgggagggcgctccggcatactccattcagtttcgacatcttcttgttggaattctaaacttgtaaatttgtacatcgtaaggaaatttggactgaggggtctttggtcagcacggcaaaataataataataataataaaatctaatttgttcttgtgtatgctcagtactatggaactgatgtcaaattaaaccctttttttcataacatatctgtctagcttgatgtcaaatttagacctttcataacataatctagttctaagtaacactagatattccttaagtactacttcaaaaaactcttaaaggcaccatctaggatatggtatatcttgctttgggtccatgatagtgtggagtttgctgttttaaaccttattcgtatctatttgtttctttcctgctcatttcaatattggggttaacaatctaacttctaatcatccactgatgtgtatggctgttcagctcgtatggaggcaatgatgctgtcaaacccaaccaattgccggccacacatgtgggcttgcaaggcgcacagtgtgcaattcatga

SEQ ID NO: 25780 - DNA, 1501 bp, Oryza sativa
atggtgcaccaggtcaccggcgccgacgacctccctccccctcctccatcgctctctctacagcagacgacggagctcctcctcccggccgtgcacgccgctccagcgggctcgcccggcgctgcaggcgcgctgatgcttcccacgctcgacacctcggcgttcctgctcggccgccgcgcggagccggcggccgcggcgccgccgtgcgacgagtcggtggcgttggtaagaggaggagcgggtaattacggcagcaacaacaatagcattagcagcagtagcagcagcggcaactgtggtggtggcttccccaccttggactcatgggatctcctgtaaatctagatcatatattgtcgatttctatcgatttctgattcttcatggctgtaattaactaagacgagatcaatgaacaggttggagcatctatctacctgattctctgttcgtgtccttgttaattttaagcttatgcctcgtatacacatggatgattttttttatcagtagtgttattttattgatcttacttaatttagagttccttttcttttaattattaagtgcgactgttaagttcgttttgatcttccttctgctgattccagcatcactgcatcagcctcaaggttcttaatttatgcaggatttttgttcttgtgaaactcttttgctttgtttgattagttggctcttgcttttctattgattttgagtctttgatgaatcctccttccaacagtagagctgctccagcaccatctcactgaacatgtggtttctgatcatttggtgaacaaaatgtaacaaaagatgtttttttatattagtacattttagagaggtgcttagtgcattaattcagctttagctatataattaattaattaatgcaccaaaccactgtggggggcagtagcatgtaaatgctgcttagacagtaagatacgttaggatgaagctaacagttcaattggagcagagcagggttgagaatcagtacttggaaaagattgattgtgagatacaacaataataatatcgtaatcatcgagccaggtttttttagaaaaataaagtattgcaatcatatatgcacacgcatactaagactgagtttagatccaaaagtttttcttcaaacttctaacttttttatcacatcaaaacttttttacatggctgtgtttagtttctgaaatcggggagaagtttggggaaagttggtagtttggaaaaaaaattttgagagtttatgtgtaggaaagttttggatgtgatggaaagttgaaagtttaggggaagtttggtgtgaactaaacaggaccatacataaattttcaacttttctgtcacatcgttcaaatttcaaccaaactttcaattttgacgtgaactaaacacaacttaaggttcagcggaagagtaactttttttaaaaaaacctaaggcggaactttgttccacttttatatttagaagaagataattgacc

SEQ ID NO: 25781 - DNA, 1501 bp, Oryza sativa
ataagcatatggtatgggtccacaagtatcgaattgaattgccagtgatagagattcgccgtttagtagaagatgatgtttggtttcttcatattgtttcccaagagggtgatgtcttggttgatggatcttattggcagtttcactacgacatgaagggtaatttgctggagaaatttcaatgtagtggccgcatgctgaacattactccacatattctccaagaaagtctcgttccacacgaagtgttccaaattctagataatgaaagtagacatgcaccacatttcttcagggggttgtagagcatactttctgtactgtgaggctatttcacacttttgggcgtctattcattggatactgcaattttagcgatggaacttaattttgtagtgaatggtcaatgatctgttgttgcaaagggcagcattcactctgatcagtatttctgtacctccacatgttcatctttaacatcgagggtatcatttcagtactgtacgtgggaaatttaaatgcctgagactgttttttcctggtttgtggaagtctgagactgaacagttgattatgctcgttgtttatttcaacatcgcaagatggttacttccttcgtttcacaatgtaagccattctagcatttctcacattcatattgatgttaataaatctaaatagatatatatgtctagattcattaacatcagtatgaaagtgaaaaatactaaaatgacttgcattgtgaaacggagggagtactttttattggcttcttgcaacttaattttgccactctggtattgaaaggtcattgtctacttgtgttggtgatgcgtatgtctgatgagatccttagtgccatttattttgagtttgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctgg

SEQ ID NO: 25782 - DNA, 1501 bp, Oryza sativa
tgtgccacttaaaagtcatagggaagtaaatgagaggatcctcttccgcctttaagggacctattaactctccgtgaaaaagagaaaaaaaactgtatacagcaagcagatcctcttcacacatcacacctaagaaaactcaaacttgcaaagcagatcaattggcagtgagaaatgagcagatcacttggttaagaatttggcaattctctgtacgaacaaattaaatcagagatgatatttcaaggaactccagttaaacgcgtctagctagctagctaggagtagtttacacactttagcctcccggtcccgggcagacatgcacggtacatatagtgtttgatcgtcatctttcggggtttcgaaagcagaaacttgcatcttcaagagccttcatgggtacaaaagtcgaccacatcatgattcttattgcactagagggcccaacacaacaattaagagaactttcccgtatgtattccagattgcagtatatatatatttcagattattacaggtgaagtgaagttatgttagacaagctgcatgtccatgtccatctcgttgtcggagacctcatcctctacgtcgacatagcccttggcctcgaagagggagcggataagctcctggttcttgcgcatcctgatggcgctctccctcagcaaccggttggctcggagcagcacctccttctgccacacatcatcctcgtcgtcgtcaggcataggcatcaccacctcctcgctgagggtcggcacggccagcttcaacgacagcagcctctccacctcctccttccccagcctcctcaccaccttcttcctcttcttcccgtcctccttctcgcgcggccgatacgccagcaacacctcctcatgatcatcctctgtcgtcgtcgtcttcttcttcttcgccgccgacaccagctcgaaatggggccgccgcttctccccatcggcgcaccccctcatcatcgccatataaaatcaaaggtatttttgattattattctgtgatgaacaattagacattggagattattggttttgttatttggaatttattcacgaagtggttttggagatgattggattcacaggtaatcgcaggattttattatttcatgtgaccggtcagaccgggctgtgtatgccggtcagaccggcggtgatcgagcggtcggaccggccagcccacggtctgaccggccgacactgtgtcggtttcggtttcgggttgtttgtttggatatccgtgattatttcatgattatgacttctcgatgaatactatacgtatgtaatactgttgtctgctactaatgagtcaagttggagataacttggtctcagaatatggtttttttatttatttcatgtgtaggtgactcgatgcctcgggagagtatttgcggtgattgatagggagtcggcttggagataagacgacgtccgtggtgatcagagatcatgcgggatacttaggctagagttga

SEQ ID NO: 25783 - DNA, 1501 bp, Oryza sativa
taacctgcactatttgcatatatattgctgatgtcaaataggtgggcatacaccatggtaatcctctgttatttgttaaattcttagtcctaacaggattagaaatatgatgtgtggttaatgctgaagttagcaacctatcgataagttgagctctggcattcattattgtagggcaaaacacatcagacttttacagttttaacaagaaaaacaaggtattttgtttactactgataaatcaataaagccccttgatttggtatcaggtttcatatgctgagattctttctggaggaattctgaggctacaagtttctgaagctgaggttaataatatcaatattcgctttctggatagaagaacgtgagaaccatagcctgatttattgagattcgcttcacttgttactgttttatttctatgcgatattctgatctttcttatcttccacctctttctatttctctccatcaccagtggtgaaccaactgttgggaagacgcaaccagagacaatactccgtcaccttaccaccaagaagggtcaggtcagatcattgaaatcacttttctccatttgtgtttacctactttaggaacactattccactacaatgatatttacaaatttcacatcagttgtgttctcaatgtagaagttttcttgtgatatgattttaagaactagttccatttcatacctactttaaaagcactatgtcactgttgatgatattcacaaatattcatatcagttatatctagaacatacgagttttcatgagatatgacttcaagaaccatttccatttcatactgaactgtgcactaggcattgaagcattgctttggtgtgcttctgaaattgcaatgcaaatgccataattacaaaacttaatttttataccgatgttagagtgtactcattaaattctttgaacatttatgtataatatttgcctatacatataattttgcacaaattctgtattctgcaaaaaaaaggaaagaaagaaagaaaggggtagtcatgcaatctgaagcagaagtattttgctaatgaaaatacagactaattctctgataagagtgatactgtattatctgtctaaacttgtgatgatgaaaataggcttacaatagagcacaagtgaaaagggatgttgaaacaatccttactatgggaatcatggaggatgttactataattccacagccagttggaggtaatgttaatttgttagttcagtctgtttcggaaagctggtatttgcacttattagcacatgttttcttacttatgatcttctgcagattctaataaagttgatcttgtcatgaatcttgttgaacgaccttcgggtggtttttctgctggtggtggcatttcaagtgggtgagtacaaggcttgctgagcgaacttaattgaatgaaatatcaaatctttgctttcataaaaataatttccttatccataaggttctgataatgttaaac

SEQ ID NO: 25784 - DNA, 1501 bp, Oryza sativa
aaactaatgaagagctattttttcacgaataatatagcatttttttaaaaaatataataagaattacggagcgatttcagcctaaacaaataagagctatttttttcacaaattatatagcatttttttaaaaatataataaggattacggagctaggtatagggtttcaaccctagttgctccatgtttgttttccgccccagtgcgcagataattgttacctagctctacatattttgtttaaatagcatagagtatagagcagatgatggacacaagtcgtctgcagtactgcaggctgacatgtgggcccacagccctcgggcccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacctagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccaga

SEQ ID NO: 25785 - DNA, 861 bp, Oryza sativa
atatataaagctcaactagtcaagttataatatcccaaggtatcaaggaataaagtaatcaagaacaaaagggctataacaaacaataggttaactccacccaatgacattcgaaaataaatgcaaggccaatggtgaggaccatgattatgctcaaggaggaacggacatctagcatactcgggatgccatgtgataatgttggactagagcttaggtacttgagattcaacttcggtcaacactggaatcaagactatacttagggaggaggtgaggtcgagacagtcaaagataccgggtgatgaatttggaaacaaagtcacaaacggttggtgacgaaataactttgtaattgtcagtatatttcatcaacatacaaatgaactaggatttctactcctactttgagtaggaggtattgggtataaatagatgaaggattgaggctcgaaataatatagccgtaggtgactcttagagataaaagttagggtttgttttgaggctacaattctagttcatgagttgagagatgagtgctttggttgcattttgtaaacacaatttgatgcaataaagttaatctatcttcaatagtatcttcaatttgtgttttttttggatacgatagtttgaccgcagttcattgggcgattagactggcgggcaggttgactggcgacaaagagttctgaccgacttactccataaggattgaaggttctttttgttttgcaaaaaaaaaaattatgcttttgatgttcctatcattcacctcccatctggtttcttgtattcgatcctacgctgccctcggccccaaggtcaccaatggccacctctctgcctccctcgaga

SEQ ID NO: 25786 - DNA, 1501 bp, Oryza sativa
caaacaatctactattcaagagtgaccttagaatcccatgcaaccaaaagcattgaactcgattccagtacagaactaacaaaataaatgctcaatggagacatttgtgtttgttgtatgagcaaatgcatccaagaggatccaatcatggggagtgaaatccaaatgattcgaccttaattggtttgattttcagaatttcatccagtaaccatgatggatctcacacaccaatcaatcatatcatatatggagatcaaacactggaaatatcatacctgaaactgttgaagcactactcatctaagaatgagatcaacataaagtgaaatcacacctcagaagctggaatctaaaaccctttcacattgaatctcaggttgcttttaagttacaataaccaataacatgtcgaagctcagacattcaggaaggtaattgaatctccatagtgcataaaattatggatcttccacatgttatgcaactgacaaaatcacacaattgtgcaggccatataaaatgatacacaacaaatagcttcgtatctagtctcgcagatccttccatcggcttcttgagtcacaatgcgatattgtcagtcagagaggatttatccaataatgccgctcatctgcctgaaggcagagggcacggcaaagctaaatcaaactatacacctaaactgaaaatttcagtgacagctaaatgaaagtttttgtggcttctttccacagacacttttcttgcttgatgaggttatagctagaccagactacagtcttttcaggattacaataagaagcgaactctaattgccagcacagttatgctctttatgcagctcctaaatgctgcatcaatcatgtagactccacagcagctggtgctgccactgcaagcttcttgctacttgagctcttgtcatcagtcttcttgccaccttcggtggccttgccagatgctggtttcgaccctgaggtagaatcaggctcgtcatcctcgacaacaagctgtacaggacgcttgcggccacggtgcatatggcgttcgcaatatttctcatttgcaattgcatttctccagcaccgccacttctttccatcagttcgccggcacctcccaggttctggttctgggttctttccaaagtccaagcagagtgttgccaaccccatcactgctcaattcagcattgtaaatcaattagaaatgcctcaaataactctaaacagcacatggaagaatttgaatcttatatgcatctaacatgacgttgtaaaggtctgcttcaataagttctttaataccttaatattactgcatgtataaaattaaatttctgctgtaaaatcacgggcttgaaattacattaaaaactcgccctaaaaactgcacatagctagcatatttactgagaaatgcatggttgaacatacaaaaaaaaatgtatctgagtttttgcaaaaggaacatagattattgtacaagttagaagagc

SEQ ID NO: 25787 - DNA, 1501 bp, Oryza sativa
gttatcacaggtgaaacatgattttcaaaatcagctttaaacactcttccatagcgagaaatattcaatatagaatcaccacaagaatcaaaaactttacttgcagttttcttaaagtgaatctcaaaattttcatcaacaatttgtgaaactgaaagcaaattgtactttaagtcctcaaccaaagctacattcttcaattcaaatttttcatttaccttaacaaaacatgtagcaagaacggcacttgtagaagcatcaccaaagataatcgattcagtcttggatgcctttttgagtgaggagaaccaatttttatcaccggtcatgtgccgcgaacaaccggaatccacgatccacacattctccttccttgccaccaaagcctcattatcttcatactctatgtcagattcaccacgcgccatgaagcaaacatcggtgatgttctttcccttatcatcatctccactttcaccatctacatcacttagtggctcgaaggcggcgcaaacttgttgaaaagccttcctgagattgtctagcttccttccttgggatgaaccctttggcttgttattgttggtcttctcaccatctttgtcttctcttttgcctcttctaagcttagaacaatgtgaacgaagatgatcaattgaaccacattcaaagtaacgatttggaccacctcttttcctgttcctggcattattcatagctcgagcaattctgttagcaaccaaagccaaatcctcctcctcgatctgttcgagttgatcatcggatgtggcattaaaaacaacaagaaaagaaggcttagatgaagaagcatcaacatccaaagaagaagaagaagaaaccaaagcactcgacttagaatcaacttttcgagaaagaacattcatctcatgtgttttcaattttgtataaagtgaatccaaagtcaaagtagacatgttaaaacagactcctgaatagatgtacctttcatctcccaaatagacatatcaagaccattcaaaaagtgacgagaaatcttagattgtggataattagtatcataaaaagaatcaacagatctagtatcactcaaaattttattaaacctagaaagatagtcatccaaagcttctacaggtttcatctcaaatttaatgtactcctttttgaaaatatcacatcgaagttctttaatgttatttgttccttgatgaaagttactcaaagcattccaaatttcatgagcagttcgaaagtgcgcaacacaatcataatcagaacgagaaataccactcaaaagaatgttgcgagctttgcaattttgttcaaaagcagttttttcagcagcagtattaatagcttcagcaatcacataaagatgagaaacttttctccaaatatcataatcttcagccataatgtaagaatgcatcctactacaccaatgagaaaaatccgttccatcgaaaacatgaggcttagttgaaaacctagcaagagt

SEQ ID NO: 25788 - DNA, 1501 bp, Oryza sativa
tggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagtggctaagctcaacaagagcttggagaggtgcttcaagggtaagaacactcttgacaagattttgagtgagcaacggtgcatccttaacaaggagggacttggattcattccaaagaagggtaagaaaccttctaaccgtgccactcgttttgtcaagagcaatggtaagtattgctccaagtgtcgtgaggttgggcatttggtgaatgattgccccggtggtaagcctcctaagacatgcatgtttgattctcattatatgattaggaaggctcatgatggtagcattgttgctagatatgtgggttcccctatactcggtggtaaaaagaatgccatttgggtgcccaaagctttggtctctaaccttcaaggacccaaacaagtttgggtacctaaaagagcttgatcttcttttgtaggtgaactaccacaccggtgggagccattgggtgcttgatagtggatgcactcaacaca

SEQ ID NO: 25789 - DNA, 1501 bp, Oryza sativa
cctcactattttttagaagatatatgtttttgctatcgagaagcacataattaattactcaatataagtcagttatcggagataccatcctatatacaattttatcctactttatcatcaccgttacatttatattccaaccactaagagcgcagaagcagcattccccgtgctggcaccgccgtgtggattccctgcgccgaccacaccggccgtccgccagcagttgtgccgtcagcaggaggcgccaccctcgtatggctagaatgcgtttgagctgtcccacttgcctaatttgcttcatgagaaacaagataaatcactaacaactaatgaatgattatttctttaacacttaaaaaatagatttgttttattatatttaaaaacttttttatatataacatttttcacaaaaataaatcatttaacatttaacaatttagaaaacgtggttaggatgaagttaatgaatcaaactcgccagccaacatattacgggaatcctccgaatcggtgttagtatttcttaacgatattattagaaatataattcccagcaatggtgcagaaacacttctagtatattatggttataccattgtagcatttcacccgagagtattctaagggtgtcgtatttattttattccgtgggaaaatcatgtagagagaactcaactaataatttatatattacttgtgataatcatattctaagcaggggttaagataatccaagggtagagtgacacacaagcatttctgctcatcctcataataaataatctaagctaggtggaaagaaaagagaaaagaaatctattcctatacttctaatatacatagtatacatccattctagttaactgatatactagctaacaccctctattcgatgccctcctggtacttcgaaaagccacccctgactgccgagttccttacgacagcccatcatgaccatccaaccggggctaaatacggaggaaaaccctccctaggaaattaacttaggattatatataggcgcggaggaatacccgtattgagctgtcaccatcagcggcccacctctcatccgcaatatataaccccaaataatgatatatcgtaatctagacaccacgtctaaactactaggtactactctaatatcatcgtcatgacatagagtaattgcataagcaaacactatacccgcaccaaagcatctcccagataagctagccgtatattcagtataacatgaacgtaatgtaaagtaggtactcatatactcggaaagtatttcaataccataaatgtatatagaagagtattctaataaaagtacaaagcttacaaaagaggaaaggaaagctgctagggccatacccgaactcttccgaaggtttccggactcctgactcccattctatttctattctaccagctagatactactaaactaaacttgagaggaatgagagagctattgcttgaggtgtgtgttgaagtg

SEQ ID NO: 25790 - DNA, 1501 bp, Oryza sativa
taaataagcgcggtggtaaattgaatagatataaaataattcagatttcacattaataaactagtatgatttggatatcatgtatactagtagcaaactgtaggcttatatacaagtgtgcaaccaatgaacggctttgcggttcacagcatgcagtcctagcttgcaggataatacaacatctaatatatagcatgtgctgccaaacatgtggctgcgaattaataataagccgtatacaaaaatattcctctcaaataacatcagagagatctcaaatgaggaaaagatgtgaagtatacatgttgtactgtcatgctcccgtacgtattggcctcctcgcactttcttgaagtgactatagtactgttgttgatatgtccatatatgctttcacttttgaggtcgacaatgaatcggcctgtttgaaatgtgaaaaaagattttcattcatatatatatatatatatactatgagttaaactttttctcatatagctcctaccaatatataagacattattaactgtttacacggtttacaatgcaacattatactttgacaatattttttctaaatatatttttttaaaaagaaaattaacgtcatataggtacttctaaatacaaatctagttataacatatgactttaattattagacaaatgttataaataataatttttctaaaagatagtaatgtcttatattttgagatggaaaagagggacattcttgtaaaaaaaattgcattccatgtccgagactactagagattgggtgttgtttatcattcaatattctttagtggcttgaccttgtagccttggaagtaaccagactaagcgtaatttatcatccaatattctctagtcaagttttttttttcaacgataggcctgcaagcttatttcacctttgtagtataatttaaagcgatttgtattctaaaattttatttttagatataatttcaggggagtttttttaaaaaaaatttatcttctcaacaatcatgaaaagagagccaagcaatggaaatgacgaagaaattaaaaaaaaccctcgaataaagttctaaattaaatattcaagaagccacagtacgttttgattattggctaggcctaatcatgctgaagccgttgcagccgttcgtgtgagggcacatgtatctctgaaaatgctgtgcatggattcttccatcaaccgggagatgcctatacaaaaatttcgctgtcatcacagcgactcttgacagatcatacatactgttgcaaacttttctatagattttgcgtgctgttctgttgtcttctaatatgtgctagtgatactgactaatatatatgtgcctcaccgattaaaaataaataaataaaacaattaacaaaaataacttatcagtaaaaattatatgtattcttgatgatttaaaagacaacgctaaaatatacttatatgatgaaaaacttaaaatcgtctctaaaattaaagagt

SEQ ID NO: 25791 - DNA, 699 bp, Oryza sativa
aatcaattcacaaaaaatctacgaatcaactccacagccaccgcctggctgcctcccctcccgaatcccgcggaggggaggccgccgccgccctcgcgcccctcgggccgccccggcgccaccgccgccaccgcacggccgcctcccctcccggatccggcggaggggaggccactgctgccctcgcgcccctcatgtcgtccccacgacaccgccgccgccgcccgccagaagggagccggaggggaagaggggagcggagtggaggaggggaggggatgggaggaggccggaggagaagagaggaggagaggggaggaggagatgagggtgagtgaatgacgggaggtgtcacgcccagaaatttagcccaaatttccagactattttgtgtattaaatccctgtccaggaatcagccagggtacacaaaagacaagtaataaacagttccaaacgtaaataaagagtaaatacttacagaagaggctcttagtcctcacaccgaaaagaaagcagcagcagcggaaaaaggcgatcctagcggggcttcagctccactcctcaggcaaaacacaactggggtttgagccttggtcttctaacttcgtcttcagctcagaagcactacacttctgaaaaggggaaaataatagcaaaactgagtacaaccaccgtactcagcaagccacaccaatga

SEQ ID NO: 25792 - DNA, 1501 bp, Oryza sativa
taactgcatgttttcttagccaccccacaaaaatgcatgtttcgttgcactcacataaatcacatggatcatttgatacataagtttttacagtctgtttgtttctatttttgcatttatttgctttatggtttcttaaaaaacaatcttcaaggctcaagctcatttgacctgttaatatgggcacacactttgatgctagagtagttcctttggaccttcttgcaattctactataattctccatgcaaatttagctatatatcttcgagtaattcgatctttcacccactgtagtctgtacctcatttttgttcgtattcaacttcagggatttatcattcaactctttcagtggtgacttgccaacgtcgtttagctcattgaagaaccttcatcacctgtaagaatgatgtgcgttcttaacgatttcatgcacaaaaatatgctagaatataaaaggttcattttgttttggttttacagttatttacagcataatgagttcacaggatctgttattttgttggcagaccttccattatcatccctgtaagaaattcaactgtattttatccttctctatatttgtttattctcatccttcctgacaattatcaactggttgcagcaacattgaaaacaatagcttcagtggttatgtgccaggaacttttgagtccattcctgagttgaggtattcggttctgcttaataacccacgtttctttccgtaggatatttatgcatacatgttgccttgacttcatatctagttgaaataagtggctaatctaacattccaggattgatgggaaccagtttcaaccaggtttcaaacgtgcatctccctcatttaccaggagtgctcattcaccaccaactccacatccacctccatcttcacctccaccacctatgtccccacctccaccagcagttaaggaaaatttgaaacacaagcccgaacctttgaagccttccttaagccattcttctatgtacaaccataatcagcacaggaagtcacactctcgagtgacagctgctgcaatagctactgttactggtacagcttttgtgctcctcattgttggcttggttctgaaaagctgcacatacagtcctaagagcaccgctaacaatgccaaatctccacctgccaatgtggaaaaaggtagcactggaactttattagtttaagcataaccggcttatgcaattgtagttgatggctagacatattctatatattcttgttcatcacttaatattcatccttatgttaggatctgtatgtaatatccaatcatgtatatatatacttgttctccattcctgcatgttgcattattggatagacttacattctttcatatcactgaaattcatacatatcattttacagtccctaaagcaaatgaggtcttgtactcttggaattctcttatgaatgactgtgaggcttcctctagtgacgtcattaagcctgaaagagcta

SEQ ID NO: 25793 - DNA, 1501 bp, Oryza sativa
cctgcccggtcagaccggctacatagtggcggtctgaccggcggcactttcccggtcagaccggccccctagaggccgagatggtgctgctcgggatggccgatacagagccgatggagccgtattcggtcagactgagccgaggccggtctgaccggccaccccatgccggtctgaccggccaggccgatggggccctctgacagggctacaacggctagttttctagccgttgcaaagtagcacggtctgatcggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagagttgtttagccaagagtcaagtgcatttgtttccattgtagagctagtgtggcacttaatcatctccacaccgggtcattgcttgttactcttggaggttgccgcctcctagacggcttgtggaggagttgcccagtgacctctacgagaagattatggaggaggcccggcgccggtttgtgagtggtttggagttcaccaccttcggagtgaaggaagaactaccccgagtgattgaggcttgggtagtcctctccgtgggccggctcccaccttgcccaccccttgacgaagggggcgtgcggtggcttcgtggttgagcggtggagttgggctcgcctcaacggggagtaggaaaccggcgagtttctgaacctcggtgaaaaatctcttgtctcattgtctcatttgattgtcgcatttacatttgtgcaatttacatttctagagacacacttgagatcatatcaccctaggattgcaaaacattgacatatgagcgtgatttactttcctagagatataattgagccactatcaccctaggtttgcaaaacataacttagttgcttagttagagttcaccctcaccaagcccagcaaattaggttagatttgattaggtgttatttagttttaaatcgcctattcacccccccctctagtcgacatctcaatcctacagtgttccaaactactaaacggtaccatttgcaaaaaaattttataagaaacttcttttaaaaatcatattaatctaatttttcatacacaatcaatcatacactaatagtatatatatctcgttttacgtatcttctcgatcttctttttcccactcctatcaaacttagccttagggcctctttgattcgtatgaaaaatcatagaaatcttctaggattcaaatcctataggaaaatttcctatgaaagcattgtaaaatcaaaggtgtttttaattattattctgtgatgaacaattgggcattgaagattattggttttgttatttggaatttatttacgaagtggttttggagaa

SEQ ID NO: 25794 - DNA, 330 bp, Oryza sativa
gttggaacggcgctggtacttctcaaagaccacgtgcttgatctgacggggcagccaagcatgctactgcagttgtcgtccaatgcttgaatctttctgccatagtcagctttgtaacagcagaccacttttgttggtcgcgttggttgctgccactcaaagagcaccgcagtgcccgggtgactggttttcagtcccgagcttcgctccccagaggatgggatgtagatcgtgctagagcctagaggaggtggctggcgccgcagtgcagctgtgtttgctcaccagaggaggaactgtaagggaacaagaggaagtcggttctggaga

SEQ ID NO: 25795 - DNA, 236 bp, Oryza sativa
gcatatggtattttcttgtgcatgctaacaaaactttgaaggtttatttgtctctagcatagcttgtatgtattctagtcttttcatgagatttatattttacttttaagggagatgatacatgacacttaaattctacttgaattaagtaaatatgcaatgttgatgctatcatatggtttgatttataaatgctctatatatatgctttattgaattgttattcctcaaatagc

SEQ ID NO: 25796 - DNA, 621 bp, Oryza sativa
actatagggcgaattcgagctcggtacccctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagt

SEQ ID NO: 25797 - DNA, 317 bp, Oryza sativa
taccgttagattagatctatactgccgtcaggggtggagcaaaaaaaaaaagacgtcggggtcattaccgattaaaaaaaccgtgaaagctgcttggttttcgtcaatccagtagttttagaacttttttttattacggagttattatgaaaaaaaaatcgatagtttttttttcttctagaaactcatccaatgggattgcaaaccagccagctaatcacaaagattttaattagtgtatgtgctcatacaagatgaccaggtggactgggtgcacattcaactacaccataggtaacgagaaatcacttagctga

SEQ ID NO: 25798 - DNA, 1501 bp, Oryza sativa
aaaggtggagcagctgctgtcgttcgtgccgaggacgtttcctcgagatcgaaagccacgatccgatgaccccgagatcaaccagttcgaggacatatatactcgccaacaccgtgctgctcctcaactccaacacccaaatcatcctccaggaccaggccagggcccgcgaggagctccgcaccaagggctccgtcgactgctgggtcaccaaatacgccgccgccgacgacgacatgctggcctcaacagcctagctaggccctgctctgcgtgcctcaattcaagcatcagcatctctcctaactgtattaatataatgtagatgagcatgacattacgatgatatttgcttcttaattcggtggtgtggaaacagattttattactgattagtagcatctgtattatatctgtaaacagattttattacgacgacgacgaccaaaaatacgtactagtattacacttgccatagcccatatattgcggtgcgtccgatccgattaagagaccgaacgccgatccggccgggtgatgcaattggactcgatcgaatcctacttgttttgcctcgcccaggtaaagtgatgcatatataaatgcagaccagcatcgctagctcagctcgtgtccagcaattcacaaatcgattccaatacccaaccagctcgaaatcatatatacaggaaatcatcgtccgatgatgatgacgggtagagaactgcgctagggtctgcggtggtgcgccctacggcctgagttcgattcccagcgaacacactcactcctctcttaatgcatatcgatatgaaagccctttctttcatatccagcgttttttttacgatgatgacgggttgctcaaaggggagccatgagctaaagaggtgctgcaaggcgacgccgtcggaggagaaggaggctaagaggatgaaggagactcagacgatggtgccggaggaacaggtggagcatctgctatcgttcgtgaccatggagccgattcctcttccggtggtctctgcagactctgacggcaatcccaactcgttgcgcaacaggatggaccgactcctcatcagggccattaaccgtgtcaacaccaattctcaagtcatccgccagatgcaggccaacgcccgcgaggacctccggacaaagggctacgtccacgccttggtcgccgattaatttccccaatttcaactagctagtatcaacctaactatctaagcaaggctattttatttcaaattaatgaatgctttaattttttttaccttagttttttctctcctactatcatgtgatcgtaactagttgcagcagcctgtttactagattctttgcatgagtcttgtttcactagattagattagattcctggaaattccaattgtcgttggagcatgatttccatcatttaacatactagattgcttgagtcttgtttgatcgtttgatttcttgctggtgcctacaaatcctcctacgtctg

SEQ ID NO: 25799 - DNA, 772 bp, Oryza sativa
gtttggtttgtgacctaaataggccttaccaaattttgtcaatgccaaattttagcaagttttggcatgactaattttggtaaggtaaagttgtgtttggattgaagccaaaatagtctaagttcactattgaaatggcctatttttcttaggcatgccaaaatttgtcttcaaaccaaatagacgctaaacactattgaaattaccaaatattgttaagtctaatttaggcctgaaaccaaaccagcccatagtccttggtctcaccaaaatcgccacatggacatgccatgtcaccttcctatgcaaaatctatatgatttatccaatttacccttacgcataggaaaataaaaaacaaaaggaaaattttaaaaaaatatatagtatatgtaagagcaaaaatatacctcaaaagggtgaaaaaagaattatttttttcctatggttatgtctaattcaccattatatttatttttctatgatatatgtaagggtaaattggactgttcatcttagattttgtatgaatgatgacatggcatatccatatgatgattttggtggacccaatgactattctaggctttatgacaaaggttaagaatttctttggaccatttaaaaggttagggactaaactgatcctacagacaaactttagggactaaagtagctattctcccgaaaaaaaatgaaacaagaacagctactgcagacttacagtttcgccattgctgagctgacgatcccttcctgggctgggtttaca

SEQ ID NO: 25800 - DNA, 1501 bp, Oryza sativa
ctaatttaccctgcggtacttgcatgtaaatgtatatgtcctgtgactcatgtaactgaaaactgctctacagcactgcagcagactcccaagtggggcttcggtcgaatactatcgcagtatgccactacggctatagtatatttgctattcgtgcctggtatcgtcatgttgggggtgtaacatatggattagcagttttgtactaaatgtattgtattacaaattaataccaagtagatgaatcagctcgtatgcgatatggtttacactgctgcctaaacttattttgaatgtgcactgctattgaaatgaatcacccatgccattttgatatttgcttggttacaataatctttaagagcttgctccactgacctctcaaatgattcctattattttggctaatctcctttttgtggaaccaggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaaggtaagaaatgtcagatcagattttgcagtgtgttactgcatttactttgtaaaacaagaactgcaagataccaccagcatccattttatagtatccaatgttatttcagaacttcatacacaaagaagataccagttaaaggacttatcctggagatcaaaggtaagaaatagtttctatatttatttgcaatcttgaggattttaatatatgtgcatttcatcggtttggagtaaccaacggattattcttgtctgtgagcacagttagttataatgtttgttcttcttgctatgataagttgattagtaatggtattttacagtcaacaggatcttcaggaagacagatagtgaatgtgaaatatttgagtaggaacatttttttgatttccagtgtggcatcagtaataatgtacacatttgtgttgattaaaagtacaataattttgtactatacagttgacttgtccttttggccatatttcacaccttaaaaattgcttcttagatatctcactgttgccagtactttcaatcagttaagaatgcacatacttgacatagtttgcagcacagtatagaactgaattttcctctgaaacttagttggttgccccttttttttctgctgttactaagtttattatatggctcagaaccactgagtaattttatattactctgcaaatcttgtacacatgtgtttggtgcgtctgtttgttaatgctttcgcaaatcacaactgcattatggacataatgatacattagaaaaggctttttcaaatttcatattttttccttgatataaatgaatttaaagacaatagtagcacaataacctgataggtgtttgtgtaggatggatgccctttccttttctgccacaagactctgaatctgttctgtgacagg

SEQ ID NO: 25801 - DNA, 1013 bp, Oryza sativa
ggcgaattcgagctcggtaccctggagttaaatttaggagctgcagctctaccaaacgggccctaagtctggagtggagttgtggagctgcctaaacccagctacaactctctagttcattttgtgagaacgcttcacccagctccactaccatttcaagtggagctgaaactgtttggctggacctaggagaggtggagctggagctgtgctaaacagatccttactatctgtcgagcaatctttgtgtagttgctgcactgatggagaaaggaactttagtcccggttgtgcaaccgggacacatgatccgagactaaagatgtctaacagggactaaatatgcataccaagttaaaaaaatgtgtgggatgtgagatttaaactcaagatctctcacctcagccctcacgcacgttaccattccacctgctacacactaaagatcgattttttttttatcccgggactaaagatactccatctagcatcaacccggacttaaaaatcaatttttttcctggggctaaagatcatcttttagtctcggttgatatcaccaatcgggctttaaaaattgatctttagtctcgggtggtagatcgttgggggcctgacagctgttgaacctttctattcgaaccaagacaaatatgatcttttggcatccgagtaatgatcagttctccagtaatgtagtcttgcttcatggcagtaatgttttggactggaaaaatgtatgatcccaccatatcctatgtaaaaataaggtatcattgccacaatgcttaagacaagaatatatatgaagatgggttacacatctagatgtaaaattcctaatttaagattaggcccaccataccctataaccactctcaccatatctggtgttggtgtgcatgtgtggccttatgatccattttatggcacattatagatgctctcacccactgactctttaagtagtggatccactactttaaggcattagaggtcagggctaagggcaa

SEQ ID NO: 25802 - DNA, 1501 bp, Oryza sativa
attacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttttttcaaattcatcctgaaaagttttttttttccggatggagtacgttttaactttgcttgcgtagtacctatagtagatatttcggtttttgatttttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccacca

SEQ ID NO: 25803 - DNA, 1501 bp, Oryza sativa
actcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctccca

SEQ ID NO: 25804 - DNA, 838 bp, Oryza sativa
aaaagggagagaagaaatgagacacgatttactttttgatataattgaatcaatcgctaaatcaacggagtatccttgatttacttttttctctacagcgatactgatagctactacaatacaccgatcactggaaggatatattcaattcaaatgtattgcctatgttttactagttaattactcaaatgccatcatgctacaataattttgttccgtaccttgcccctctctgatcaacggtgcacattatttcaccttcaagtaccttgcaaacaccgtaaaagatctcttatcatttacatatgcagagtaatatctttcttaaagttggttctcattaagttccatgaagattattattgttaaaaatataataatttcttatgatccatatatgttccaagtaagaatggcaatagacttgaatgaagaagggttttccaaacttattttctgtatgtcaaatcatattaataaagctcacatttgtctgtcaatcactccaaacatattgctagcatcactgcatccctgtaggttggtagatcaccgtagaatccataggaggtgttctccattgcccttcaccgcgattcttacctcccttcaccaatcacaccactaccactcgattctggccgatgctcggcggatgttggtcaccacacctgtcccttggggcaggcgttcggttttcccagttttatctggtttgtcttttcagtttctttagagttcagttttcactagaaagaaaaagacaacgaggcaataaaaccaagaaaattcggttcagttttcagtagaatccgaagcaccgaagaaattgatagga

SEQ ID NO: 25805 - DNA, 1501 bp, Oryza sativa
cttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccga

SEQ ID NO: 25806 - DNA, 159 bp, Oryza sativa
  unsure (1)..(159): unsure at all n locations
acactatttttgttcaacttntgttttggatctgaaaagaaagaaaagtaagttgttttggcgacatcaaaagaatgatgttatatctanttgattcttagttctgaaggtacaagtgcctgtaaggactttttcctttactaatgtagtagttgtctg

SEQ ID NO: 25807 - DNA, 1157 bp, Oryza sativa
acgtgagctagccagtgacccagtgaagccaacacccattacttgtagacctgagcatatccacgtcgatttacttcaattcgcgtaacggatagatgatgctgagtgggaactgcaaactcttgtgtagacggcccacatacctgtccagaaagcttgagggcgcggttgaacgcggccaatgccatgtcctctgcggcctgcttgctggtgaactgcaagggcatctgaacaatgaagcattatcagtacaacagtatgtctgcacagaagataccagcttctgaacaatccaccgaattggctcacgcgctcaaagcgtgctcacaagatgggttcaaaacaagttcaaattcgggattactcggagggggagccgaggaattaccttgccgagcagctgcgccatggaggccatggagtagggcacgacgacctcgaggacggtgccggacgcgccgggcacggacagcagccacccgagcgcctgcggcgaatgcgcgctttgctttagtctaggcgccaaacagtactaccatatcggatcgaatctgccggcgaatcacggcgcggcggcgcgcaagtggggggcagcggcgaggcgaaggggggttacctgcgaggcgccgccggcgaggtagatgacggcctgggcgcgagatgagtggatagcctccaccaccgcgcggacccagctctccatcgcgcagccgcgagaagaagctaccagacgacggaggaatttgtccggttccctttacgcctctggccggctgaaccgtttgatcggtcttcccatcggacgattttgcccctgggcccactcgtcagatttaagagacagatagaggactccagaattcccagatcgatcgataaagcatttcccagcccgagcgggtcgcggcgacgagaagacgaaactgccccgtgcgccgccaacatctcccctctccggctaccgccgccaccgcgccgccgcgctcctcgctcctcgctccagggcttccggccatggccggcggcgacggtgaggaagcaaaccctaagcggcaccatccccggcaccggcgcccccccgttctgtcctatataccgcatctcccttacaccgttcccccctctcccctctgcaggcgatcgcgcccgcgcgccga

SEQ ID NO: 25808 - DNA, 204 bp, Oryza sativa
tactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcagg

SEQ ID NO: 25809 - DNA, 929 bp, Oryza sativa
  unsure (1)..(929): unsure at all n locations
ccatgtgcactgaatgcccncngttganaancaccttcgttacncattacacacatgcatatatgtgtgcactatatgtatatctatacatatatataatgcaattatacatatagtgcacacatatatgcatgtgtgtaatatatatatatatatatatatatatatatagacctagggtgcgtaatagctaaaatgctcctctcactttcccctctctctctccgctttttacggatctagcggcgcagcggaggcaaggaggagagcgatggctgcggcggtcgatggagcagttcaacagcggcggcgtgccccgcctactgccaagggtggcggcgtccaggcgacgggcggccgacttaatcaccaccctctcccgccgttgctcgaggtgtgttgcccggggttgtcgtcgggtcgtggccggatcggcatgtggttctttttggttagatatgtagtgcacccgttaccggtgtccgcatccattgtctgctggaggtccttgtatatgctcatcatcgttggatccattcgcttcttgggtttcttcgtgccggttcttgttttcttggtattgctttgctcatggaggttcatgttttgttgatgcattgtcatggtggtggatgctgcatctcagccttttgcatgattaatttcagattgtgctttcctttcttgtgcagtgctgctactagcatcttacaaggtcattaaactgtatgatggggggattggttcaattaagtatctcgttgattctcagagttattttctatatggaaaaaaatatgtttgctttcttttatggcaaagcaattcacaacagcaatattatggctatgaaatactaggtttaagtgaaatcatatttattttgctgatttgtgatacttagaagtaaccttcattttttttatcca

SEQ ID NO: 25810 - DNA, 224 bp, Oryza sativa
taatacccccaaaagttaaaattctatacattgattttgtggtgaacacccctttttcagtatgaggccaacagaccttgtcattctcagttcctagttgagcttccccaattaactctacaagctccctaacctctctaaccctttgttcatctaaatttcttctaaactccaagctccattctctgcctaccaccgtatccttgacagtagcattttgatca

SEQ ID NO: 25811 - DNA, 225 bp, Oryza sativa
aatatgatttgacatcaaaaaataagtttggaaaacccttcttcattcaggtctattgccattcttacttggaacatatatggatcataagaaattattatatttttaacaataataatcttcatggaacttaatgagaaccaactttaagaaagatattactctgcatatgtaaatgataagagatcttttacggtgtttgcaaggtacttgaaggtgaaataa

SEQ ID NO: 25812 - DNA, 1501 bp, Oryza sativa
tatcttaaaatcaactttaaaatgaagttcaaaattcaaatcttgacttttgctttggcgtattaggctaactgatggggctctgagtgaaggagaaagagtggaacttgaaataatggatcagaaccctttaatgttatattagcattgattgaaacacaaattttaggggccctagtttttggaggcctatgccatctctttaccttgcacttatctagatgtgggcctatttatatttttaaaaatctaactatatgaaggttttttgcataatataatctttatatatatggggacaaagtatatttgaaaccaaagatagcactagggcatcatctttttcatgatttattactacatacaccattgctaccttggtcaccatacgcataactgatttcaattaattgtatatttgtgttcatggtttttactttccaaaagtttttccacgctaaatttgtgcctcagttcttttggcatcatgtaataaagctatacttttctttctgtcatatggtacaaaacatgtcccagtatacttttacatggtgtttccactttccagttccttgtttctatcacactcactaggaccaaagaattcccctgttgacgcaatatcccacctgattcctccaaaatttccagaaaagacgcatactagtccatgcatggcacaacagaacactccacaatgcacaggtcatcacacgcaatatatatccacccgaacagaataaaccatggatatttaagcaacactaatgcagccattgctttgatcaaagcaactgccaaagcaaacccaataaaaagaagaagaaaaaagaacacagaaaggggccaagtgtgacatggcgagctgcccccaagggcacattttccaggccaagccagctcacatcaccagagcaacaagaacaatctatcctccatctttatccagctaccagctctcgatgaagccatcccgcggtatccatgggctgagctgactgcccccacaaaccaacacttgccactccctccctcatctcccctgtgccgtgacgtcgttctatccaaagtccaacacaacagcagggcattttttatacggttccagccaccgaaaagaggaaaagataaaaaacacacacacacacacaccagaacaaaagtagtatagcaaaccatcagcttcctcctccttccctccacgcggacatggtatagccgtatagggggcgcagtatggtagcccccattgcccccatacacaaacacattccggcatctatcgcaagccaaaccacccacccacaccccccacccaccgctcctatatatccctcctcccccttcgtctccctcctctcctacttatcctacgcttgccgcctatagcatcgccaacagaaggaagcaagagatagttcgagtcgagttgagttgcatccgtccgtactggggtagaggagagtaggagtgtgctagtgtgtgaggtctactgaaa

SEQ ID NO: 25813 - DNA, 477 bp, Oryza sativa
cttttttttttttggtttactgattgaaggctagcataactgaaacgcacacaaaacatcgatgtttgacggaaatatcaatgtttgtggaactccgcttcagaagaattgatcaggcaataaaaacaatattgagcatacagtgaacagagaattggaaactattcatagacttaattatcctttacttcggacttttgtaagagtttgtggttggcctctgagtggggtcctgcactctgccgttaaattaaaagaatcctaaagagtttttgtagtgtttattgttcatacctagggcaggttagctaatgggtaacttccatttggttctgcaaaccaactaatgccgttgctgcagccaaaatccatctgtctgttccataatgccagcaaagaagtaacgttgtatatatatacagtagttatttttttcatattccagtttagcatctttttcttgacaaccgaaacttt

SEQ ID NO: 25814 - DNA, 557 bp, Oryza sativa
agaaaataatatgcatggattttgttttctgtaaaaaaaatggctataatatccttatgggtaacaacactttggtctctcaagttttgcttgaggctcctgttgggctctgatgtatcatccagatgtgtgtgtgtcctcaaattttcctcattaaaaattaaaattggatccaccgggagcagcgcctgtacaggactaatcggtgttgacccttgatctcttggcttggccaattcgtttgatatgcatgtccttgtagtgcttcaactggttcaaaggagtaaggacaatcatgacccatagtcggaaaacttggaggactgggtggataaattggaatgtcatggacaatcacaaccaaagaatggcctatgaaacttgacttcatactactaaattggcaaataattaaaatattagtggcccatgcaaccatctagttgacttcattcataagtgggatacttttgcaactgcagtgccactaaattggatataattaaatatttccatgcaccttatatatttatgacaaatctttgaactgctgcagg

SEQ ID NO: 25815 - DNA, 1501 bp, Oryza sativa
ctccctccacctccaccgcactaccaccaccaccaccaccaaccgccgtgcggacgccgccggcttcccggccgcgacgcggaggaggaccgaattcccccccacccctccgtccaatccgcgcgcaccacctccgaggtaaagcctctgcgctccccctgctccgtcgcgcggcgggttctccctccacagccagccgaggggggcggtggcgtcatgcgaggcagagggagggaggccgcctgaggggggcaaggcgccgcctcaggccggacttaatttgttactgcttcttcgctacgatgccctgcttgctttctcttagcgaatttttgtggtctcgtgtgtctagaataggtagcgcggcgtcagcaggttttgggggtttggtttgcggctgcggagttttcagcctttcaggccaagccatggttataactgggtgggttagaatttttttagttgcttgatcggttgcttttacctatcatcacagggaacaaataggtcacaattggtaattctaatcatttgttaatcggaacgactatgggcactggtggtaattgatgtttcatatactaactgtcactttcctgcttatctgttcatcggggtgaaattggtgtgacactttgggagttgagatactcggcagccataccttatctatgctttgcaaagtttaaccaccatgtatttgatggcgactccctccgaaataacagagagggatagaaatacagagttatatatgttaaggctaggctaggctaggtttgctgtggaaatgattcttataagctatagctgtttagtttattttatgggatcaatcaaattatagtttgataaaatatatcatccaactttcatgtctctcctaattatttcatattttcacaacataataatattatcatttagaacatctttgtattatagtgggaagctgattttaacatgattactaaaaagaagtaataagctctatctgaattaaaaaatagtcataatttgaaactcaaaattaacttttgatttaaatacaagcattttaccaaacactggaatacccaaaaagctgttgccctaaatgaaacacagtccgccgcaataccaaatggagcctgcctacacgagggaaacaccaaatcaccacttcagcattctatctattgtccagttagctaaatgcaatcattcaatattcaacaatcaaatggacatttcctgtcaggtgtgatgagtgattgtccatgcacaaaatctaagctgactgttgtgacataacaaagttaaatttactgtttccatttgattatgttgctgttctttgttctgtgtccatattcatgtgcatacgcgttacttcccttactcaattatgcttgataatcatcagggaactccatgtatgcaaatgtcgccacccttgtagaatcaataaagctgttctagcagctaacctttggtttggtggatttttggaaaatgatga

SEQ ID NO: 25816 - DNA, 352 bp, Oryza sativa
ttttgcacacgcaaattaaggttttcataaattacccgcttgccacgtttaaaggtaaggttttttatttcaaccaagtctctcttatcacgcattggaattttcttcgttagagtataaaatatagttgacaatactctatcaagtcgttattaaagtcaaaggatttttaaattatggtgaaaaattcaccgcttacctgtaaaagacagaacgctatagttcgtttattttatcaacagttattttgtttttagtgaaccgttgtttaattacactgtcgtaaataacacagttaatttgacacttattttataaattagagcatatacaaggatgatacgaatgaata

SEQ ID NO: 25817 - DNA, 783 bp, Oryza sativa
atttaagttccgttaaatttttaggattctcaatttgcactagcgcaacatccgataacgcatctgaaccgattaatttcgctttaaactctcgcccatcttctaatttaatggtgatcttttctgcatctttaataacgtgattattagtaatcacatagcctttttcagcattaataattgcgcctgatccttgacctcggaaattacgtggcacattacgttgttcaccaaaaccaaagccaaagcgttcagcaaaacgctcaccaaaaatatctgggccaaagaaaaattgaagttcttccggaagttcacgtttatattgtgcattttcaactttagttgtaccttcaatagcaatactgactactgccgggcgaacccttttaatcatagatgctaaacttggtaatgcttgaccgcctaatattgttggtaataccgcttggctcatagcaggtactgaaagtacacttaaacctaagactaatgaagataaaattgattttttcatgactttattcattcgtatcatccttgtatatgctctaatttataaaataagtgtcaaattaactgtgttatttacgacagtgtaattaaacaacggttcactaaaaacaaaataactgttgataaaataaacgaactatagcgttctgtcttttacaggtaagcggtgaatttttcaccataatttaaaaatcctttgactttaataacgacttgatagagtattgtcaactatattttatactctaacgaagaaaattccaatgcgtg

SEQ ID NO: 25818 - DNA, 341 bp, Oryza sativa
aaaatgcttttattcgcaaaaattctaccgcttagcgcttcctttacaaataaagccgttacattgaggctattgccacaattgcttttaattgattaaccgtttaatgatcaatttatagtattcatctataacaacttaaaaaccataaatgcccactagaatcgcgatgaaaatgccgaaaccaaagtaattattatttaagaatgctttaaaacattgctctctaacccgttgttttgttaaccaacattgataaataaataaggttgaagttaaggctaatacaataaaataaccaatgtgatattcacttaaccacccaaacagaataaataaaa

SEQ ID NO: 25819 - DNA, 1501 bp, Oryza sativa
gaattcacatgtgttatctataaatttcagatgtttcatatagattgtccttgggatactgtcgaaacaagatttcggcaataataaaagggggtggctatcaagttaggaaagtggatgggtttggagacaaagaattttatacaggttcaggccttcttattcaagaagtaataccctattcctgtccggggatgattccgccgagtatgttattgattgtataaactgggaaaaaagaatcgcgccctaagaggcacacggaccctccttatataggggaaggagtccgctttacaaaatacagtccatatcctaacggaatatgggattacagataaaatacaatcgtaaccgactaggatcccgggtattttcttgacatacaagtttagaatctaacccgagtactcatagagatattctatctatatttggtaccatatatccgactaaattataactgtcgtgtagatatggggtatccataatctccacagtagcccccgaaaccttcgcagttgacagtaatagccttctcgaaacaaaaaacagtaatccgagtgcttcaattcaacttgccgagtgctaaaatcaaagactacgaagggcaaaaataaaacatggtgcatcgagtagatgcacctaattaggtgtagcccctgactatgtgattagttgaaaaaactaaacatatagtcaagaaccgagtggttatatagcgaagcacgcatggtacttagtaagatacccagccgactgcttctcaacttgaacataccaagaacaaaaatacaagaagggccgagtgataaacactcaaaggtccaaaaataggcatatttgataggaatctgagtaagaaactcgtaaaatgatccaccaaatatgataaagatcatggcaattaggaagtttaatagcctaggctataacccttaccataatcaaaataagcatataacatgctaggagaatgactactaataaatcagtcatctcaaattaacccaacagcttttgtagcctaaaaaagcttacaaaaatagtataacacctttctgtcgggtacctttttatgtgcatcataataattccaaagaattattgaattgcgttaaaaaagattttaacagcatcgggtcacatcattgtgagcacatattgccaaagcaaaaagcgcttaagtccctagggatcacaacgggccacgctgaaaacaaaattgggctgaagtaccgtacaggcccaggcccattagtactcccgataccctaaaaacaccgaagtccaaacgtcatttcgtcttccccgccgagactctcgccattccccgctccatgctacagtacagaaccgcgccgacgaagttagggttcatcaatctgctccaatcctccctcaaaaacttcacaaaatttctccccgcgtccaccgctccaattccccattccactctagccatatctcggaccaaattaaaccatccagtttacattca

SEQ ID NO: 25820 - DNA, 1501 bp, Oryza sativa
gcatgtttgacatattaataactgaatgttaaccagaaaacatttcattacccaaagactaacctttatttaatgcaacccaacaaaatagtataagatattagtcctttttgcgcgaatataagatattagtccttatcctgctggtgaacatttaatttgttactaccttactggtggccattgcatactccctttatttggcactaacctgtactggtcgccttcctccatcttattttaggtttctactttaccataaatacctgtaatcttttcagtttttcacaacgtaatgcttatctgctaaaaaaactgagtgtttcagttgcaatggagaaagttagtacaagattctatgcatatccaagagtgttcaggttaagaagtgcagggctaaaaacctcatattttaaatttggccatattaaacctaacaaataacataaaagtatttctgggataaaaaggaaatttaaaatatgaagctcatcatcccacaccatcctgaatttgaaatattacagatgacatttgaccatatggacatggcttcgtcaaaggccttcaagtaaggagtactaaacagcattctgtatcttttctacctaattaagctgtacacttaaatcctattcagggtaacaggttctttcagaaatacttgccgcaaccaaaattatagttactcattcccttctgctatgatggctagtgatgcaaggaatacaacatgtatggattgggaaaatatcatcaggactgaagtcactgaactgtgattcaaaactcaaactcaactccagacctaaaacattcagacctcaatttcagtgataaaagtgcagatcatgtcatgcattgcaccacctctgttcgtaacaaggcactgaatggttctaagttctaacgttcagtgcacgggatttgatcgtcataaatgcatcaaaaaataaaataaaaagtgtcaactttccatagaaacaacaaggttcgttgctgttagtatctgtggagattatggataccccatatctacacgacagttataatttagtcggatatatggtaccaaatatagatataatatctctatgagtactcgggttaattctaaacttatatgtcaagaaaatacccgggatcctagtcgggtacgaatggtattttatgtgtaaatcccataatccgttaggaaaatgactgtattttgtaaagcggactccttcccctatataaggagggtccatgtgcctcttggggcgcgattcttttttcccagtttatacaatcaataacatactcggcggaatcatccccggacaggagtagggtattacttcttgaataagaaggcctgaacctgtataaaattctttgtctccgaacccatccactttcctaacttgatagccacccccttttattattgccgaaatcttgtttcgacagttggcgcgccaggtagggtagcgtcaagttttttgccgactaagtgcga

SEQ ID NO: 25821 - DNA, 1501 bp, Oryza sativa
gcatcgcgcactaccacgcgcgatacctcgtcggcgacgccaactatatcctcggcttgcacgggcaatacctcatcggcgctgaccacaaccagaacactcctcggcgttgataggtattttcatctaaacttgatacctaatactagatgttttgaaacttgatacctagtactagatgttttgaaacttgatacttgatactagatgttttaaaactggataccttatactagatagatgttttaaaacttgatacctgatacttctgtaagtagaaatgctaaatttgtatcaaaattggtgaaaaaagaaaactggtaatattgtccatggtaatcttacacttatgttttgtgctcatttatcaatgtttgtgctcttgcaaaaaggctgataattattttttagtaatctggtacttctgattgtagaactgaaaaaagtttgatgaaaattggtactaacctgataatggtatgtttgtctaatttgagccgtacagaatttaatgtttttttttgttttgcactatcaaaatgtgaagggggagtggaaaaaagtatgagttcgtcagttagttctattgaaagaagaatggaagatcttcaaaacatgggtgctggggcttgtgtttctgctgaaacaagtgtgaatgagcaggctacaagtgtgggtgagagatgctgaagttctgaggacagcactgcttgaagctggaatagtcacaggacccacaagtattttgcaagttgatgctggggatggatttgaaatagaaccagtaaatcgaactggaggatctgaaatggaggctgaaacaagtgtgaatgagcaggctacaagtgtgggtgagaaggatatagatgctgaagttctgagggcagcactgcttaaagctggaatagtggcaggacccacgagtattttgcaagttgatgctggggatggacttgaaatagaaccagcaactacaactgaaggatctgaaatggagggtgtccaatcacaacctgtggtaccatttgttggtatggagttcttttcagacaaagaggcacgcgtgtactacaataggtatgcaaaaaattgaggtttcggtagaaaggtttcgagttgcaaaagaagcaatgtcaccaaagattacaacagatatgagttcgcttgctattctgaacgcacaagtaaggagcagaatgcaaaatcaagtattggaagcagatccaggaagtgcaacagcatacggaaaactgattgtaaggcgagaatggtggtcgttaaaagggctgaaaagtgggtggtgacaatagtagacttagatcacaatcatcctcctttgagccccaattctctaaggttcctagaatcacaccgtaacgtgtcggatgaagactatgagctaatagaattacggcacaacaacaacatccccactagaagaatcatgtctgtcctgtctgatttgtatggtaccatgcgtaacataccattcacaaagaaa

SEQ ID NO: 25822 - DNA, 1501 bp, Oryza sativa
agtgctaggaggctaatcggacagtgatggtaaatagtagaagttaagtaaaagtcggtggcattttatagaatgtgataaagtcagtggcaaatcgtagagccgtgacaaacttagtggtatataatggattctctctaataaagatcaaaactaaaattcgaagatagacaatgtaatgagcaaaaccccacagtataaaagggattgaggaatatttcaggagtatatagggaatatttcagttagcgtgagtatgcataactgttatttctcccaatagcttactagagctatatatattccttctttttcgtaaatcagaaaagtagaatcttcgaaatcatcagcccatgaagtagaatcttcgaaatcatcggctgatgattatgtcgatcaaagttcactcgtttcaccgccgactaacgtctaatcaatgtggaagacaacacaggtaactgagccgtaaataagtgattcgtccaagcgaacccaatctgatgaggacaccaccacaagagcactatactaatagggaacctccagtacaacgcctttaaatagatcgagacatctagaatatcgtaatcgctatccccgaacatatagaacattttttttttacttgtagggtctaccgaagacatggaagagagacggggcatcacaacatcgtctctaggaggataaatagtgcccacatgtgtcactgatgtctctcctcaagtggtagccggctctcccacaacagcaatggtggctaccaaacggatgaattggccgaattggccacagtaggagaagtctagaatggatgaattggccgagctctcagtatactggtccttcaattgctagtctggctagtctgaacacggttttctaaagaggcaatttcattcttacccctattttaatatccaacattaattttatctctgttttttaggtttttttatttcttttttttaagaagccaaattttactcccactttggactggaggatggatatggacatgttgacggtattaaattttttatgaaaatacatccatacctttacttgctattacacatttcacactttgtttgtcaattgtgcatctgccccctatttgtacatgcagctagtagttctgataaattaactttgacagaatttcaacaaaattttgtttccggcaccgcgttccagaatagcacattccaccgtcgccgtggacagcttgagcttgctaagcatcaacacgaaccatgaagtcagaggctgggacatacgacttccaagaatcagcctgcaaacgaatggttccacgtgtttcaatacctttgaattgaatttcttatgacgattgagaagatagcgcatgcaagaaaaaataaatgcagacatcgtcgtttttacagatatgaaccatcatattggttagccttgtctagtgcacaaaccaaaatcagttaaacattccagtaaagtaaaataaaatatggctaagtta

SEQ ID NO: 25823 - DNA, 1501 bp, Oryza sativa
tttagcatttctacttacagaagtatcaggtatcaagttttaaaacatctatctagtataaggtatccagttttaaaacatctagtatcaagtatcaagtttcaaaacatctagtactaggtatcaagtttcaaaacatctagtattaggtatcaagtttagatgaaaatacctatcaacgccgaggagtgttctggttgtggtcagcgccgatgaggtattgcccgtgcaagccgaggatgtagttggcgtcgctgacgaggtatcgcgcgtggtagcgcgcgatgccgaggatgtttttggtgtcgtcgacgaggttgccggccgtcgccgacgaggtggcgcgcgataccgaggaggatcttggtgtcgccgacgaggtatcgtgcgcgcgatgccgaggaagatctgggtgtcgccgacgatgttgcgggccgtggccgacgaagatctgggtgtcaccgacgaggtagcgcgcgatactgaggaggatctgggtgtcaccgatgccgacgaggtatcacgcgctccgcgcgcgatgccgacgaggatctgggtgtcgccgacgaggttgccggccgtcgctgacaaggatttgggtgtcgccgatgccgacgaggtatcgcgcgcgatgccgaggaggaacctggttttgcgccttgatttttggatctgggatatttaggacatatcaccgtaaatcgcggggaccgaatcgtaactaccatattaatgttgtctccttcgaacagcattccgttttgtagcgtctctcttttgatattgaagttgaaggtaagtctataaccgtttgttacccgaattggggcgcaaaaccgctccacataaaaggctccctcctaatagatgaagaataaatatggtagagaaaagagatgatgtatttattaatggcccactttaagaaaccatgggttgtaaaatatagtttttattgtgatgtcttattgacatggcatcatagacattacttatgaacactatgaattaagactgccctcatgcatcatcaacagcagcagcaaaaacagcgcgattttgctatatctcactcgaaagattttttcttatctctcactcgattttctcactcaaatttacagtgcattttcttataaattacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaattcaaagattaaaaatatgtgtgatacaatcataaaaatctttcgaaagatgtataggtactcccaaacagcgcgcacttcaagggggagagcccagctgacgtggcgtcacccagccactgacgtgtgggcccccaccccaccgcttttataacctcgccgcctcgcctcctcc

SEQ ID NO: 25824 - DNA, 1501 bp, Oryza sativa
tgcaggatataaggtagctctaatcttcttatagtgttgttgtttttgttatgtctgtgtctaggcaaagcatttgagtgttcacttagggtcgcaatagagcaagtgtagtgtggcggaggtaccgatagaacaggatataccttcagttgatttgtgcaaaactgatgatttgataaaataatatttgccccaacacaaggagcaaagttgggaactatttttcaatatagtatattttttctttggtaaatcccatgtacatgccctttgtagcagaaaactacgggttcacaaatttcacataactacatggagcttgatagtactattaagtattaacacaaaaacacattgtttgatacaggatttgtgaaatttgatattttctgtattataactctcaagtttttctaacaattatataatactttctcagccccattggtggtttcatgagcaaaatgtttttttttaagaaactgataacaattgtttggtgtactactttgtatttaaggctaatatttgtaaaggatgaatggagctaaataattgtctctgcaacatgctgatattttttttaactctaacatatctggttgttaaagtccacttggattttgtttgcaaccttgtagttcaaactgctaccttattccttataatcatgatctgtacaattctatcgattgatcagtaacttttgatggagttaatgaggaataatgttagaattttctttctgacttttgtgcttttagctacttgtaggtgcagacataagttgcatggccaattactagggactgtaaaactataaatttaacaaagagtgcattatatatattttgtctatggctaattttacaacaaagcgaagaaagagaacatgaaaagaagggaaacccaactgtgtaaaaacctgtgatcatgttttctaacaactaaaatcgctgtttatcaaccactcacgacgacaccgagatcttcgacttagctcccacaggtcccaggctcgtcaccccgggaactcgcagcccatcacaactactcatactaggagccacctagctagaatagaaggaagaatctcgtaaatctagactatgatagtgtactcaacttgcagttttccaacagtattaaccatttgttaaactgccttcatcagaggatctagattcgatcacacaacccaatcatatcgcaatacattattctgaggtaatacttaccaatcgatgtttggtttctttcagttgtgtcaatttacaggcatgactaagaacaaacttacagtagaattgctgctatttttgggattagttggttagtttttactatgtgcatgtataggctatttgcttgcacagacttttcagctgcatttcactaaatcaactaatattagtccaaaattactctttcaggtaagctggcaactttgagagtaaaacagacttcagggagctatttctctttcttttcctcatgtagt

SEQ ID NO: 25825 - DNA, 227 bp, Oryza sativa
  unsure (1)..(227): unsure at all n locations
cgtggcatganatgcaatgagaatcagcatggnacccancaggccttgtctttataatgtattaatacaaaggcagatcgatgaaagaaatatatgctcaagcacaaataaccacgggcgatcgagttgcataggcagatagcttggatcactgctcgttacccatatcgccactatgcaatacccctcatcagctaccaagtcttcatggctgcttctcgtcgtca

SEQ ID NO: 25826 - DNA, 1501 bp, Oryza sativa
ggagacggccacaggttagtagtccgtttcactgtccgattaattactgtcctaataattttttttgggacggatggaatatcattttaccaggtcttgcacgtttacctgcttaggaggggctgtttagttggtgaaatgaaaatctttgagtgtcacatcagacgtttaaccggatgttggaagaagtttttggacacgaataaaaaaagcaaattttataactcgcctggaaaccgcgagatgaatcttttgagccgaattaatccgccattagcacatgtgggttattgtagcatttatgtttaatcatggcctaattaaggggtgtttaggaactagggactaaacattagtccctctcacaaaagtataagtccctcccttagagacttatgtttagtttagcccctctctcccaaacaccccccttagactcaaaagatttgtctcgtgatttacatctaaactgtgtaattagttttttttttatctatatttaaacaggtggttccagaaacgacggtccgcggctcgttacgctaggatcacgtgaaagaaatgtgggagtgtttgttgatgcaatacttgggatgacattgctggcatgtgacagagcagtttgctagctttgcattcccacgatcatccgctgtgtgcaccgagactgaatagtaccctcacgaattccgaggtcaagaatcaccgtactatagaggcgaaatcacatggaaactgctcttcctgaactctcaagaagaacaagtggcatcgcgaagactttgactcctgactcgcttcacacagcacacatacgtgcagctgtgccactctagtcatgtgaccgagcgagtgatcggctggggcaacgacgactggtgcattgtaagcggtcaccgattttccgttgtgcgcatggcacacatcggtcgagttaagaggcggcgttgacgcgcgcgacagatgatcgggtcaatgcaaattacttccttcattcctttttttttaaaaaaaaaggaaaaaaacttaacctgaagataggtgacatcatttttttttgcggggaggtgacatcatactccctccgtttcgttttatctgacgccgttgactttttatcacatgtttgaccgttcgtcttattcaaaaacttttgtgaaatatgtaaaactatacatatgcataaaagtatatttaacaacaaatcaaatgataggaaaagaattaataattatttaatttttttgaattagacgagaggtcaaacatgtgctaaaaagtcaacggtgtcaaataaaacgaaacggagggagtatttaggttgagttttaggaagagaatactattccctctgtttaaggttacaagacgttttaactttggtcaaaatcaaaatgttttaattttgaccaagtttgtagaaaaagatagtaacattttcaatcaagacaagtttattatgaaaatatattcaattattgattcgatgaaactaatttat

SEQ ID NO: 25827 - DNA, 1501 bp, Oryza sativa
aagaaaccaaggcccttcaatctttcatttgcccttgcccactaaatttcttcagtgtcggcttattcctaacgcgcaactggtgttgccaatgcagatgtaacaatagttcatgatgtgtatctctctctactccctccgttcttaaaaaaaaaaggtaaatctagaactggatatgacacattatacgtactataataaatctggacagatgtatatccagattcgtagtagtagatgtatcacatccaatactagattgtttttttatgagacggagagagtatttcttagcgtagccgtaagcctttaactacagcaccgtcagccatggagaaattacctgcaattcagcggtaggcctcgcaccacgcgctcgctcacacgatactgcatgcattacattatactccctccatttcagattataaaatattttgactttagttaaagttaaactgtttcaagtttgactaagtttatagacaaatataatgatatttataataataaattagtttcatcgaatcaataattgaatatattttcataataaacttgtcttgattgaaaatgttactatctttttctacaaacttggtcaaaattaaaacattttgattttgaccaaagttaaaacgtcttgtaaccttaaacagagggaatagtattctcttcctaaaactcaacctaaatactccctccgtttcgttttatttgacaccgttgactttttagcacatgtttgacctctcgtctaattcaaaaaaattaaataattattaattcttttcctatcatttgatttgttgttaaatatacttttatgcatatgtatagttttacatatttcacaaaagtttttgaataagacgaacggtcaaacatgtgataaaaagtcaacggcgtcagataaaacgaaacggagggagtatgatgtcacctccccgcaaaaaaaaatgatgtcacctatcttcaggttaagtttttttcctttttttttaaaaaaaaaggaatgaaggaagtaatttgcattgacccgatcatctgtcgcgcgcgtcaacgccgcctcttaactcgaccgatgtgtgccatgcgcacaacggaaaatcggtgaccgcttacaatgcaccagtcgtcgttgccccagccgatcactcgctcggtcacatgactagagtggcacagctgcacgtatgtgtgctgtgtgaagcgagtcaggagtcaaagtcttcgcgatgccacttgttcttcttgagagttcaggaagagcagtttccatgtgatttcgcctctatagtacggtgattcttgacctcggaattcgtgagggtactattcagtctcggtgcacacagcggatgatcgtgggaatgcaaagctagcaaactgctctgtcacatgccagcaatgtcatcccaagtattgcatcaacaaacactcccacatttctttcacgtgatcctagcgtaacgagccgcggaccgtcgtttctggaacc

SEQ ID NO: 25828 - DNA, 1501 bp, Oryza sativa
taaaagttagatagaaatttagatatttgtggcatatttttcaaactgctaaataatacgtttcatgtaaaatttttctatatgaaaaattactctaaaatatcagataaatatattttctcaagtttgtaataaaaaaacttaattagtcatacgttgatatcatctcattttatataaaatacttaatttttatcttcatcttcatctatatgagtttcattcgaacatgacgtactacgctgtgtattcaaggtagcactagcaaattaagctgtacactcacaggaacaaatgccaatttcgtttccgtactacgttcccccttcactgttttctttggtgagatgaaaaaaatgtcatgctaattaattaagctgtgtccccgcaaaaagaaattaattaagctgtgcactctcgatcgatcggttcggcaaaagatttattatttcctctttcgcctattctttcatcacggtcacaaacgtgaacatgcacgtacagggaagcagcttgtgaacgagctcgctcgcatcaacttttaggccgcctttgatttaaagaaaaaacatagaaattttgaaggattttaatcctacagaaaaattttctataacaccctttgaaacaaatgatcaaatcctatcatatcctttggaatttctatggaatggataattctaaagagattttcttgaggaaatttaacaagagctccaacctcttgaaagctttccttttagtctatctctttcatccgattttcttcccttttgccgcggttcattcaaacgatcattcctgtgttttgcaatcctctattttacacttgcattcctattagggcccctttgattcgcaggatatgaaaaacacaggaataggaaaaacacaatatttgaaatggtaggattttcaaatcctacgggaagagaaaacagagaaaaacgtaagaagatcctttgatataggcatagggaaaacaaaggaattcgcaccaggaagaattccaagaggtcttacctcttttttagtttcctttggaatccactcataggaatgcaatcctatggaatttatacttgccttttctataaatcaaagaggcttgaaggaaaaaaatcctttgaaatcccattcctaaaaaaaatcatttggcattactttaaattaaagaggctctagaatcctacgtttttcttattccttcgttttttcattcctaagattcaaagggatccttagtttgtattccttctccagttttcccaattcagctttctcgtttttcgtgcgcacgctttttaaactattaaacagtatgttttatattaattatttttttaaaaaagctaatacttaattaatcatatgataatacgatgcatcattttgcgtgcagccttagtttccatggggggcaaagtctctggtcggtcttcccgatgtacgtggtctggcttctccagtctccactatcgcaactcccaggatataagct

SEQ ID NO: 25829 - DNA, 719 bp, Oryza sativa
ggactttaatatttatgtgagacaattgttgtatggactttaatatttatgtgagacaattgttgtatggattttaatatttatgtgagacaattgttttatgtaattgtatatttatgtgagacgattattgtatggaattgtatcttttatgtgacacgattgttttacatacttgcttatatatttgagacaaattatgtgtttgtgcttgtaaggaattgtgtatgcttgtatgtgcctgtattggattagccatagaagatccggctgctgtatacttttagtggaggcaaatgattgggatggtacaataatagctaaatagcctttggatccaaacagcaagagggctattttgttagggggctattttggtgggataatctttagcccaaaaaatatccctgggatagttctccaaacaggcccataggaactttttcagtggaagtctcgcccagaaaaggaaaagaaaaataaaaatcaaaggcagctttatggctttataagagcaagggcagataaactttagctagcctactcgatatactgctatatttgcatggtatcatgtttgaagggtataaagtgtaacaactttgctacaagcccaatagcatggtcaaagcccacaatatgtcatatccagagagaacaagtctacattgactccctcaacttatgcccctggttgaatcgcatccctcaacctcagg

SEQ ID NO: 25830 - DNA, 1501 bp, Oryza sativa
ttcaatttccacaattcacaacgaaaaaaacaaattagactacaactatttaatgtgtattcaaaaataaatttcttttttcgttgcaatacttaaaagttaagtttaattttgcatgcttgcggagtgatttattacatgttaatatattttttagaattttttacataacaatttaagtaacacgtaaacaacgagtgacacgttcactcgagagttaatagtttcccaataatgtccttccgcgctagcatcatatggaaacaagcgcagagctgtttgtccgtctacgctgctgatctactccaaagatcatcttttctaccggtgttcttgcacctattgaatgcagtttcagacgctgggaagaaatgatatgtttcaccagcaattctgcagaattcctgtagcttccatgttctcaacagagcctagctaagcacctaatcattttttttaagatcaacggatctgaaagacttattataacacgtggaggattcactctgacaactcgacagaaaaagacgctgcatttgcgagttgcgacacgagcagttaggctgagcgcatctaccccgtgtaccaaaacaacgagaattcatcgttacatcgtcgtgttgtcgtgacaagacgtatagccaccaaagcaatacgttcccaacacatacacaccatgacactactgtaaatttgactgctaagatgttaatcaagagtacattaaaggatgttgataatgaaaatacgactggaagggcggccaggacaaggttcacatgcctgctacaacaaatttcgcttcggtgaagcagcatcgtcgtttttcttttctttgagaggccagcatcatcgttgagcctgcacgtatccactttatcttttgaacctaataatgcacagataaacaggttacgacctgcccagaaaagtatatacgtacaaacgaaggcgatgcgactaatattaggagtgcgacatttcagtaatcaacctaaacaaggttgttgcgttagaaaccaggtgtctgacatttctagtatatatcacacatattaggcatgtaccaacctttaaagacatcatcatgtaaagacttatataaaacaaaatcattgaaatttatactgtcgtaaaaggataagctaatgtgatggtgatatgcccccactccttcactaaaggtagataagcttgtgttgtgttctttgtaatgtgcatatgtagatggctaattgaccgcatgtgatcaagtatacaatttttagatatgggaataacttttcttttgcattttcatttggatcttatagcatgtttatttgtcatccatcgtgcgtcttcacacaggaaaaacaaaactgtactagctaattcaggctatgggaacctgctcctgcctttaccttcaacacagttgcagtcatgtgaactacggtttcctatatttttacctaggaaactggtaggcatcaaaaaaatcatattatctttcttattc

SEQ ID NO: 25831 - DNA, 268 bp, Oryza sativa
ataaatgcccgggtcgttttgccgttgcccgtccagcacgttagccaccacatacaccgcccagcgcgcctgcacaacgtgcggatgttcgcccggtacatgcccgagccacactacataggcggcaggcggattgcgcacaatatggcgcacggcggaatcgtcccaatgtccggggtgcgtgccgacttcgcgcaactggtcgccgcatagctcacggattcgcgcttgtagggcttcactggttttcgcaatgttgctcatcaga

SEQ ID NO: 25832 - DNA, 1501 bp, Oryza sativa
gtacacgcgtgcctctttgtctgaaaagaactccataccaacaaatggtaccacaggttgtgattggacaccctccatttcagatccttcagttgtagttgctggttctatttcaagtccatccccagcatcaacttgcaaaatactcgtgggtcctgccactattccagctttaagcagtgctgccctcagaacttcagcatctatatccttctcacccacacttgtagcctgctcattcacacttgtttcagcctccatttcagatcctccagttcgatttactggttctatttcaaatccatccccagcatcaacttgcaaaatacttgtgggtcctgtgactattccagcttcaagcagtgctgtcctcagaacttcagcatctctcacccacacttgtagcctgctcattcacacttgtttcagcagaaacacaagccccagcacccatgttttgaagatcttccattcttctttcaatagaactaactgacgaactcatacttttttccactcccccttcacattttgatagtgcaaaacaaaaaaaaacattaaattctgtacggctcaaattagacaaacataccattatcaggttagtaccaattttcatcaaacttttttcagttctacaatcagaagtaccagattactaaaaaataattatcagcctttttgcaagagcacaaacattgataaatgagcacaaaacataagtgtaagattaccatggacaatattaccagttttcttttttcaccaattttgatacaaatttagcatttctacttacagaagtatcaggtatcaagttttaaaacatctatctagtataaggtatccagttttaaaacatctagtatcaagtatcaagtttcaaaacatctagtactaggtatcaagtttcaaaacatctagtattaggtatcaagtttagatgaaaatacctatcaacgccgaggagtgttctggttgtggtcagcgccgatgaggtattgcccgtgcaagccgaggatatagttggcgtcgccgacgaggtatcgcgcgtggtagtgcgcgatgccgaggatgtttttggtgtcgtcgacgaggttgccggccgtcgccgacgaggtatcgcgtgcggtggcgcgcgataccgaggaggatctgggtgtcgccgacgaggtatcgtgcacgcgatgccgaggaagatctgggtgtcgccgacgatgttgcgggccgtggccgacgaagatctgggtgtcaccgacaccgacgaggtatcacgcgctccgcgcgcgatgccgacgaggatctgggtgtcgccaatgaggttgccagccgtcgccgacgaggatctggtgtcgccgacgccgacgaggtatcgcgcgcgatgccgaggaggaacctggttttgcaccttgatttttggatctgggatatttaggacatatcaccgtaaatcgcagggaccgaatcgtaactaccatattaatgttgtcccgttcgaaca

SEQ ID NO: 25833 - DNA, 1501 bp, Oryza sativa
actgtggggttttgctcattacattgtctatcttcgaattttagttttgatctttattagagagaatccattatataccactaagtttgtcacggctctacgatttgccactgactttatcacattctataaaatgccaccgacttttacttaacttctactatttaccatcactgtccgattagcctcctagcactatataattttgtccaaatgaccaaaatacccctaggaaaaaaacttccataatttggacaaaaattcaaaatatcatattagaaatataagattgtaaaaatccaaaattttgccaaaaacttaatatctgatatttcagaatttttgtccaaattttgaaagtttttatcatatgggtattttggtcatttggacaaaattgtacagtactaacgaaggctaaccggacgacaatggtaaatcgtagaagttaagccaaagttgatgatatattatagaacgtgacaaagtcagtggtaaattatggacttgtgataaactcggtggcatataatagattctctctttctctcttactcctttttcatcagttgatcttaagctgaccattcatttctatcaaaaagtccattttacattttggtataaagaaacatataaatttatgtagtatattgttatagggtagaaatttgttatatgataatattataattactagcttagagccaatgtattgtaacagaaaacaaattgagtctctaccttattaaatcaattaataagcacttatttagttcaggcaatactataattttctttattgaacaagtaggtgattttgaaatttggagagagccaataatgaaacgggagatgactcattgtaatataatataatataatataatagtatagattatggagcccacatgtcagtggtagcctggtaaggatggtgtggaaatggatattaccacaactaacattttaaatagtatatatgagtttattatgcgatatattatttatttgtagaaatgactaaactagtattatttatttgttattaaaaattatttatgtatcgtataaatagatttcttttacagcaaatatgttgtattaattttcataaaaaattatggtcaactaacaaaagagtatggaagtgatccaaagtatgcaatggaaagagtaaaacttacggaaataaaaaggatgggcaaagtttatacaatacactgtaattagttttccttaagttataagatgtaattttgtaatcattattcatttataaaattatgtcgtagtttttttaagtaaaagccaaaaaaaaattattatgtaaaaaaaatgtcaaaacgagaaaataacggtcaaacttaaccgagcaatgtctctaagaaaataacggtacctccctcttcctctccaacactcttgtcggatccaaaaaaacctcccaaagatccgctaagccgctatcccatcctaccgcgcgcgtgcgccatcgcca

SEQ ID NO: 25834 - DNA, 186 bp, Oryza sativa
tcacaatcagtatcgaaatattcaattaagtaataaaagtttatatcccaattcatttattaatattgacggtatggcgggtagattagaatcgaaatgcctttatttacgtttaaatcaggagaatgaaatattacagctagatcaatgggggcgaatttatgttataccgaaaactaaacggag

SEQ ID NO: 25835 - DNA, 1501 bp, Oryza sativa
tgcgtgaatgattttaagaattgatcccgcgcttgttgcatcattgcttcgaagtccttcttttgatcaggtgtgaacttttccggatcaacagtcacaacgttcccttcattgatgtatctgaggcccagcatctggattttctccttaacagaacctggactagccgaggatggcgacagcggcagcttctcggccatgaggaaggttgttttctgacttctaatcagtctcaccgggcgtgccaaaagcgtgttgacagaaaacacgaggcctgggagatctgcttaactttagtgcaggtccaaaactcgccttcggacgtgtgagcgtgccagttgatttgatcctgcaatcaacaagaaataaagacaaagaaaccacaattaatcctataaacgatagtcgatcggctaggtgccgatgacatatcatttatctttgagccgatgtcatatatgtatcgatcggcaatcatgaataaataagaagaaactaaatctactcgatcggctgtagatattaacaatatatatattccctatatcgatatatacttaaatcaagtgattgagatagatcggacgccatgccgagacagtataaatcatttatatcgaaatatatactaataatgggactatatatatgtttatagcatagccgatcaaatagatctagcgtgtatcggctaatactccgataccactctatatcaatatattaaagtaagaaaaatatatcaaacagaagcctaatatacttaaatgcaacaagatcttaacataaagggcacatttaacatatcaatcaagcatatggaataaaagtagttaaatcaggtaagatcggctgaaaccccgatactaccctaataggcaaccagaaggcaggctagagattgatattctaaacacgacttaatagatcaaactcaactgatgcagcattaagtatgaaaagaagaacaatatctagacaatcaaaccgctgaaagtttcatagagtggtggatatccgatataatttgaatcaacatcgatatttaacctaatcggctgtcctctaccaacagatgttagccaattgtaggttagataacgatattgctaaaaattatgtaagatatatgataactcgacgaattacataaacaagattagagtgtcatgaagatggaagcaccaatcccgagaatgcaaaccgccataacaagttttacctcttgttgaagatcgaaaccgatgcagctcaacccgaaagcaagaacttgtcaaaataaaactaaagcaaaaaggatggcgatgcgccgagattgtattgaacgtctgttttttttttacatgaggctcggggtctatttatacccgagaattctaagatgtgtccataccggacatgactattatctctaacaaactctaaaataccataagtctttacggcagacttttgcccaaacatatctctaaggaaattacataaaatatcctaattaata

SEQ ID NO: 25836 - DNA, 1501 bp, Oryza sativa
cccacccatattgatcaaatggtgggatgatgaaatgcaacctcaagggattgtaatcaacaagcaaaaagaagacgaggaattgtgtatgctgaaaaaggctctcggccaagccactcgtcttgtaaatgtaagtcttctcatacatgtctcttatcatcctgtcggccactttgctgaataaggatacttttgtattacagagaatccatctcaggaaagaggcgaagactgcaactcttgaaaaattagttccctatcttggaactctgaaagctaccagagatcagctgcacgaagccaaggagcttgccaagaagactgagcatgacctgagagaccggatcgccgagctccaagattccaactttgagctgagcggctcatcaaaaggtaactcttctcattgcctgacttgcttcatgttgttgttcatgtgcgactaaccaaaagggaacgatatagcgcaagctgccaagatttccgagctggaaaggcgagttaaagctctggaaaaggacaaggccgaactgactaagcaaagggactgggcccaaaaagacgtcgaaggtaccgacggccgaagcactaaaaaatattcacctcttcatgaccactcattgatgtaggtatatctgtgcagatcgcaaaatcaaatcccaagctcaatttgacgtcttggtcagcaaaatcaagaagcttgagggagctagagatgaggttgccaacgccgccacactactcgtccaagccatgttcttcaataacaatggtccgagttcatttgatgctgacgagatcttcgacaagctgagaattgctccggatacatattttaagaatatcaaggaggctggaagtatgggagctggcctgtcgctggcgatgaccaagtccttgtacccgaagatagacattgaagctgttgacggctttgcagatgggacaagtgaagaagctgctcttgatctcatcagtgaagctcaaaatgctgccgacaagatagcggctgatgttgttgaaaggttccaggacactgacctcaggccgactggatcaactaactctgatgatgaaaaagctgactaacattgtgtttggatgatgatggagggacaatttgtacaatactgataaatgtatgctatgcttgatgatttagacttagcttctgatttcttaaaagtttttgtcaaaccttattgagcttagaacccgcaaaagttattaaaaactttcagtcctcatcaaccaagtcaaaaaatcaaacagggcaatgacaaatcaagtaagcaaattgaattgataaaaatcacactccattattattatagtagcccccgactgataactcaaggaaaaacttgatgttagcagtcaaagagggaaatacaaaagtaacgcctaagcataaaaatggcgaagatgttcaatattccaagagttgtcgatattagtaccgtcttcacgcttgagtcggtaagaaccttgccgagtgact

SEQ ID NO: 25837 - DNA, 1501 bp, Oryza sativa
ctcgtcgtctcgcggcgccgcctccgtcgtcggcatcgcagcggcgtgttccacgccatcctcgcctccgtgcagccgctgccggctgccctcgtcgtctcctcgccggccccggtcgtcgtcgtcgtcgtcctctcgtcgttcccggtcgtcgtggcgttcgtccctccatcgagccgttctcgtccgtcgtccgcgttcgtcaagcgagccgctgcagccccgtcgtcgtcttcgtcctcggctccgcatcgtcaagcgttgcgccggccgcgtctcgccttcgtccaaggatcgccgccgaagtcgtcccctcgccgttcgtctccgtcgttcccggccgcctccgccgcgcccgttcgtcattgtcgttccctcgcctcgttgcgtggtggtaagggtccctctccctcgctgccccgtcctcgtcctttcggtgtcgcccgtgctcgttgtgcggttgtcggccccggtacccgtgtaccggtgtcggtagtcgtccaggtgtgcgtgtggtgaccgtgttagtgtgcccactcggtagccgcatggtttccacgtgtgcaacccgtgtggtgtctactggagtccgtttgtcggccactcgcctcggttgacacacgggatccgtttccgtcgacccgtggaccgtctctgtgtactcggtctaccgcggtcctttttgttgacatgtgaggtccgcatgtcaacggcgcagccttcctgtcttttctaggctagcgcttacacatgttttataattgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattctgatttaaattaatgcattatcgctttatttaaattcctgcgttatcactgttttatttagccatgcctatttacctttgttatgaccttattattattgctattgttattattaccttgttcaccctggaataaacaaaaccccaactagtgggtactctattcatggttccactagtatgaatttaggtagatgcttcgctgtttaattaggcaacattaggtggttttataactttagactttgggaatattcatatcacttggatactttggaatggttggcttttgttgcaattggacacacacctccccctctattcaaaacccccaaaatggttttaggctgggctcgaggtgcgtggttgggttttgctagtcgtacctcgggtactataaggattaa

SEQ ID NO: 25838 - DNA, 1501 bp, Oryza sativa
gacgaagatcgttgcggaaacagagaaagaatcggctgtatccaacggatacggtcaggatcgacagagtttgagtcggacggggttagccaatatagccgattccgataatacgacttggtgtgcgatatcgggttgagttaatgtgcttcatggtgattgccacgcaaggatagagtcctgagaaggcaattatatctattaattaggatattttatgtaatttccttagagatatgtttgggcaaaagtctgccgtaaagacttatggtattttagagtttgttagagataatagtcatgtccggtatggacacatcttagaattctcgggtataaatagaccccgagcctcatgtaaaaaaaaaacagacgttcaatacaatctcggcgcatcgccatcctttttgctttagttttattttgacaagttcttgctttcgggttgagctgcatcggtttcgatcttcaacaagaggtaaaacttgttatggcggtttgcattctcgggattggtgcttccatcttcatgacactctaatcttgtttatgtaattcgtcgagttatcatatatcttacataatttttagcaatatcgttatctaacctacaattggctaacatctgttggtagaggacagccgattaggttaaatatcgatgttgattcaaattatatcggatatccaccactctatgaaactttcagcggtttgattgtctagatattgttcttcttttcatacttaatgctgcatcagttgagtttgatctattaagtcgtgtttagaatatcaatctctagcctgccttctggttgcctattagggtagtatcggggtttcagccgatcttacctgatttaactacttttattccatatgcttgattgatatgttaaatgtgccctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcgactatcgtttataggattaattgtggtttctttgtctttatttcttgttgattgcaggatcaaatcaactggcacgctcacacgtccgaaggcgagttttggacctgcactaaagttaagcagatctcccaggcctcgtgttttctgtcaacacgcttttggcacgcccggtgagactgattagaagtcagaaaacaaccttcctca

SEQ ID NO: 25839 - DNA, 1501 bp, Oryza sativa
gcaacggttggtatttaaagcactgtgtaacggtcagaaaacagcaagtgcgatatttactcatagtcgatgtatgtcaaatccgaaacattaccaaatattccggacttggggggcatgtgttaacgaccaaatttggttcaaaagcactatggagttgcctttacattttaaaacaaacaccatcactagctttagatgacgcgatgtggatgtaggtcgttgaagcgatggtaaatcaacctatggcataactgcttgcggtatttcatggtgtctctctggggaaaaaatgaaacaatatgagaaccaatgagcatttctctagagatggaacaaacaaccgatttttggtagcaaaaaaaccagtaccgtcgtatatccaacaagactcctgccattgtgacactcgagcatcctcataacacagaacccgcagtcgtgtctacataaaaaaatgaaggtgtgaagtaaaaaaaaacatgtacagaaaaggatgtgactgtgagtgagataaatcaaaaaaaaattgttgatacttacaatgtatcttggtgaggcgattcaggatactcaactatgaagatgtcaccaaatccaaaagggctactgtttgttcgtgtgtcaagggcaacatggagattgctactctgaaaaacatatggaagaaagaatgaaaagaaaaagaatgatacctagtaaaaatacaatgaaaaagaggaatagtaaaaaaaaaagcttaatcacaaattatctaacataatttttagcaatatcgttatctaacctacaattggctaacataagttggtagaggacagccgattaggttaaatatcgatgttgattcaaattatatcggatatccaccactctatgaaactttcagcggcttgattgtctagatattgttcttcttttcatacttaatgctgcatcagttgagtttgatctattaagtcgtgtttagaatatcaatctctagcctgtcttctggttgctgattagggtagtatcggggtttcagccgatcttacctgatttaactacttttattccatatgcttgattgatatgttaaatctgtcctttatgttaagatcttgttgcatttaagtatattaggcttctgtttgatatatttttcttactttaatatattgatatagagtggtatcggagtattagccgatacacgctagatctatttgatcggctatgctataaacatatatatagtcccattattagtatatatttcgatataaatgatttatactgtctcggcatggcgtccgatctatctcaatcacttgatttaagtatatatcgatatagggaatatatatattgttaatatctacagccgatcgagtagatttagtttcttcttatttattcatgattgccgatcgatacatatatgacatcggctcaaagataaatgatatgtcatcggcacctagccgatcagctatcgtttataggattaattgtggtt

SEQ ID NO: 25840 - DNA, 366 bp, Oryza sativa
  unsure (1)..(366): unsure at all n locations
gttgcttggcatggtggtnctcataccttttgggtctaaggtgctttcatttccggaaatgaagattgagattcccttttggtcttctggtatcattaatgatatagatcacacattcttaataactctaggtgtttaatttctgtggaggatgttatttcaagttaatagagtgctatctaggtagtaaggatctgcatacatgttttctgatttctctctgattatggcttataaaatgagttcagtacttgatttcctctacttttttttttatctttaccatgttgccaaatgccaatcatgtggtcggcctcttcatcttgaactactcatcatcagttaaagtttctcataacacattta

SEQ ID NO: 25841 - DNA, 265 bp, Oryza sativa
  unsure (1)..(265): unsure at all n locations
atcgaaccttgggtctatatgattaagtgttttactttatgtcgtccttctaacatttcctgngggtcttaattgtgnnctaannnnnnnncnnnnggcgganatgattgtgatcgactcgtaccccctctttttcctctctctcactcttcctctctctttctcgccagacgacggcaggcggtggacgcgaagctgcggtggggttgggggacgaggaggcagcggcagccgggggcactatgagcagccaccccttggcgca

SEQ ID NO: 25842 - DNA, 1501 bp, Oryza sativa
ttactttacattgtagtcctccagcctctcaaaatttgaacgtgtccgtgcttttgagttcaggtatgtggaatgtatttataacacattataactaacggttgatagcaaattagttgttacaacaaaaagaccaacattccaaatgaaccgtgttgaaaattgggcaacatttaaatgcggcttttggggcttgtttggtcatgacccaaatgaatcattccaaaaatttggcagcattcaaagtagtccatttggtgtgtagaagaaagaagggcattgacaaatattttggtttagatgaaatgaaaataatccactagaatgcttttttggtagcaaagcaaataaaacctttgcccacctttatcagtaatttgataagtttactgtttttagttgttacaaaccaaacagagcgtgactgacatgtggaaaaccaaggtctcgctagctccatgcataccgtcttaagcgaaatatgcagcgagactacactagaattagatttttttccctcgtatcccgtgagatcagttgaagatgcgtcattttggtaatagagattgatttaattaaatgcaggcaacatatatggtcagaatgacgtctatactactattttgccacggtttgttatagttttctccacgagacaaggcgtgaccataggtggacgcaaacacacccctgctacttctgtggtatgatatcttgatttgtgttcatgtcgacgcggccaaccatccaatctgcctgtcttgcctctaacatgtccttaaaacctagctcttcaggggttaaggcagcaagcggaacaacaagagaagggatgccatggaggcaacaacgtcgatgatcccctctccctcggatccatctactccagcgtccccacgccacctctctcactgtccctattcgtggaccccgcgctgcttccctcgccaacgccagtggtcatccccacattgtctcatttgccgacgcagctagtggtctcctccacgcagcctcacttcatcatcatccccgctctctcttcctcattatcacaggtgccacaacctccttccccgctctctgtactagctcaagttcttatgtatgaataccaggaatcacctcactgtgtcactggcactaagaaccacgtgttgtactatgcttacattgagatgtgtcggcagctcgacccacaggggctattcaatgtctaatcaatcaatgcatctatgcataatttaattttgacgggtgaacttaacggatgacacaatatgagattatccttccttcattttagtatcaatagttaaaaatattttattggtcttgatgaattacattttgttggaaaattgaaggaccggttatgttcttttatgggacatgcactttttatacacttatcgtgtgttacatttattaccaatatatgttccgtacacttttgttttgtagttttgatgtggcctatttatttcatgattgcattcca

SEQ ID NO: 25843 - DNA, 330 bp, Oryza sativa
  unsure (1)..(330): unsure at all n locations
gccccgtgatganttcanatctnatacgccangcctgcagtctactttatagatccccctttatcaatacatactacgctctgcatccagatagtgcgcacatattactatttgttctccaaagaccacagatgaaattaaggggatgttggatgttacaaaatcaaggagcgactgcaggcatgtaaacatgagtatttagatgactccttgggctctaatcaaacatttaatttatctctttatttaagtcttagatgcataaagactacaaataggaacaacttatttggaaaaagttaaatgtgaaatatatctaacttttgtgga

SEQ ID NO: 25844 - DNA, 1501 bp, Oryza sativa
tagcatttcaaggagcctattatggttagacttttcgattcaaaatcttattatactttctaattaagttgaatttgttcctgtgaactaataatagaatgtatctgaccaggccttccaagggggaaaaaaagatttatgtatctgactgcgaaagaaagtgagaaggtgaaaaggttgcatcagaatcaacaatcacttagacaggttaaaaatcatgacaaatctatattagctttttccgttgtaacttgcgggcattgtctttagtagttctctccgttgcaactcacaggcattttgctagttaaaaaaagaaaacaaagcaatatcatttttgcatcaaatacttgatatccatgcaaattttagctgcaaacttgtttattttctatgaaaacttattgagtttaactttgataattgttctcgttttttctaaactctagtaataatgaatcccccccctccccccctaaaatgtctaatactacagatattcgaacagattttcaaagtacaaaaacgcacccattatgcccgttttcaaattgcatgatctgtaggacaccttgtatatatatatcaatatcaatgtcaaaattttcacaatcaatactgaaaccgattatattttgaaatagttggctgcaattttttttggtgcccctgttacaggatatgcaccaaactcaaaaccatacctgggatggggggcttggcaattgttctccctcgtgggcttgtggcccggccaacaacccaaccaaactcagccaaatccatctggaagcacgcgctttcccccttccccagataacaaattcaccaaattcccccgcctcgaggaggaagctaacgaccgtccggtcaatttccaaccgccctctacgactgccgatccttcctactaattcctatgcttggacagttggacatccttgaattccaagagtcagccgcgccgccggccggtgccctctcccactcgtcttcaaacgtcccaactaaattatagcagccaagagcgaatcgcctctggcctctgctactttttcatcccccgcacggaaggatatctcaattgtgaatcgtatcgcatggtgtccggggaaaaggagaagtggaagagaagccagaagggagacgacgagagatttgtccgggcggcaagccaaggcggccgttctttccgtcgtgaacgcttcgtgtaaggttcggtgtcccatctctcatgtccgtttcagaagaaaaccgtattgctgtgttgatgctaattactgatgatgctgaggttcggctatcctggatgcatggctagttcttagagttctagggacaagtacaactattgttaaatagcacgaattcaaggttctgagtatgatttctgtacttcttttgatggacaggcaaaacatccatctgatttatcttgcgaattggattgcttaacctaatctgggaattcaagtcagtacgtacgatatgccggcaccat

SEQ ID NO: 25845 - DNA, 1501 bp, Oryza sativa
acgatactaactagtatcccgatcctgacaaccttggctgtgaattgaggggaaaaagcacagagagaggaaggaagctgtgagctgcaagctgtaagccgtggcggagaaaacgttttggacgccgtgcgatagattttctgttgaaggatatatacatgctatcttaggcattttacaatgcacctcgatatatttttcagtaggacacactaaggatgtgtttggttgctcgcatccttctagcctggcccatctcccagattcgggctgagcttagcctggttaaggacatacacatgcaggtatttgtttgtctgattggaactaaactggatatggctagatattgtttggttggttgcattgaagatactggatgtagaagattttgtttggtaggtagtatgaacttccagtgcagtcacctttttatttgatagggtgagattaccccccacaatatcatatatattaaaaaactatactaatatctaatttaagcaattagttatattttgaccacataataaaaaagtgcatttactagactttaagcacggtatacattatttttttctgaagactacagtaattcacttggatatacagagccggtgaattaaaaaaaaggggaaaagaaaaggggaaaaaaaaaagagaaaacactaagcttcgtggtctcggtgagctcgcggcggtgcaaaaatagaaaagaaaatgaaaaaaaaacaaaaaagaaagcacgaagcttcgtggtctgggcgagctcacggcggccgtgaactcgggaccgccggatctggctgcctggccgctggagggaaaacggatggtgttggtgaggggatggatggcgatggcgaggaggggattaagggcgacagtgcgacacagaggaagaaagggagcgcaatggcggcgacggtggcacgctgttggccaccaaatctggcaaagaagagaggaggaggaagacgatggcggcgcgctgttgaccgccgaatctgactgtggagattatggataccccatacctacacggcatgtatagtccgactgggtatggagtgccatgtatagatagaatttctttaggaagactcgggttaaattctaaacttgtgtatcaaggaaatacccgagatcctagtcggttacgattgtattttatctgtaactatatatttcgttagggatatggactgtattttgtaatacggacccctttccctatttaaggaggggtccgggtgcctctaggggcataactttctcccagatcatactatcaataacacactcggtggatcaatcctcggacaggagtagggtattacttcttaaataagaaggcctgaacctgtataaaattccttgtctcttaacccatccacttttccagcttgatagccactcccttttagtattgccgaaatcttgtttcgacagttggcgcgccaggtaggggtagcgtcaagttttttgccgactagtgcga

SEQ ID NO: 25846 - DNA, 331 bp, Oryza sativa
acctaaccacatttattgcggtttggctgagcgcgtcatgccgcatgtaacgcagtgcagtgcactcgtttatccggtctgtgaccagtcacagaggtcagatcgcgggtttggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaa

SEQ ID NO: 25847 - DNA, 204 bp, Oryza sativa
tgcttgttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatt

SEQ ID NO: 25848 - DNA, 1501 bp, Oryza sativa
ctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggtatgccccattgccatgctaaaagcctaaaacagcacaaccaactggcaggtccgcataataactaatatatcaaacaacttaggagaaataccagttaaattgcatatgtcaaagttggtgcccacaaaagcacctctagcgaattcgagctcgttacacatatagattgcataatggattagaaacagcaataaaccccatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaa

SEQ ID NO: 25849 - DNA, 1501 bp, Oryza sativa
aataagcctggtactggtgtaatctcactattaataatagtttatcaaatgtttaggtttaaaaaattagtatgcatgcataaacgtgcgtcaaagccatagatctggatcctctgcagtaatgcagaggctcattattcatgcgaactgtatttattgtaatccactattgagtaccgaagcgcatgacatgatctgctcttggtcatatgcattacaaactgtaatccagaggatcccgatttcaaaaccaccaccattctttaaacttattactatccgtttctcaagtagattctcaagtagatgatgtcttaaaattaatggtaaaatcaaatattaattaattagttaattctaaaatattaggagttgacacgtgaaaatggtatcagtagatatttgtaaaaaaaactttcatataattattgtttttatagcttgtaaaaaatatgtttagaaaaagtaatgataaaatatgtaaattatatccgtatcaatgtctaaaacggcaagtaaaaaagaataggatgtagtatattttataaacttatgctattgtaaaattggaggtttaaccaatattttttctaaatgttaaatatttacaaccataaggtatacacatggaagtgaagccacgaaaggaaggtataattgtccattttggatgtaaattttactacatcttctcaaattataaacatttctggacatccaaaataagacatttttgactatatgcattctcgataaacttctacaaggtagtaataaaatactgagtgaaaatgtgaataataacatatataattgaaaaaggaaaacgatggagcaacaagcaacacttattatctaaaaaaaaaaacaagcaacacttgcctagctgttttgacgtgataattaggatcgggacatgacgacgactgtggagcaatcgacgcagggaggcagagtgcccaactgcccatgcagctgcgcgtgttcctgccgtgctgctgtggtagttcacacgacaggaccacgtattacccgtacaaattagcaaccgcgcgcgcgctgtcgtcggtcccgcccgcgcgctgcccacaccacagtgcagtgtcgccatgcatccgccggcgccggaccacacagcaatcggttagctataggattcctttatctaattttgttgattttggcaacaaaagaagagaaacacatatgcataattctggacatcgatctccctgggcctaataatgcaagcgtaacgctgttgacgtacatgtcgtcatatacgcatgtcctcgtttcaattcgctccccacactcaaaggacaaagggctcttaggctcttattaaaaaggcggaggagtttgtgataactcgcacggcctatgcgtacgtagcaccaggagctagcaaacactactctttttttctttttttgcggggaagctagcaaacagtactactaaccttctgcttatatatcaccaacaaatactatgtcgg

SEQ ID NO: 25850 - DNA, 1501 bp, Oryza sativa
aaaaatgaacctttttgccatgccatttgtaaccggtgtggccaaactaccttgccacaccaccggtcttggcatgggcaacggtgccccatggcaatcattggcattgacaaggtcaagccggcttcgacgtagcacctattgccacgtcaggctccgtgacatggcagctgaaaactgccacgcccagctcgttgccgtggcagttcagctagccccatttattttgtgtctttcaagaaataatttccattgttcacttagaaaatttcatgtgttaggattatttgtttattaatttcatgaccattgtggtttatgatgaacataacaagtttgtatttagaaaattggtactattagtaaactccatagtaatgaatggtttggaggaatccattttagagtggttttgatggacttgatttatctgttgaagatatgaatggttcaagcatattcgattccttgttctttgttttcactgcaatttaaaaggacagaaatggctaaatccattgtaagcaatcacctaaaataggaatttcaaccaagacatctttcgtcctcttaagattctgcaactcttcctcggtataaaatgaagttgggccttcatcatctaaggaagatagtgatgaatagtcatcgatatctccctactgcccgtcctactcgaaagacctagggtcggagtcatcattcacaattgcaatggtaccattcaactgcaccgcacaaacatttttagatctcacatgactatattttgatgatttgcttttagaagtttttttttgttgcaatggatttaaaatgttacaataagtattttaggatgtttcactatgtcattattgaatgttgcacagggtgttctttggatgttgtaggaggtatttcgcgatgtttaattgtagctgatgtttcactatatcatttcagaatgttgcacgtgctatttttggggatgtctcgggatgtattttgtgatgctttaatgggtcattttagattgttacacgtgctattctttggatgtttcagcaagtattttgtgatgtttcatcggttataactcaatgtttcatatatcatataaaaatatttctgttacgaatattttttatccaaaatattttcatgtgggatctctctgtaaaatttaattgcaataaatttaataatacaatcagatcacatatcggataattaattcgtaagaaaaaatagtttataatttgctaataaagtgcatatgtgggtggggaatctaatgatgcatgaatgtggaggtcccgatttgttgtgggctcgtaaaagtagatatgccgatatccctttaaggggaaaaaaagaaagtcccatttgaaacaatttattgttgtctatgtgctatgcagaacatctatatacttcatgtcatgtcacgtcagtgcacagagagtgggttgaaacccgtttggacctatatgacacacatgataagtttgtggatcca

SEQ ID NO: 25851 - DNA, 1501 bp, Oryza sativa
gtaaaattcccgtcacctccgataatctccccggccgcttccgtctaatcggcctgatcaaaaggccgaaccaacccacaacgactatcccagcatatttgttgtcctctagtataaaggctagctgtaccagtacgttgttgattacccttctaaattcctctgatgtcgctgcaacctgttagggttagttctttccatctaatcctctttcaaatccaatctaccatattttcttgatctcaaaattcattttgatgtttcatgtatatctcaaatagcagttttgctatacatttatcaacaaattctccaaatttttttacaaatgtaaatatagtgtaatggtagtgtaattacgtacattgtaacttgcatataacacagtataatttgtatgcaactttcaaaaatcttacgataacattgctattttcatgaagcggaggtcacgagaccaaatcccctcacttgtgtgcgttgcgacttttatatatcttctcagcttgcaccaatcttaaagcaaatctaacgatttcaaaattacgcgaaagttattacactgtagttattacatgtaagttagttagaatgtaattatagtattgttatactatatttacatctgacaaaattttagaagaaaatttgttgacaaatgtatagacaatccactcaaatagaagaacagaagataatccatatatatttttttaaaacaacccatacaagatagtgcgacatttatattaataaagtaggaataaaacacaagtctataatcttggaagactatagtaagaaaaaagaaaatatgcatccacaccactcgtctatgtctgatcttactgctaaatacaggacaagcacacaatacccctaagaaataagtcttctaaacgacgcctccaaggaggaaacgatgccaatagcttcgtcaccgcctgtcctagagatccaggacgtggtttttgttggtatttcttaacgacattactagaaatataattcccagcaatggcgcagaaatacttctggtatattatggttacagagttcatccgcaagcgcacggatataccattgtagcatttcacccgagagtattccaagggtatcatatttattttatcccatgggaagatcatgtagagagaactcaactaataatttatatattacatgtgataatcatattctaagcaggggttaaaataatccaagggaggaatggcacacaagcatttctactcatccttataataaataatctaagctaggtggaaagaaaagagaaagagaatcaattcctatacttctaatatacatagtatacatacattctagttaattgatatactagctaataccctatatccgatgctctcctggtacttcgagaaaccacccctgactgccgagttccttacgacagcccgtcatggccatccaaccggggctaaatacagaggaatacccccctaggaaattaacttaggat

SEQ ID NO: 25852 - DNA, 1501 bp, Oryza sativa
aacgcgcaacccacgtccgtggatcgccctaactctctgccgaacgggtcctttagaagccctaatggattggaaatgggaaacacgggccaaggccaagcattagatttcatggaagctggtcgtagatatcaataacgagataaaaacctgctactgttgtagcagacatacctgacgtactttttgatagactgagaattatacggagacctttcaggttcactttggtacatataccgtgtagaattgttacttgtacatttcaacatgatgatgttagctatttctcatgtaaatctataccagattaaaataatgcacctacatttgggtatccggaagtatgcctgacagtagatggtcacattgtcgcttggcttatcatacagaatagggtttggacctctggccggcttgtgaccagggggttggaaaaataatggcaggtgccctctctgcatataagagaagatgatacggctttgcacctcgtcgccgagtgcaggtatacgagaaggatttgaaacctcgttgcgacatgggtagggtttcaccagctagaactccgacgctgggggtggtgcaaccggtcaaagattggtggaaaatactggcctctgtgtctggcgtccctaagaagggactctgcaccctgattctactcatcgtatgggaagtttggaaggtgcgaaataggaggatatttgattataaggaagccacaacctcgtatctcctttcaaagataaaagaagaggctggcatgtgggccttggcaggcgccaagtgtcttggagagatcatcccgcagtttgtatagtgtacagctttccttattttttgctttttctttacccttaggggttgtattttttttcttgctatattcaatgaataagcacattcttgtgctagttcctttcaaaaaaaatgcttgttttaaaattgagcataacacataagtgtgctaatgtgatgatgtgaaacaaacatcagcttgtgttcttaacataaggatccataagaagggctattgcttggagttacagtgatcataggacatgtttcatgaggatccataaaacaagcagctttgagttacaatgatcataaaaaactggaaatgtttcactttcatgaagatctgaacacgtctcaactctgaatagcctggaacggggttgcggcttaacatgcggcccgttaactctaggggcgtctacggatcgtacgttagggtggttaaagtttttaagcaaactttaaactattttttctcctaaattatatatctaattcatgatccgattgcaccattaaattcgttgcaattaaaattttaaaacaagaccacatatggatatattccgacgaaattttttttagcttattattgaattatttttaaatgttgcacgatgttccaccaagtatatcggaattgttttactaagtagatcgaaaatgtttcaatcatttaaattgggcgttgtttcat

SEQ ID NO: 25853 - DNA, 1501 bp, Oryza sativa
tgccagcaactctctttctttcacacacactataatttctctctctctctctctctccgtacgtggcgacgttggagtctactacctgttggtgactagggcctgacccatcaatcaccagtggatcacctcgcatccgtacgtcgtcgtcgctgatattgcaagctcgtagtagcagcatctccatctcatctcccgtagattttgcacggaccgatcaggaccgatcagtgcaacagtactagagagaggcgtatcattgccggcctcctgctccaagctatagtacccgatctgatactactcctactactacaagtctccaccaattattcttccagaaaccccagcgccgtgttccaatcaaagattccaccggctgcctggacgccgttttcgcctggccgggagggccggtcgtcgaaacaacgttgattccgctgggttttcgttttcgcccaggccggccgggtcgtcgtcaagacaacattaaacggtgcggtttaatgtcgtgacatgatgggttctcgtcagtctcctcgtgacatgatggtgtgtgcatatgccgcatcagcgcagcagcttgattccaatggccgtatcaattcgagatcgatcacagcaagattcagatatggccggtaccattgccaacaatcctacctcaggctgagctggaggtagctgctagcctgctagtggtagtgtactcactaccatggctagttactcctagtatcaagcatgatatactggcactctgatcacctctcgacgtcaatgtgttgcacatgccaaaagatcacgccttgcatgcacagctgattaaactaatcaaggcacgaacaggcacctaaccgggctcatctggatagctagagaccaccacccaccataccataccattccttccccccagcttgcgatttgttgcaatgcggcgccaggaccagcaaaagcatgcgcgataagcttagatgccgtgggaacagagcagtagtacttgcaacgcgttgcttttgttcatttccagatctctctctctctctctcactctctctctccttttcttttaaattttcttttttatcttctctattggcgagcatatccctgcaaaagtcactgtttccggcttcccacctgttgctgataagtttagcatatcatgtctacagctacgtgtgtcagtgtgtgcaatttgtgcatgcataccgccatgggcgcgcccatcagatagctccaggccaccacgagctttccctttccaatcaaacaacaaacatagggcaccccccgggacatgcatgcacctggggcaaaggtgcaggtagagagagagatcatcggtctcggcacacaacacgtcacgtctcgcggactgcacaaacgcatcagagaagctaaaggagaaaaagaagctgcagatggggaaatatctccattggttgtggttaattgacatttgacagatatgatgatggataatttcaaatgtttc

SEQ ID NO: 25854 - DNA, 275 bp, Oryza sativa
atgggcccctgatgggccatctggtgatcgccggccctgtaggccttaggcttgatgggccggaaaggcttcctcggccctcgtgggggcgaacttgctatggcgaagtcgtcttccttcggcagatagtcttcgccttgcacccttcgcttgagacgcctctggcctggcaaggcactcgtacgactcttcgcctcacgccgttcttgctccatagccttcgccacgggtttcggcagatttagtcgaagggcctcatgccatccgccaacaga

SEQ ID NO: 25855 - DNA, 1501 bp, Oryza sativa
tttgttaaaaatataattgtgttccacttaagatggagacacatatatatactagttcatgtgaaaaatactgttcttgatggacagaaaagtaagagggggagtgctttctcattggctgcaagtagctgaaataaaaattcaaggctagggctggttttgtttagttgggatgtcggagttttgagaaaaggacatgcatgcacccggctacctgccatctgcacacagtcccacacacacaaaaaccctaatcttttcactggagacagtagtacatttccatcgggcctaatcctaattatcatccacaacaaaactacatccacccactctcatcaccatcctaatttaggaccaacatcacaccaataagttaaaagtagtggaacagtaggacgccgtatatgtctcttcttaaaaagtaggtatcgtgtgtaaaatggtcatttcagatgaggttgtcactgctgtagatcgacatgttagattcttactagtcgcgttcgataaatattaacaaaatgcgggtaccagttctcatccacgactaaagagagcgattatttttttacaccagtcatcagcacaccaaacagagcaccactagctcaatagggggaccagtctaagcttgtgatcttaaatagaaaataaacaaataaatgaagccttcaccgaaacaagttaatatgctaacctgcaacgtacatgataaactatatttccaacatttgaattcacatggcaaacggggacccaaagtcaaaataaaaccgcaaataaccccggggaggagcatgcaggggaggatgggggtaagaagaggggtgtgctccttgggaagaaaggccacctaattaattaagtttttgcttagtttatagtggcacccaaagtctctctctctctctctctctctctctctctctcctctccatcaagtcttcatgcttacatgtccacctttctccctcccctctcttcctttcttataccccacttgccctcctcttctcagtttctaattaagcagaagctactcttcttcttcctcctcttcttcttgagctgtccaagctagctacacctactaaacctccacttcacatacaagcagctaggttcaaacctagcttgcctagctaagcttgagaggaagagggtttcacacagagtgagcttctacctctgaatcactctacctaagacaagttagaagagagatacatcaaggtatgcagatatatgtgtgtgaattcagatctcctcaaatttatgcatgcagcaatctccttttcttgatttaagttgatctcttgttgatttcttgtgttctactgcaattgcatacactaatatactattagaggtagattgattatgttgtattattagcaggcagctgacatgtgtctctgcagcagcagagaagcaattagttgagagattaagcatgcagtgcattaattgtgcttctcctggagcagggtcaagctgg

SEQ ID NO: 25856 - DNA, 490 bp, Oryza sativa
  unsure (1)..(490): unsure at all n locations
ccgcgcgcngacccactcgcctngacngcgcacgcaattccttgggctgcgcctcacgcttggcctaaaagtctgattccggtccctcctccattatctttttcaagggaattaataattccttttcctttagacagaaaatcaaataatccttagaaaattcatgtctcccgattcgtaacaccgattgactccgttccacttccaataattccgtaaaattgagatctatccaatggaactattaattagtctaaataggatctttcttttgctcttttgtttaggatttcgattgtttgcgtatagttgcggttaccggattttcgtcaatcgtggatttctcgaagattcgtgaagcttcgtgaagaccttgagcaaggcaagtcaccctttgaccaattgcccctataattagaaaatcattattattttgtttgcaacttgctttattagaatcacacgttaacttgcttggcctcggtttgcg

SEQ ID NO: 25857 - DNA, 435 bp, Oryza sativa
  unsure (1)..(435): unsure at all n locations
gctgtgcattganagtcgagctcggcacccatataagattactttatttgtaattagacttagtatgtaattattgactacggaattggtgcgacaagtagcaattgactattgtagtcttaattagacttagcatatacgcacgaaacacttagcatatacatgactattttagtcttagcatgcatgtaatattatttgagttttaatataagattattttatttgtaattagacttagtatataattatttactagctagggttgtataatatacgtcacctagacttagcttatatcatgatttgtaattagacttagcacgtaaggttgtgtagggttctaatgtacgacatttacacttagcatacatgacttagattgttaaaacataaatgtctcgtaacttagcagatgtttcttgtatcaacaga

SEQ ID NO: 25858 - DNA, 392 bp, Oryza sativa
  unsure (1)..(392): unsure at all n locations
ccccaaaaggaggggtggtttggcccccccttgggttccccgggttccaangaatttgggcggtgtgtgcattagttagaccgaccaacctgccggtatgacagaccggctctgcgtcggttttggtttcgggtcgtttaattggatactcgtgattaattcgtgtttatgacttttagatgattcctatgcatatgtaatgttgttgtgtgctcatgttgagtaaagttagagtgaacttgtgctcaaatatggtttcttatttgattcatgtgtaggtgagtcttgatgcctttggagagcattgtcggagatggatcagtagtcaacttgggggaagattacgtctgaacgatcaggatatcttgcggggtgcttaggctgaagatcaa

SEQ ID NO: 25859 - DNA, 275 bp, Oryza sativa
  unsure (1)..(275): unsure at all n locations
aggaaggcacgccccttttttggtncnaaggntgggggcccgacaccccttggttttttggcccccagtatatgggtanggtaagcacagcggcgctcacctaaccgcatttatgccgggtggacgagcgcgccacgccgcatttaatgcagcgcagcacgctcgcttatccggtccgtaaccggtagcagtgtgtgaccggtcaccgatcggtcagattgctggttaggtggtaacaggcggcctgtcacacgccttgccccgtcccgtcggaa

SEQ ID NO: 25860 - DNA, 734 bp, Oryza sativa
gcccgcgcgccgccccttcctccgccgccgcgtcgccggtcgccgacgccctcctcctctcccacctcacagactcgctgtcggagaggagagagagagagatgaggatgagaaagaatagagaagagaggaaaagagagagaagattgatgtggcaatgctgacaggtggggtccacgctaactcatccgcaacgtcagacaaaaccggggtcaaaaccacataggatctcaagcgaacggttttgctaattgagggacctccagtatcttagtattttgttttgcggtttggggacgattttgtaacccgatgacaagttgtgggaccttcggtgtacttttccccatagctgagggagaaaggatgagtgggcccatttatatcggcggcccagcaaagtgtactaggccgtcgtccccgagaggccgaaaaaccctaaatcccatcgccatcggcaacgcacgccgccgctaacggcgaacggcgatctggtctgattctgatcttgttcttctccacaatggagtttcttgatatgacttgccgaaatagcagtcgaaaagggagtgggggatttcgatgtccgagagccaatttcgcataggatccggcccggccgaccgagcgccttcatccatatttatatatctactagtatagaagaaacacaagaagatcgccaacacatctgattccgatctcatccaccagcgcccgcttcaggtcatcca

SEQ ID NO: 25861 - DNA, 177 bp, Oryza sativa
  unsure (1)..(177): unsure at all n locations
aaaaggggggggggggtgtttctcccccccccccgcgggtttttttaaaaatttcacccgaattggaatggaagaacaananttgtccttgcaaaaagaccaataaccactagccggatcccgtccatttgtgacgggcccttacccctcacttttacgnattttggtctggttaga

SEQ ID NO: 25862 - DNA, 1334 bp, Oryza sativa
agtcatccatcccctcaggcgcattatgggctccctttttccggaggggcagccgtcgcttcaaatcggcgcttgccattgatgatcgatcatcgccggtgcccaacggtacaccggggtcgttgtcctagcctcacctcgcctcctccgatttcctccgcgtcgctataactcggtcgtctccctcaccggtctgtagtggccattcggcatgccatgaacgtatgtcaacttccccggcaagatgacattggtgaaccgcacacgccggctttgcgcacatggcgaggggcagcggtccggccaagctcttggtgaatgctggcaacaccggcatactacgcagggacccgtttggggagggagaggagataagaagtaggggaggagaaagaaaggagacgagataaggtaagaactactgacatatggaacctatatgttttgttttcatttctttcttcttttgtttaatttagttttcagtggcacgtcaatgttacgtgggacaagaagcaagacaaatcattcacgtaagtcggttctatgagttaagagacgttatatcttagtattgcgggtttaaggacatgattcaaactacaatagccacgtcatgctgaaaacataggccgtccaatttttcctccaagcattgtgagcggttggatcctacaattggtgaaagctcttttcggtccttccagaaacttgttttgcaaacatgtcctcccacatcccaagtcccagtagaccacccccatccaccgccgcctcctccccattccccacggcaaccgcttcctaaaccctccccaccgccatcgcttcgtcctcaccggcgtgatggatggtgttgggggagtcgccaaatgtgtcagctgtctcatcgagcacaccgactctgccttgttgaggaaaggagacacggatgatgaggagaagacgtctccttcctctcactatacacacgggcagcataacctgcgccatgtggtgccgcctcctcttcgtaccaacaagcccacgcccctttcgccaccaatgtcatcttccctgattcactgccggggcgattggagtggagaatcccatcttcgtcctcctccatccaggtatgaaagcccaaatcgacgagcactgacttagggccctgtttctttcagcttaggattattataacctagattattgagtcagattactataagctagattgttataatcagtagtagaataagcggttagttgtttcttttctagattattagagcttagattattgggtttgcaagtctaaagagggagtggggtagcatggtgggtaatttttc

SEQ ID NO: 25863 - DNA, 1501 bp, Oryza sativa
tacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcagaaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttaca

SEQ ID NO: 25864 - DNA, 1035 bp, Oryza sativa
aacgagggaacgaacgtgaatgagaacaagcgaacgaacgtgaatgagaacgagcgaacgaacgtgaacgagctagggaacgtcaacgagcgaacgaacgaggacgaacgttaacgtgaaatgcaatatatatatatatatatatatatatacatgtatatatatatatacatgtatatatatgtatatacatgtatatatatgtatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacaacatttacacttagcatacatgacttagattgttaaaacataaatgtctcgtgacttaacagatgtttcttgtatcaacaga

SEQ ID NO: 25865 - DNA, 234 bp, Oryza sativa
ggcgaattcgagctcggtacccccatatgtgcaattccgaagcattgccaaacaaaggtctcgtcttctatccttgcccatccaagtcttctcgtaccaactcagtcttacttgcaccccctcaacgacgagaagaatatgtcacaaaattattcttaatgtaatgaggagacttgtttaggtgaagaacttctttcactcgtgaccttagcttccacctctccagtggtgagt

SEQ ID NO: 25866 - DNA, 1501 bp, Oryza sativa
atttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacagcaccttgactatataaaaaagtcagtaggccagctatgtaaagctttactgtttgacaccttttaagatgcattgtaccaactcctaaaaag

SEQ ID NO: 25867 - DNA, 688 bp, Oryza sativa
ggtttagtttaattaggtggttaattacagcagctagcacaggtgcatgctattgttagaaggtgtaaataggcagtataggagatggagcacaagaagaaaggttaactggtggccaaggaacgggcacgccgagagtgtgtgttaaaaggctcccttttaattacttgtggacgattttgatgcctggctagctccctctactagctgcttttaacttcgtgtgccaaatatgtttttacatcattattagacacccttaatttagccccttgcttgttttccaaatgcttaattacttaccctcttgaattaacccatcaaagtgtatgtgtgtgtgcgtgagtgaggatgaagctgtgcctactcaactattatactagtatctatagttagcatagctgttgttttctttttggtgatgaattcaagtaatatactccctttgtcggcttcatttctagtatttttcagataaattagtaatgatgagaaataactatggtgtctcttattcatactcctggttgtatttactaattaagctccaattaaatgccttagtctgattggtttgaaccctttgaaatctaagtttttttatgggatgaattttaagcaccagaaattaagtctttctagaacggagagagtagacagaatagatagagggagctaggtgacaaca

SEQ ID NO: 25868 - DNA, 872 bp, Oryza sativa
tggaatgtttgtacctactcggtaccccacatatttgataactggtaaccaacagcctgctaccaacataacaccagttcaaccgacggcaccagttttggcttctgcaccagccgcaccgtcgtcagcaccaaggcaaacaaccaatcctcgattgttgaccagagaacagccacagcatgttggacaaaatatcaatcggttgacccacgagcaggttgctgcgatgtttctaccaaacccactggtggccaacccagcacagtcaatgccgattcagcaaacaccaccaagacagcagacggttctgccgattcaacagcagaatttgcagcatacatcggctgggctaggaacacctgacaatcggtagaggcaacatgttgtgaatcaagttatccctgaacacttggtccataatgttcaacaggatcaatcggtgttgccccaagttattcctgagcatttagtgcataatattcagccgaatttccagaattattatggaggtaatttgagctatcagtaccagcctccattgcctcatgttcagtatcagcaaagaggatcacctcagccccaatttgctcctcaatttaatcagttcgagccgattccacagcagatgcaaggagtaccccagcagagaccttgggccgacatgattgcagatgtgatgaggaagcagtttgggctcaagccaaaggactatggaaacctgtatcagcatccataccctgagtggtttgaaagggttccattgcctggctgatacaaggtaccagacttctcaaaattttcagggcaaaacaatgtttcaacttatgaacatgtcagccgattcttggttcaatgtggcgaggcatcggcta

SEQ ID NO: 25869 - DNA, 1501 bp, Oryza sativa
cactggttcagacatcttagaccgggcaaatcatttttgtatacgtctgatgatgaatgactcgctggcgatttagacaggacagacgctgaaccagaattggacaaaacaaacacacacatagcgccaaatttcaataaaacctttccaaaatttgatactgtcaatatttaggaaggtaaacgtgtagtataagttatgttccgtacctttgccacgttctttttttttgtgaaattctaggattaccagtgcaagtaatttttagcaatgttttgattgttattactaccattttgatacagcaaaattttggtagggttaatcttgacaataaaataaacatcccatactatataacatctactactatatctataatttcagctttctagctccgaacgcagtgaacctatgttcattctcagggtgcaaaaagtagtcatttcatagtaggagcgaattttagattgggttatttataaggctaagttttaatttaaataactgtatatatccaattgaatgtacacgtcagataaataatactcctacctttctctctcgaaaaaaaaatctgtagccatttcgttcagaatcacggcggaccgccggtcgaacgctcgaaccgcattgccagcgtcggcgggagggacggtggcgtggaaagagtgcgaacggcccatgaaaaaccggcccaaacatacgggcctcacgtgggccgcgactcccttgcggccctcgggtttagcgcaacaaaaccgacgacgaatagtaaacgggccacaacggtctccgtggtcgtcgccggcgatagggaattgtgaaggctctgcagcctcactgccactgcggcttctcgccaaagatctccatttttttttattttttgcctaagaaaactaagagaagtactccctccattttcagtttataagatattttgactactactttaaatttgattaaatttatagaaaaaataataacaactctaatctaagataaatttattatgaaaatatatttaattattggttagatgaaactaatttaataatataaatattattatacttgtctataaacttagttaaactttaaactttaaatttaacgttttataagctgatacggatggagtaacaaacataaatcagttgagagtgagagggacgtggaaaagtagagccatccgcgctaaaagagggggggggggggggggggtgttaagggaggcaaggtaggcaacgccaagaacggcaaatcgaggccgggattgaagtgcggcaatccagcaaccaaaccccttccatcgccatggcctacaccgagcccctcctcctctccgcgcgccacaccacccaaacctccccgcgccaccacctcctccgctcccgccacgccgccgccgccgccgctgacggtcgtatggttgtcgccgtgcaggacgacgagaccggcgcgctcgtcgccgctgttggcaagggcgatgaggatg

SEQ ID NO: 25870 - DNA, 1113 bp, Oryza sativa
  unsure (1)..(1113): unsure at all n locations
aggcttttcaaggtttatnagctnccatcaagaagaaattttcatctcaggagtttgagagcttatcacatcttgcacagaaggtgactttacatgagcaaagatttgccgaagccaagaagaatttcaagaaaatcaatcatgtctatcctcacatgtatgattttgatgaagaaaatgattccgaagtagcagcagccgagtgggttagaagcaagaaggttgtgccatgccaatgggtgaggagttctggaaaagaagaaagaattgactttgatatcaccaaggctgacaagattttcgatctgttgcttcgggagaaacagattcaacttcctgatggtcatataatcccatcaaccgaagagctaggcgaaaggaggtattgcaaatggcataactctggttctcattctacaaatgactgcaaagttttcagacagcaaatccaggtagctattgaagggggaaagatcaaatttgatgactcaaagaagccgatgaaggttgatggtaatcctttctctgttaacatggtacatacatctggaaggacagccgatggggggaagaattgaaactttcagataaattcggctagaattatcaccaagtaccaaagaaagtatatcaagtagcaggaaaggtattatgaagaagatgatggtggttttgatcctcattgggactgtgagtttttcagattctgctggaatgaaggtatgaggctgccatcgatcgagaattgtcctggatgcagtgacactgcagggagttcaagccgatcctgtaatagaggtaatcggctgattcaaaagaggatacctgttcatcagagattgggacatgtaaatcaagattatcaccatgatgaagatgaagataggaaaacccaatggtgtctacaggcattttcaccaagaatcaaaaaagaatggttcaaagaataaggaacatggagcgctttcaagaagtagaacaagaaatcaatcatcggctgaggaaaacaaagaccaagcaggtgtggcgtgttaagagctcggtcacaacagccgatgaagttgaagctgataaagccaaaagggttgctcaagggcaaggctactgcgtctg

SEQ ID NO: 25871 - DNA, 449 bp, Oryza sativa
cataaaaccaaaccagcccaacatggcaggtgtactcgaatagttccgagatgggcatacagtatgtgaattcaagcaactaaaacaatacagaattaatcgctacttatatttccaaactgtgaggtgtataatatacagaagagactaggcagcaaacaagccatcgatgtaggtaaacaagcaactcatataatggaaagtgtttacaattcgacaaagaagctagcaactgttaaccagaatttcactagccatactaacgacagagccacttatacctagagacacagggataaaactgttggggtgatcgaagcccgactgaagtatatacaccaactgaagcaagcctatattacaccacagtagatgtaataatacgagtcttgccaagtctaagtacttgctactagcctactagtagagagcaactaatcaaacttgac

SEQ ID NO: 25872 - DNA, 1501 bp, Oryza sativa
ttgttccttattgagtctgattgtgttagtaactggagtagtcagtcaatcagctgttctatttatttcttatttttgttgggaataggattatatttcacaacatgtttggctgttgtcataactcaacaacgctggtgtgctaccctagttttgataattgtgatccttaggttacccttgaccccttgtctttgcctgtttgtttgtctcctcaaaagtcgaaatgactcgttttgctgaaagacaaagttgcttcctagtgagaggctgcatcttctgtccaatttgttgcatttccatgatgttgcctccaaaatcttgcaagtccaaagccaggaaaaaaaagcgaggctgcctactcttgtggggcgtggaaagtcacaagcatctacctttgcctgcgtggatgcaaccaatgccaagtaaaaaaaagcaaaggctgggcttttctttttctttttaaatgttacagcgagttttagctcccatttggaattcctatgaatatatcctatttgaaagcatttgaaattctttcaaatttggtgggcgagcaaactagtacgagcagaaaaaaagtcgaaattttctcaagatatatgtcgtgaatgaaataataatactggagtatcatggaggattaaatctgttttaccaaacgacgttttccctcaaaagtttgactagtatacaacataaatacattctgtggcatccactgtattgtctatcttcagctcactacgtttggagaatttacggagtagaatcaaatcttagaaattgcataatactccctccgtttcaaaatgtttgacaccgttgattttttaaacacatgtttaatcgtttgtcttattaaaaaaaattatgaaatatgtaaaactatatgtgtacataaaagtatatttaataatgaatcaaatgatatgaaaagaataaataatcacttaaattttttaataagacaaatggtcaaatacgtactaaaaaaatcaacggtgccaaacattttgaaacggagggagtacatctcaaaaatctctgaataaaatttatccgtagtagtatatccttccatatataaacgtaaattattaaataaaaaggtatattcgtaaaaagttttcggacagacgagagggcaggagtcttctacaagacggctaccgaggagtatgatatttcctctattattattttctttctcatcacgcggctgcgtccgtatcgcgacttttatcctctcctccccaactaactcggcgttcgccatctcgtgtcgacttcctcctcaaaaccctaattccatccaccgctcgatccaatctaccctctctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggact

SEQ ID NO: 25873 - DNA, 270 bp, Oryza sativa
tttagatatttagaaagaccaggtttacacagtagaatgtaattggtaaggattgggattcttatagaagggttttggttataacgaaggcgactggaggttattaatttaggtgacaatttttaagttcaggaaaaaatgtataattcttaaattcacggccgaatttttctgaaaaatcaatgcatgttgtttaaactagttatggccgctctttttgcttactgtgaaggaatttattattgttttgtgattgtttattacttcaca

SEQ ID NO: 25874 - DNA, 495 bp, Oryza sativa
  unsure (1)..(495): unsure at all n locations
cctgtnattgattgcattcgactcgtaccctgttttcctatacgggcgatggcccggctccggtccccctatttttccttgcgatttcacttacgacccgcttgaaaactaaacggtccagcgtccatgaaaatatttgctgtagtagtgggggtccgaaatttccgaaattgcaatccctgagttgtcgtcgtatcagtcacggtacatatactatgcgttgggactatttgataattaaaccgataacgagaaaaatcattagcacattaattaattaagttttaattattataaacttgataattgtatttaatattttaaagaaacttatatataaatttctttacgggagacatcgtttaatagtttgtaaagtattctaacgaaaataaagataaaaatatgaatcttactcagaaaatggaagggcccggtctcacattaaatactgcactcaattgcttccagccattcacgcattcgatcgcatca

SEQ ID NO: 25875 - DNA, 1501 bp, Oryza sativa
atccttagtgagcgctaaagttcatgttctaaataaataaagtatagaacaacaaagtaacatgcagaattttggacaatacagtatttttcccagggagtaactataaggaataggaaacatgttatgattaattattcttacatgctgcatcaaggttcattcaagaatgtgaaacttctgattatctatgattgttagctgaatgctcatataagactgtaaggtgttaatcatcaagaggaggttattttcatgactataatttgaaaagcaacaaagtacaaacataaaattttcatggcataaaacttcctatcctcaagggacgaattagaaagcatataaaaaattaatagatcaaaagatacagaccgttcccttttttatcttttcaccacaccgtctacaggaagtacgggcagatttagcaacctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggtatgccccattgccatgctaaaagcctaaaacagcacaaccaattggcaggtccgcataataattaatatatcaaacaacttaggagaaataccagttaaattgcatatgtcaaagtt

SEQ ID NO: 25876 - DNA, 770 bp, Oryza sativa
ccttgactatatgcattctcgataaacttctacaaggtagtaataaaatactgagtgaaaatgtgaataataacatatataattgaaaaaggaaaacgatggagcaacaagcaacacttattatctaaaaaaaaaaacaagcaacacttgcctagctgttttgacgtgataattaggatcgggacatgacgacgactgtggagcaatcgacgcagggaggcagagtgcccaactgcccatgcagctgcgcgtgttcctgccgtgctgctgtggtagttcacacgacaggaccacgtattacccgtacaaattagcaaccgcgcgcgcgctgtcgtcggtcccgcccgcgcgctgcccacaccacagtgcagtgtcgccatgcatccgccggcgccggaccacacagcaatcggttagctataggattcctttatctaattttgttgattttggcaacaaaagaagagaaacacatatgcataattctggacatcgatctccctgggcctaataatgcaagcgtaacgctgttgacgtacatgtcgtcatatacgcatgtcctcgtttcaattcgctccccacactcaaaggacaaagggctcttaggctcttattaaaaaggcggaggagtttgtgataactcgcacggcctatgcgtacgtagcaccaggagctagcaaacactactctttttttctttttttgcggggaagctagcaaacagtactactaaccttctgcttatatatcaccaacaaatactatgtcgg

SEQ ID NO: 25877 - DNA, 727 bp, Oryza sativa
cgctcggatcatcctgaccgagtggtccacccggggcggtaccccctggtactagaccctgtaggttcgcaacgtcaagcttcgcagatccctcatcgatggtggcagtgcctcagcatccttttcgccaagactctggacaacatgcagatccctcgcacggaattaaaaccgagtaatgcgccctttcacggagtcatcccagggctatctgctacaccacttggccagatcactcttccggttactttcggcactcgggagaacttccgcacagaaaacgtttgttttgaagttgctgatttcgagacagcgtctcatgccatactcggacgcccggcgttagccaagtttatggctgtcccgcactatacctacatgatgatgaagatgcctggtcctcgaggagtcatatccctgcggagcgacattaaataagccgtcacatgcgacaaggaaagctgcaagatggcccagacccgcgagatcaccctcgctcgagaagaaatccgactggctgcgtccacagcaagcgaaggagaagtgcctgcaaccaaggtgccaaagagcggagaaagcgacgccaagaccaagaaaattcctctagatccctctgatcctactaagactgctgtaataggcgctgagttagattgtaaataggaaagcgcgctcatcacctttcttcaaaataataaagatatctttgcgtggaaaccatctgata

SEQ ID NO: 25878 - DNA, 1501 bp, Oryza sativa
attgttattgaagaacatggcttggacgagtggggtagcagcgttggcgacttcatccctagccccttcaagccttttgattttattgaccaagacatcgaattgagcctgagacttgattttgcgatctgcgtaaatagatttatatcaacgagtaggcataaagataagaggtattagtcaccagtaccttcaacatctttcagagccgaatccctctgtttcgccaatttggccttgtcattctccagagtttggatccgcttttctagttcagatatcttggcggcttgcactgtattgcttcttgattaattgatattacaaggatggcagcataagtaagttagacatagattgtatttaccttttgacgaaccgctcagttcaaagttggattcttgaagctcggcgatccgatccctcagatcatgctcagttttcctggcaagctccttagccttgtgcagctggtttctggtggtctcaagggttccaagatgaggaactaaattctcaagagtcgcggtcttcgcctcgttcctgagatggattctctgcaatgcgaatttatcggcatttgagcaaagtgggaaacaggatagttgaagctatgtataaggagacttatatttacgatgcgagtagcctggctgagtgcctttttcagcaagcatacttcctcatcttccttttgcttgtttatcacgattccctaaggttgcatatcatcgtcccaccatttgactaaaataggtggacgagaatcctcagctgactgtatccggaggacttcttcttcgtcgccgaccattgggccttaggcatttatgaataaaggtgaaacaattgaagaaagtctgtcagatcaaaatgggttcggaggatgtgtttacttgtgattatttccggtcggggacgagtaggcccttgtaatttaacaagagagccggaccctagatcgacgctggcatcctttttaggagggctgtcagcttgagtttctacttcaggaatatctttgtttggttctgtacccgactggtttccagtcgggggctcctgattagcaccaaccccagtttcggccgactggttcccagtcgggggctcgttgctgggttctacattgtcggtcgccggttgattgtcactcgggtgatcttctgcagtcgggtgatcttcttttgaagaacccgtctccatgtcagtcggttcagagtcttttccagaaagatctatgtcagatggcttcctacgagtttgagttatgctatcagtacaaatcggagcgtcgtttcgtcttccccgccgagactctcgccactttccccatttcccgctacagtgcaaaaccacaccggcggaagctagggttaacaaatccactccaatccatcctcctgagctccacaaaaaccctccacgcaaccaccgcaccgaatccccatccatttccagccatatctcggaccaaatcacaccatccagttcgtattca

SEQ ID NO: 25879 - DNA, 897 bp, Oryza sativa
tagagtagtatttggtagtttagacgtggtgtctagattacaggatatcattatttggggttatatgctgtggatgagaggtgggccgctgatggcaatagctcagtacgggtattcttccgcgtgtgtatataatcctatgttaattcactgggaggggtattcctccttatttagccccggttgtatggtcataatgggctgtcgtaaggaactcgacagtcaggggtggcttctcagagtaccaggagagcatcggatagagggtactagctagtatatcagataacaagaatgtatgtatactatatatattagaagtataggaatagattatctttctcttttctttccacttagcttagataatatattatgagaataagtagctaatgcttgtgtgtcactctacccttggattattctaacccctgcttagaatatgattatcacaagtaatatataaattattagtcaagttctctctacatgatcttcccacgggataaaataaatatgatacccttggaatactctcgggtgaattgctacaatggtatatccgtgcgcttgcggataaactctataaccataatataccataagtatttttgcgccattgctgggaattatatttctaataatgttgttaagaaataccaaccagcatttctagcgccgttgaaggggaagattcataacagagattaactgaactaatactttatatttacctctgtataaccttggttgttttcacttttgttgtgaaaacagggtcgtgcatgactggtttcaacttgccgggaaacttcaaggaaaatctagaagctttcatccggagcatcaggtcgcgagtcattgctccgcagaaaactctaccgacagagaaaccag

SEQ ID NO: 25880 - DNA, 1501 bp, Oryza sativa
tcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttccttgaagtttcccggcaagttgaaaccagtcatgcacgaccctgttttcacaacaaaagtgaaaacaaccaaggttatacagaggtaaatataaagtattagttcagttaatctctgttatgaatcttccccttcaacggcgctagaaatgctggttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatt

SEQ ID NO: 25881 - DNA, 1501 bp, Oryza sativa
tgacaggtgggtcccacctgtcagcggctgagagagaggagggagggcgcggcggactgggccgaacgggccgagcacgcgcaggccgggggaagggagagagagacttgggccgactttcggcccaaagccaaaagggagattttaaaacctttttctatttaaattattcatgaaatgatattccattgattaaaaatacttccttggctcaaataaattccagaaaaatctaggaactatagaagcaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagatcattaattgattaactaattactgaactgttctttgtatcatttaggaattgagctctgaaaaatccgagaaaatttcagagggtataattaatcatggagaatttaataaaaattaaatccagccatgctttatatttaggaaattttatttcccacatttaacttcacttgtaaattaatgaacatttaatataaattctaataataatttattaaataatttataaatcctgaaacggaaatcaggctgtgacatcagctaccggataagtccgaaatggtggtcgagatggaaaagactatttgccatggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagcatttggcaaagagcacaattgtaatctcacatgtaaagctgtgtactatatagagcagacaaaaagcctgtagcagacaggacatcttggaatactaaaaatcttgtcactcagggtgtgatcatttggtattcgggctcatttctcaggataggcaggaaaaggggttttcctgtctatccccaatcttgtccgtgaccttgtgtcacgacaaattattttcaggatttttcttgaaattatttgagcattgtaattatttttaacaattcaaagatcatttccatgattaatttaaatggaaaagtaaataaaattcccttttccttttcgggccagtcttcagcccattcttcctctttgcctgcttactgtctccttctttcccgaagaagtctatttcttgtccctcgcctcttttcttttagcccagacaaaagtctgtttcaccttcctatcgctacagtactccttctatctctggacagaacccgagctcctgtgcccactgcc

SEQ ID NO: 25882 - DNA, 1501 bp, Oryza sativa
tccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccttcgtccaaaaacctaacgatgaagtgcttaaacactcatatccgattcgagcggaaagtggaaaattccacgcaacgaggtaaaacgtgatttcgacctcgtcgctccttcgaaaggtaaggaggacggcggttttcgaacaagttttaccttcgtccaaaaacctaatgataaagcgcccgaacactcatatccgattcgagtggaaagtggaaaattccatgcgacgaggtaaagtgcgatttcgacctcgtcactccttcgaaaggtaaggaggacggcggttttcgaacaagttttaccatcgtccaaaaaccaaaaaaacgatgaaacactcaaacactcataaccgattcgagcagaaagtggaaattccatgcgacaagataaagtgcgattttgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgccgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactccaagaggattgtgcggtgtgtgagctcgaagccaacgatgcttagagagaagcaagggtatcttcatagcttttctttttccagtaccaaacttgaaaagctttgactacagatcaaactgccgcatggtgttgagcaaactttgacataaatgtgcatattcaatacataaagaatatgtatacatataacaatatatatatatatatatatatatatatata

SEQ ID NO: 25883 - DNA, 1501 bp, Oryza sativa
tgtctgcaacggcgtcaccacaaatatccatccatgctcgtcatcagcagagggacatttctcgactcaatcggtgagacacggttacatttcgttatggatctccgtatctttctttccctcgatactgctacctaccatctcctcctcctcctctatagtattgtggtggtgtttggttggagggactaaagtggagctaaactttagtccctctcacaaaaatataagtctctactatagggacttataattttgtaagagggactaaatttagtccctagttcccaaacaccccctgtgttcggccaaactaaatttgggttacctcgtaaaacggttatcatagtaaccatatagttaccatgaggattactatgattttaaaaattaaaaaagattatcatgcgtgataatcgtgcggtttcttaaacctgttgttcggtagcagactgccagttgcagcgatttggagcgtctgattggccaaagcattgttcatcagttatgttaatcggtactagtaaatcaggggaagatcccccatctgatcatctgatgctccgtgatcactgctgtctcccccacttgctctcactaccgaccactgctgatgctcctcttcttgctcggtttctttctcccgcggacactgaaacccaacaacagccaatgcctatcaacaccctaaccacttgctgcctcccatggcgtaagccctcctgcatagctggcgtctttaccttcctcttcctcttcttggtgcctctctcggtctctcatctcctctcctctcctctccaggtgacaaattctcccatccatccatcgattgctatcttctcttccgtatttctttgttcattggtctcttttgcagatcaattggatggcatctttccctggaacccaatatcgatagcttcactgttgcagacaacaaactggttctgctcaactttgaggtagtaccacaaagcttcagaatttgttggatttgctccacctctgtcctgttttgggatccaaagtgctacagggattcactaattcgtcctgtattcactttgtgttgattgattgattgattcaggacggccgcccagttcgatgaatcgatccgtggatccaattctgctctgctgaagctttgatctttctggtaattcacgaaggcaaaggagaaaaaaagatgaagctgatgctggttttcttgtcctaattcctttgcctgctttgcttgcacatacagattacagatgatgccattccgggatgttgctctccacttggacgccaggatgcttccagggcaataaaatcttgttaagatctctaatcacatggtattatctcgaatttatgccaaagctgcggcctttttattttcttttttacttaaccttgccaagttgcgctacggattcgccgcctatttctgacaaaagctcctccattttcctcccattggcgcagcagcagcagctagtccactggatga

SEQ ID NO: 25884 - DNA, 1501 bp, Oryza sativa
cgaaggcaaaatcacattccaaccgtatcgtgtcagcgattagctcgatcacaattcacaaacaacatcaacacatgagcagaattttaacgaatactttcgcttttgcatatttacagcaaaacgttgattaattcctccagagctcgccgctccggtcgccgccggtgccggcggacgacgagctggcccggtcggagatggacgagagcggcgtctcgtcgccggcggcggccaccaccatgtccctgtacgtcttcctgaccgcccacagcgccctgcagcactcgcccatgctcggcctctcctgcctcacgggggcgaggcaccggaacgccagctccatcaccatctccgcggcgcgcgccgtcgccggcgtccgcggcaggtgcgggtccagcacgtccgccgccgcgccctcggcgagcttgcgcatcgcccaccgcgccgtcagccgctcccgcatctcccgcctcgcctcgatgggtcgccgcccggaggcgatctccagcagcagcacgccgaaggagtagacgtcgctccggtcggtgagctggcacgtcttgaggtactccgggtcgaggtaccccgccgtgcccttcacctgcgtcgtcacgtgcgtcacgccgtcggcggcgccggcctcgccgacgcccagccgcgcgaacccgaagtcgcccaccttggcgcgcagcgacggggtgagcagcacgttcgacgacttgatgtcgcggtggatgatggggtgatcggcgtacatgtgcaggtacgtcaccgcgtgcgcgacgtcgatggcgatctccagccgcgcgcccatgtccaagaacctcccgttgcaccctgcgcccaagaacctccattagtaaccaatccgatcgagctcgagctcgagctgcaatggcggatcacacgcactgtcgaggtgctcgcggagcgtgccgttggggacgaactcgacgacgatgaccctctcctggccgcactcgaggtagccgtagaagcggacgaggctctggtgctcgatgcgcgccatggccttcacctcgctccggaactccacgtccacgtgcgggttctggtcccggagcttggcgcgcttgacggcgacgagcgtgccgtcggggaggacgcccctgtagacggcgccgaagccgccctggccgaccttgagcgccggcgagaagttgttggtggcgcgcaggatctcctccatggagaacaccgagctctggaactgcgtcgcgatgcctcttcccctgctgctgttgtacagcccgcgcatcgacgccttcccctgatcactgccaggccccggcactggaatcatcaaacagattcatctatcaagaattaattcccaactgcttaattgctgctctgaattttgaaaaaaatgtttgaagtcttctgtgattcagattttataaatatgattctgtaagctttgcactagcaattctgctccagaaagtaaagaattcagagtagttgcggcaattgg

SEQ ID NO: 25885 - DNA, 1501 bp, Oryza sativa
ccggatgcgggagagggaggggaggtcccacggctcgaggcggtagaggtcgacctcggcgatggcgtcgatccggaggcggcggccgaggatgcggcggcggaggtagtaggagacgagctcctcgtcggtggggtggaagcgaaaccccggcgccaggggcaccgccgccgcggaggaggagtccggcggcgattggctcatcggcggcgaggggaatttcaatttctggatggatatgatattggagatcccgtgggaggggatcaatcccgcataattctaattctgcacggaggattgggaattttgcagggagaattgagaattgagaatcgagagagagggtagattggatcgagcggtggatggaattagggttttgaggaggaagtcgacacgagatggcgaacgccgagttagttggggaggagaggataaaagtcgcgatacggacgcagccgcgtgatgagaaagaaaataataatagaggaaatatcatactcctcggtagccgtcttgtagaagactcctgccctctcgtctgtccgaaaactttttacgaatatacctttttatttaataatttacgtttatatatggaaggatatactactacggataaattttattcagagatttttgagatgtactccctccgtttcaaaatgtttggcaccgttgatttttttagtacgtatttgaccatttgtcttattaaaaaatttaagtgattatttattcttttcatatcatttgattcattattaaatatacttttatgtacacatatagttttacatatttcataattttttttaataagacaaacgattaaacatgtgtttaaaaaatcaacggtgtcaaacattttgaaacggagggagtattatgcaatttctaagatttgattctactccgtaaattctccaaacgtagtgagctgaagatagacaatacagtggatgccacagaatgtatttatgttgtatactagtcaaacttttgagggaaaacgtcgtttggtaaaacagatttaatcctccatgatactccagtattattatttcattcacgacatatatcttgagaaaatttcgactttttttctgctcgtactagtttgctcgcccaccaaatttgaaagaatttcaaatgctttcaaataggatatattcataggaattccaaatgggagctaaaactcgctgtaacatttaaaaagaaaaagaaaagcccagcctttgcttttttttacttggcattggttgcatccacgcaggcaaaggtagatgcttgtgactttccacgccccacaagagtaggcagcctcgcttttttttcctggctttggacttgcaagattttggaggcaacatcatggaaatgcaacaaattggacagaagatgcagcctctcactaggaagcaactttgtctttcagcaaaacgagtcatttcgacttttgaggagacaaacaaacaggcaaagacaaggggtc

SEQ ID NO: 25886 - DNA, 1142 bp, Oryza sativa
ttgaattgaatccctcactgacttctgtctgtgttgtgctctatcgaatttgccttctcatgattcatccattggttgatttgatcggatgatgatacccatcacccaaagcgagtgaatccaacccccgcttcttatggatccccctcactctactctacacgtttccatcgtttttcccctactcctaaatcagttgcacgttgacgcgtttttttttcctcgtttttgttcctctactatatattttttgtgtggacgatcgtttgctgcgtgtatatgtttagatttaggctgggttaggattagattcattccgagccgtaattcccttctgaatttcgaacaataccctcttctgttttgatttactagatacaatatctctccactcccaaggatttgtctcgaggggactaaccttcagtttttactgactacgcacgattggatcacacacctcctgtcctgctgcctactacttttttcctggttatcaactcactgcaagctccgaatgccactgtgatggatattggatgactcctccatttgctgtgcgtatgagcccaactgccgctcacgtcatttggggcccccaaatttgttgctaaagttttcatgcccgattgattacattcctacagcaaacaattgaggaaacgaccgtgggtggggtcttaccatctgctactactagttagtgctgctgttgattaccattgtccttactgttttgccttcacaaaacgatgtgacgatcaacagaatgatctggacaataatagtcatgatacgattacaggacgtgtactacaacgattttcatctccgattagttaggtttgtagtttcaaggaatataaatttcatctaatttttttgtacacctgatcttgactgtctctcattttctagttaaagctgcacaatcaatttctttgtgaagggtttctttctatgaatattgcaataggataagttgtaacgcagtttatcctcacttggatacgtttccacaggttacattactgatgtgtctcgtgaacttttctttacaggccgtgcttaggagtatcttcctcgcgactgtgggttagtcctcctagtgggtttatgcatgacagcccctgcagtccttc

SEQ ID NO: 25887 - DNA, 420 bp, Oryza sativa
ggacggagggagtagtgcccattttcttttgtattttccaagatgttagttattaaaaactgaaattgtactgtcaatactcaacacctataatgaaaactagaggatgccaggaatccatggaattacctttaactgaaaacattctatgtgactatatcaatgaatacaggataatgatagctgaaacaactaagtagactatgcatttgccatcatggttgaagagttcttttctttaattaaggttttgcatgtttctattccctgttactgttctgacaaaattttaaaatagaataattcttgctggattttatctcttcatatttttttcctcgataatatatttattgctcctcctatcaagtgctctgtgatgtgtaacacaccttcatgtacttcaattaccactacaga

SEQ ID NO: 25888 - DNA, 1501 bp, Oryza sativa
ttaacagtttgaaaatcatgtgcgcagaaaacgaggaagaagggtcggaaaaactagatgttgaataaaactggatgtcgaacacaggctaatacttcaaatatgtgtccgtatactttaaaaactttacacaaaaaactaaacacacctttgactaaatatgactactacaatctacatgtctacaactgcagcaggagtacaaacacttggagtagtgatggctatgcttcgccatcgccgattatcgatgaccaagcactgacatccacgtgaacgaaatcactaaacaaatgcagctacgtacctaatctcctgtctcttcagcgagtcctccgggaattgctgaccaactgcaccagctactatacatgccaccatttcctcctctaaaatcccttatccaattcaaacatggccaaaacttaaccatccagagggagaagagagatatagatggaaaatgtgtgcttgaaaaatttccagattttctcatgttagccatacaaacatgcacgagcttaattaacgagtgttcagactgaaactgatctctgtcacaagtttgcttttagctggtgatggaagaccttcaaccaccacaagataatgcacacatccaaccgagatacattacacctgcttgagactagcttgacagcacaagcaacccaaacaaacagtcatcttcacatcagtcagccttcaaatttcaatttatgctacagcacaatccatcttatgcatcttcatatttctatacacaaaggctaacattgcaaaagagaggtacatcacttgtactactgaacatctctattcgttgtgtgataaaatactatgaaatatctagttaattaagcagacggacttaaaggtaaccaatgatggctgcaccattcacctgtattggagaagctgatgatcacggcagattgcagtgcatgagttcatcagttgtggagagggtttggtccctgaggaaccattcttcttgagacagcatacttctggccacagatgctaccggcgccggcgacgacgcctgcttctttctcttgagaaggagccatggttggagcaagctcatggcttctgaaaccactgacagcttcttctctgaatgctctccttgaaccaaggcttgagattggcaagtgagacatgacaagtagcaggagcagaatgaaagggaccaggtgctgcttggagaacctcctcatggcataagtctctagtttgtgtgtgtgtgtgtgtgtgagagagagagagagggagtcagagaggggcaaggatgagagggttttaatatggattttaggcaggccagtgtcaatgtcatgttcctgtagggaggagacaggagtgacaacaagtagagctcatgatcctccatcctatggtccagttaactctgcatattagatgatgatgtgtttggatcactgataatttggcatgtggagcccaccttttttttttcatatggactcaatgcgat

SEQ ID NO: 25889 - DNA, 918 bp, Oryza sativa
cgtatatggatcccactcatccaaaattatgtagtggtcacaaattacactggacgatacattgttcgggtgcccacagttactacatagttcatgaaatgaagccattttttttagttgatacatttatgttttggtccctgcagtctttaaaaagatcactgaacacccttttttgtgattttcagcagatggaatccatgctcgggaagatattgatactctaatttagctttagctaacatgcattgaaagtctaatggtagggtggttattggttaacagaggcagaagatgtcactttttcaaaggtaatcatcggttgcttgcttgcttgcatgagcaggctagcagacaagattgtcaatagtctctgttcactctagccatttctttattcgacatgagtttcatgaatccttctatagattccttggagaaaagataacttgtctatacaaaaatcaggcaagtttcaactgaccaaaagaactatggctgtctttagatccaaaatttggatccaaacttcagtcattttccatcacatcaacctgtcatatacacacaacttttcagtcacatcatctccaattttaaccaaaatccaaacttttgatccaactaaacacagcctatatcgcattgagtccatatgaaaaaaaaaaggtgggctccacatgccaaattatcagtgatccaaacacatcatcatctaatatgcagagttaactggaccataggatggaggatcatgagctctacttgttgtcactcctgtctcctccctacaggaacatgacattgacactggcctgcctaaaatccatattaaaaccctctcatccttgcccctctctgactccctctctctctctctcacacacacacacacacacaaactagagacttatgcca

SEQ ID NO: 25890 - DNA, 1501 bp, Oryza sativa
cgaaagtgcgaaagcatgcgtgggaggtggagcgtcctcttagagaggaggcaggtcctgacggcgtcgggcgtgttgaggcggtccaggatgttgagcagaacatcgtcaggtagcgtggtgaacctatccaccaccattacggttacgggagctgatttctgcatcgaaattaattcatggatcgacaggaaaggcagatattattattatgcaataataataatgcaaattaattaattaattaaggaagggaaagaaaagagacttacattgcggttgcggcgactacccttcttgttcttcatggtggttaataaaatccaattccaatgttaagcttctgaacggcggcgggcctgaccggacaagcgctgcgcgtattgtttatatactgatgatggagaggagaagaggaaaagaagggaggattcgattccggctccgatgcgaactagatcttcccttcccagcttccgcccgatgcgaactaggctacatatatacccacaccgactgctattccagctgaccgaccatacctatgaaattcaaccgaatccaagcaccagcagcagcagctatacatcaccggcataggtacttgtatagtataagaacaagcgaatggagctccagcattagatcggcgttagggcaacagcggtggcggcggcggcgtcggcgtgacaggggatctgctctcatctgggccgccgcttccaatgggcctcccaaagtttagggccggcctgtctttccttactttatccatacaccctaccgtaccctacttcatcagttccaatttccaaacgttcaaaacagaacccgtagtactcgaggggaataaaagaaaaaaaaacagaggtatagctgtgtgctgtttcattggcatcagatttgatctcgaaaaagggaaggtaagggaggtgacttctgtctcgatcgatccatgtacgagttcgcataggatccgggccgactgatcgagaggaagaggaggagagtcttaatactcacaccgatccatcggattgaatacgcaacaagaacaagggtgtatcatccatgaagaacaagaagggtagccgccgtaatcgcaatgtaagccgccgccgccaatcttatactgtgatatatatatagtatcattatttattgtcattgctagctgtaaaaacatcaatttagttttgtgttttgttcgttcgttatctaccctataattcaccaacacactcttacacctacattactcattcatcaaatccaacggtccagaatcatccaatccaacgcctcaaatcgtcccacgtacgcctcaacctcctctcgcatcccccactcgcagaaaccatcgctcctgagccgaaaatcacgccccccacgccgccacgcgctctccttccggcaaaccgcggtgcctagatcgctccgcctcccctcgcccattgctgcactctggatgagctcctcgccgttctacatggcgaccacc

SEQ ID NO: 25891 - DNA, 1344 bp, Oryza sativa
ttcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtgagctacctttaaatatccagctttaggtaatagtgaagctttaggctgtgttcgcatgttcagcttgggaacatagtgcctccgcacggaaaatggagcgatccattagcgtatgattaattaagtattagctattttttttcaaaaatggattaatttgatttttttaagcaactttcgtatagaaactttttgcaaaaaacacattgtttagtagtttgaaaaacgtgcgctcggaaaacggaaaacgatggagaggggctgggaacatggggttgcaaacacagccacactaatgtttctaagcatatctaagtaactatactaatatatctaattgaaccattatatgaggccaactagtcaaattgtatcccaaggtatcaaggaataaggtaatcaatgcaaattggccgtagcaaaggtataagttcacaccaccggtgacattcgaaaataaatacacagttgaaataaatagagaatttaaatataggatcaacatgctcaaaggagttgtgtttgggatctatgtgacttgccttgcaataatcggtcttcaattaatcttcttgaacacttccgacgcactcacgaatcttcgcaacaacggaaacgatgagctaatacacaaaacgaggaaaaagactaagaaactccaaataaacagtacatataaactaaataaacatgtagatcatgattttagatgaatttagagacttaaacagccttattctgacttcatatgatttagttatgaattttacaagattaatctgattttagccttatatacagaaaaggatttacgatttatcttagaaaaggaaaacgggcgctgacgtcagcga

SEQ ID NO: 25892 - DNA, 1434 bp, Oryza sativa
gtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgtt

SEQ ID NO: 25893 - DNA, 270 bp, Oryza sativa
ttccgctatttcttcaggcgtcatgttcttgagctgttcagtgttttctgatagcgttacggtatgctgggattgacagatccttgttggatctagataaccgatgggaaccatggtcttctaagcatccatgtattgcatcctataaagaaaaacccgttaatactaatcacatgcttatgtagtatatttatttatttgtgtaaaaaatgtgtgttcatactcataggcaccatgcaccaacaaagtttatgtccatcttttcccaac

SEQ ID NO: 25894 - DNA, 280 bp, Oryza sativa
agtgcagtgcactcgtttatccggtctgtgaccagtcacagactggtcagatcgcgggtttggtggcgacaggcgatctgacgcacgcctcgccccatccggtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaa

SEQ ID NO: 25895 - DNA, 664 bp, Oryza sativa
ttctcgtttgcttactttgcaatttctatgcactttgaaagaaatagaagatggattttcctttcgctttttccgtaaggagtttacacttacatggaaaagcttaagcacacttcttggttttcacgattgctgtaaaatcgatctctagaaaggaatttctgggttcgagaaaaataggttttgggaagatatttctggtgctccaatttgcaagaaacctatgatgaatgatatccataatcctacacttaggctcatgcacaaatggattgctatgactttgtttcctagaggtgatcttagaccattaggggggatgaattgattatcatgtttgccatggttagaaagatcaaaattgctcctgtgaaatgtatgataagacaatggttagaaagtataaagttctctgctcctgttgagtgcacttctctgattactcagatagcaaaaggggtaggtgtcgttagcaacaaaattgcttttatctcagccgctcgtccgtgtatggatgagacctatctagtgcaagggcatattctgaagtatggagtggatggatctttgatttactttttccccggttgtacaaataaaatcccgttgccaaatgcagggtatcatttgtataactgacatgaactaaccattcccctgtaga

SEQ ID NO: 25896 - DNA, 1501 bp, Oryza sativa
ctggcgtggcgtgttggctgcggcagcgcggcagggtcagcgctcgtgcgcttcgctctcgcgcatgacgacgtcgtcgttgacggccgagtggacagcggctggttggggcgcacaaaggtagagtaggatatttcacggtggcgtaagactcgcatccatatgaattattgagctcgtttggaatagagttcatttttattttatcaaaattttgttagtgtcgtcaataaattttggcgctatcaatatcaaatttaagtatagaatttgaactactgtgagaaaaatagagtagcaaattaaatatacatgcgacattattaaagttgataaaattttggcttggtaaaaaattaccctaaacaaacaagcttattctttaacatagtagaattagaataattatttaacaaaatttgctacaggatattaaaaaaatatgatatttactggtagacatattaagaacgttaatttgctcaaaaacactttaaaaatatgataatttacggcaaaacaatagaaccattaaactattactttcattagagctggagagagaatttaacaaaagacattgttgcccccctcttcttcgccattggtgtcgccagtggggaggaggaaagagcgggcgcagatcatggacaaccttagctggaggtgagccgcaagcggtgagccggtgagggccagtagttttaagttgtgccgcatgccgctgtgggaaacaaggtcatccgccccgtcggccgcagcggcggaccgacagcagatggcagcgttagtggagcaggaggcgaggataggaccttctcgtcgtccgacatggccggcgacggtgcactcgaccattgccggtagcagtgtcgaagctatagggggtgccgaactgggcctggcaccccccaatggcccatgaacgattccccacccccgacaaagcccatctggccatctgcgcagctgcccagcccattagcacttggagtctcgatatacgggagagagtcaagcgatacctcggcttcgtcgtgaagtcccatcgcttgcgagatggctaacgggcgatcgctaggggccggccttcagtttctcaagcacgcagcaccgacgcatcgtttccggtctccctcgtcccgtccggcgctaatcggcgatcagccgattgcagtctcgtggcgacgcggccagccgccgatagagtggctgctcgaggcaccaagcaggagctaggagcaagcaatccaacagaggtggtctgcagaacatgcgcacatcttctgagctcacggaccaggttccacctatctgttggctgctgctttttggtaagttatccccaaatcgaacactgtaaataccctgtaaatccactctatattctctagttttactaaccttgatccggtaaagcagaatcaataatcaattttgtgattttcctttatttatattttcagctacatcaaaattgctaggtgtttagctaagatga

SEQ ID NO: 25897 - DNA, 1501 bp, Oryza sativa
tgctcccagctgccctttaggtagatggcgttgctgagcacgatggccatcgtcgggccgacggatcccggcggcaggacggagtcgatgaggcccctcctcacctgtcgcgtccactcgttgatctgcttcctcgcttaatttcccggccttcaagaaaccccaaccaaatcaagaacagtgtacaaaaatttaaaattatgatttgcatcgccctgaattggcatctggatatgattcattgattcatcgtgcagattagtaatggtagatactaaccttgttcttgaaatcgacggtggtggcctcggccttgtacctgccgacgacggcgtcgcaccacacgccggacgtgaacgcgacgcgcggcccacccgacgccgacctgtcggccagcgcggtggtcgccatgtagaacggcgaggagctcatccagagtgcagcaatgggcgaggggaggcggagcgatctaggcaccgcggtttgccggaaggagagcgcgtggcggcgtggggggcgtgattttcggctcaggagcgatggtttctgcgagtgggggatgcgagaggaggttgaggcgtacgtgggacgatttgaggcgttggattggatgattctggaccgttggatttgatgaatgagtaatgtaggtgtaagagtgtgttggtgaattatagggtagataacgaacgaacaaaacacaaaactaaattgatgtttttacagctagcaatgacaataaataatgatactatatatatatcacagtataagattggcggcggcggcttacattgcgattacggcggctacccttcttgttcttcatggatgatacacccttgttcttgttgcgtattcaatccgatggatcggtgtgagtattaagactctcctcctcttcctctcgatcagtcggcccggatcctatgcgaactcgtacatggatcgatcgagacagaagtcacctcccttaccttccctttttcgagatcaaatctgatgccaatgaaacagcacacagctatacctctgtttttttttcttttattcccctcgagtactacgggttctgttttgaacgtttggaaattggaactgatgaagtagggtacggtagggtgtatggataaagtaaggaaagacaggccggccctaaactttgggaggcccattggaagcggcggcccagatgagagcagatcccctgtcacgccgacgccgccgccgccaccgctgttgccctaacgccgatctaatgctggagctccattcgcttgttcttatactatacaagtacctatgccggtgatgtatagctgctgctgctggtgcttggattcggttgaatttcataggtatggtcggtcagctggaatagcagtcggtgtgggtatatatgtagcctagttcgcatcgggcggaagctgggaagggaagatctagttcgcatcggagccggaatcgaatcctcccttcttttcctcttctcctctccatc

SEQ ID NO: 25898 - DNA, 1501 bp, Oryza sativa
gaaattgccatagagagcttatattgatcgagttaaacagcatgcagctacaatttttgtcccaactttttctgctttatgaactcctaagttgaagaaagttggtttccatggtaaacttagtggataaccgagacttgaacttattcattaccttacattgtgattgacacttgagctgttcaatatattttgcttattccattttatactatgtatctctgggagaactattcggctaatttagttttattttcctttttagctgttatggcaaatgcaattctcatcaatatctttatattttattgatggttgacgacagactttgttcaaacacattgttgaaaccctatttaactattcgctctctcttggtagggaatcattgtgatatcatccaaacagttcaaatttgacctttgcattgcagccacatgcaattaggagctagcgatcaacatgcaaatacttagctggcatcactgtaatgattataagttcaaataaatatgaatcactgctttgagcttcaatttgttgttcactgacagtttctttacactatcttctctaaatatatctattctgtacttctattacagcttgtgatgtctgcgataacctgaaagtgctttgtcagagttgagccaggctaagccatcaataatggctcaggtattaaattaaaaatttattactcaaactctcatggatctgttgacataatccaaaactgttttgagaaataagaacccattcttcgtagttttcttgtcttcatgcaacactgaagctgtgaaggaggtgccaattgttctgaagctcctatatgatcgggatgccctggatgaagggtcaaggagtccctggttatgaagaatgccaagccaattcatggagtggctccggagtgtggagtatttccagttcgtgtcatcgtgtgtgattgtcccaaagtcataagtactagagcctggggcgcgcccgttggcgcgccgcctgagtggaacattggtgaagaggcagtggatgattaagcctgagtggaatgatggtgaagaggcagtggatgattagggatatagatgggaggaaagaataagcaagttttggttaaaaaaaataagaaagcaggcactcatagagaagcaaactgcagctaataagatatagacatcttaatacttagtggtctctagtagtaataggcacatatacagatggtctttaacatctgcaaggtagtgcagtatggatggtaagcacttatggtcccaatgacgcatatccaatttcatcacttgtcgcacggcacaatgggctcatcttaaattaaatttgaatatatcaatacacttctaatataaaatttaaacaattgaccagaatggtgttaggatctcaagtttttattgtcgagaccgctcatgttcagaattcaggtatgcactactaatttcgtactaacaaatgaatcaactctatgtaattgtttttc

SEQ ID NO: 25899 - DNA, 1501 bp, Oryza sativa
ttgaccgtcagtcgggattggatgggatttgatgggcgaaatgcattagttcttagctcaggaatatgagttgtaaggtatttatgcttttattgttattataagtatgtatctaatttccccattatcttatcgctatgtaagtccgtcttatttattcgctctcatgcaaaataatctatgcataaaatttcgctcttattcgattctcttatttgagtcctttattgctttatttaatttggatttgagcatgcattgatcctacccctttgtcttctctagatggccgagcacccacccaaccaccgcggagaaggcatggatgacttcgtggcagagttggcacgcatgacactggtggtgggctaccccaacgcgccggagtacacgactgttccaccgctcagtggcgagcttcctcaccgtgtccgcttggaggtccatggttacgtggggacttgcctcgctaacatggtggtcgaggcgtctggagccacagcagatcacgcatgtcaggaggcagcatatctgatgatggccagactgcgggagcgccacaactacatcttccacaacacggtgtaccgtttccaccctcgtcgagccaacgacagtgatgtcagttccttccgtccgacagccggcgagaacgacaccaccttcagtcacgtgcgctgtgatgagggggatggacaggatgcactcggacctgcacaaggcgtccaaggccttgaatgatgggaagctcatgaggatcgtcgctctgaaggacgagatagcgcgcctgaagagggagaatgctcagttgaagggtcttcccgcgccaggaggagtccagatccgcaccacgcctcgcaagtcgacaacggcacccgtgcgcatccagcttgcgcccaggaacccacctccgtcagcagctcccgcagcacctccagttccgcccgcagctccagcagttcctacagctccagcgccagccccagctcctgttcccgtgtcagctccagcatccgctctctccttcgcacctgcatcagccgtcaggggccccgccagtggcaatgggggttggttgcctgctactcccagtggcagtcgcgaccgcagcagcagcagctccagtggcatagagccgggcagcggcgagacttatctgccaggctccaggagtcgctcagaggacctggtgacgagcaggaggacgccttcaacttcaccgaccgcaggagccgttccgagcattaggctcgttttccattagcttatcgactgtctagcttctgcttgttagtttgtgtgtttaggttgcttgcttggggtcagttgacagtcgatatcatgtgcctatgatatggctgtcttaataaggatttttgcttgctgtttaaagtattttaattcagattagaacaattgcagtttaaatttctatataataaagcttagttcctgagtatctgtttttctccgtttccccgtctgctcttcctccagatgg

SEQ ID NO: 25900 - DNA, 1501 bp, Oryza sativa
gtacttcatccatgattatacacataccgaaggaccccaagtggatattagtcagatgaactaatggagtaaagactttacacatcaaaattactactagaaagtaaccctcggcttacagatactagtaacaaagtaaaaaaaaaaaactaggtaatatatattccccacagtgctcaatcgatggaaaaccaaaggcaacaaccatccttcctactaatgaataaacacaatacattggctagcatccagtaaacctcccatgaacaacatgcaactaatgatatagacaaagagatataaactaaaactcaccgggatcagactcaatcgtgcaccacgacatcctcgcgaaaaccctgaaagattacggtgacagccagggggcgcggatccaacctgggacagaaccacccccaaaacctttgggggcaaaaaacaaactgttacttatattaaaaggagattaaagctctgatgaaattaagagaaaaaagcttcttccagatctagaagagaagctagggttaacgcgagcaagcaaattcgagacaaaagtgtgggtgagactgggagggagagagagatgaatgagaatgagagagagaggatgcggatgctcaccgggatgaggatgcacaaggacggcggcggcggcggcgccccctcccctgctctgctcgccagatgcgcgacgagcggaaggcggcgggggagagaaactcgagtcgaggcgcaatgattttggaagctaagataagatttctttttttattacttatttatttaccgataaattggtccaactaaaggaggaatttaagtatttaattatttgtcactgataggtttggcgaactatttaaatacccctttttttagatttatttttacttttttattacacatgagaaaagatgatttattaactatttgccacttatgtcaacgtgacatgccaccatggcttgctaacgtggatggaagcgtgggcccaacaagtcagcctttcaatctcagtatagtttcaacctcacgacacgggtttgagatgcttgtggctatggctggggaaaagagcggtgaggtcgaccgcagcgaggcgtggcggagcctaggcgagcaattgtaattgtgcccggcaacaaagcggggagctagggtaaggacgagcttgtcctcgccactggggagcctcaggaggtggcgggcgaagccgtcgatgaggatgttggccggccactgacaccttcgtctcgatccaaagggttatcctcctcctcctaaaagcaaccgaaatccctcgcccgttctcttcttcaactacaatgtagcaagcaacacttttcttaaaaccccatcgtttgtcccgtattacaagaaacgtctaggagtcttccgcctaactttacgaggtggttgtcggagatatgggcctgggggtgtcagggttacgggttaggcataccctttacccttcgatatacgttacatatcgata

SEQ ID NO: 25901 - DNA, 1501 bp, Oryza sativa
  unsure (1)..(1501): unsure at all n locations
aggtcgacctcggcgatggcgtcgatccggaggcggcggccgaggatgcggcggcggaggtagtaagagacgagctcctcgtcggtggggtggaagcgaaaccccggcgccaggggcaccgccgccgcggaggaggagtccggcggcgattggctcatcggcggcgaggggaatttcaatttctggatggatatgatattggagatcccgtgggaggggatcaatcccgcataattctaattctgcacggaggattgggaattttgcagggagaattgagaattgagaatcgagagaagggtagattggatcgagcggtggatggaattagggttttgaggagaaagtcgacacgagatggcgaacgccgagttagttggggaggagaggataaaagtcgcgatacggacgcagccgcgtgatgagaaagaaaataataatagaggaaatatcatactcctgggtagccgtcttgtagaagactcctgccctctggtctgtcggaaaactttttaggaatatacctttttatttaataatttcggtttatatatggaaggatatactactagggataaattttattcagagatttttgagatgtactccctccgtttcaaaatgtttggcaccgttgatttttttagtacgtatttgaccatttgtcttattaaaaaatttaagtgattatttattcttttcatatcatttgattcattattaaatatacttttatgtacacatatagttttacatatttcataattttttttaataagagaaactagtaaacatgtgtttaaaaaatcaacggtgtcaaacattttgaaacggagggagtattatgcaatttctaagatttgattctactccggaaattctccaaacgtagtgagctgaagatagtacaatacagtggatgccacagaaatgttaattttaatggttggtaattacttaggntccacaaaccttttttttgggagagggggaaaanaaaaccggttccggtttttttgggggtttacaaacagatttaatcctccatgatactccagtattattatttcattcacgacatatatcttgagaaaatttcgactttttttctgctcgtactagtttgctcgcccaccaaatttgaaagaatttcaaatgctttcaaataggatatattcataggaattccaaatgggagctaaaactcgctgtaacatttaaaaagaaaaagaaaagcccagcctttgcttttttttacttggcattggttgcatccacgcaggcaaaggtagatgcttgtgactttccacgccccacaagagtaggcagcctcgcttttttttcctggctttggacttgcaagattttggaggcaacatcatggaaatgcaacaaattggacagaagatgcagcctctcactaggaagcaactttgtctttcagcaaaacgagtcatttcgacttttgaggagacaaacaaacaggcaaagacaaggggtc

SEQ ID NO: 25902 - DNA, 1501 bp, Oryza sativa
gcgctccatcgattaagcagacggagtcatgcttcttctttgggtataaaagtttggatctcggaggctcgattcaatctctggagtgggaacaatcgtttgctcgtggtcgtgggatagctcctctgcgagatgcagagtgggagcgagatgagacccgtgcacaacagtgtcgacacggtgaacgcggctgctgttgccattgttacagccgagagccgcacgcaacctcaggcagagccggttcgtgcctcactccctgcttccatgattttttttttcatgtatgatatcttcgttgcgtgattcagctgggtcatttaggtagcttacttcgatgatattgttgtgacggcgttcttggttgcttggtggtgggagcattactcggttgttttttagttaaggttgctgtatttagtaggcaaaattgaagaactgataggcaaggtacgttttgtagtcttagatgtggttttacgctagagtgttgatgtattggacagtaaacttgcatttttagggagaaactgcgtaagtggatctatgagtgcaaattttctttgcttattcatcacttgttgacttgcaactaatttcttgtccaccgtctttaacttttacaatatatcagaaatttttagcacttcaaatcgaaaatataacataaatgctgccaggattagttcctgctgtatatttttctagctattgcaatctatgattcatttatccccggtatatattaccatgtttgaccttgaatgaaacctatgtatcaccttaaaacattgaaaatatgcatggataaattaccattataaatactgtgagaacaaaggaggggaattgttgaaactgtcagtttgaactcttcagaggaatagatgggaccaaaagattcttcctgtgctggccatatgcaagtatgcaaccagccattattttattttaacttgctgaggccttggtcattcttgttttttttattacatggcctgctgtttgggctttcatctttgtatattattaatttccctctgagattacctctcatagggaaatgcagcactatggtgctcattcatgatagccactctccaggctatttagttcgggttatctcgtggctatgatcatttatgaaaccttcttaatgcttttattttgaactggaaagtcattacctggctaatgggggatctatgacgtaattttgatgatttgtggaatttcatttctagtttttcgttacggttacatggagcctaatagctcgatgatgctatatttctattgccaacctgtttacatgttcacgttattggtcatcctaactctgcaatacaatcgctatagaatgcatgtctgacaaaagctaggtgcaggctactgtactcgactgtgcttatgctgtttatgtgccaaatatttatgctacaatagtaatcttcttaagtcacatttcaggaggattaagactttccttttgaattaaata

SEQ ID NO: 25903 - DNA, 1501 bp, Oryza sativa
taagtttgactaaatttttggaaaatctaaaataccgaattggttttatttaatctagcattgaatatattttgataatatgctattataattttctatatactcggtcaaactcaaataaagttgactaaaaaaaagttaaaacgacttacaatatgaaacgaacggaataatatagatatgttaagatataagttatacttaaagtttatttaaagataaaacaagtcatatcaaaataaatcatatttatatatattataaatggacataggaagtacaatacttgtgttgagatccgtcaattatttattaacagagaaagtataatgcctttatattagagtataaataaaatgcccctaagtgtgaatttagtgatataatattcacgtagacaatttagctgagtttgttatattggtgaacaagctgatgaagaggcatgaggtaataattcatctgaatatgttactagtagtagttagtgatattttaagactcagcagagggtgagaaacgttccacccatgcatctctttgcctgtcaattagtgacaataatagtatacaaaaatcagctgatatgaaagcaacattcttacatgtggcggtgaatcatcgttaccaagtaaaaaaaactctgtggtaataacatgatcgtattgtcaagtttccaggagaaattctcaaatataaacccagaaatcaaacattttattccttgtgcagctaggatccaatagagacatgtctgtagtaatcatgttcatgtaaacaaatgaggtgagcagaccgcagcgagtgagctcacatgcgccaaccatttttctgcacatgaaaatacaagaatgtttttttcttttttctttgggtgtacacatcatcctcatcaatgagtagagagaagagtagagggtagtagagagccaaaaaaaatcgatcatggagaggccatgtggagctcgccaagtgtgagcatttaccttcttggaaagaatcccaagctagaaatccacagaattatctgctctcaaacattggctcatctgctcaacaatcctatcctcctcctcctcctcactggcagtgattcccccaaccccatttctctctgaattgggcttgtttctttgctgaattattattttgctcattccactctggttgcttgttcagagactccatgtacaattagttgaccattcttctagttagcttctcttgtgttcttggagttggagctggtctgtccatgtgagccatgttgcagattgggctagctttgggagcaagagagtggtagatcttcttcttgccagatttattgtagatacaatacaatcccatttcttgttcagatttcttggtgaaaattcctagctagatccatactttctccagtgtagtgtgtagagaagaagaggccttgtgaatcttatcttgggaaaaagaggtatatccatccacccatctgtgtgctgttcttgattggcggcaa

SEQ ID NO: 25904 - DNA, 1501 bp, Oryza sativa
tgatagaaaacacaggttacaaagagaacaagggaacttgtcggatccggcgagattgtagtcgagttgattcgactagctctcgatgacttggctccttataagctccggcttcgtaggctgtggaggttgtgttagctctgagattcgatgcctaaaccctccccggggggccccttttatatcgcagatgtggaggtctcctcatagaactcggaggtatcagaccttatacgatacgccaacgacccagtcctgcccgagtaggattcttcccatctgtagattccgtgaaaggtttccttagaatatacaggaaatatccgcatgcgcgtgggtatgccatatcgatatgtaacgtatatcgaagggtaaagggtatgcctaacccgtaaccctgacacccccaggcccatatctccgacaaccacctcgtaaagttaggcggaagactcctagacgtttcttgtaatacgggacaaacgatggggttttaagaaaagtgttgcttgctacattgtagttgaagaagagaacgggcgagggatttcggttgcttttaggaggaggaggataaccctttggatcgagacgaaggtgtcagtggccggccaacatcctcatcgacggcttcgcccgccacctcctgaggctccccagtggcgaggacaagctcgtccttaccctagctccccgctttgttgccgggcacaattacaattgctcgcctaggctccgccacgcctcgctgcggtcgacctcaccgctcttttccccagccatagccacaagcatctcaaacccgtgtcgtgaggttgaaactatactgagattgaaaggctgacttgttgggcccacgcttccatccacgttagcaagccatggtggcatgtcacgttgacataagtggcaaatagttaataaatcatcttttctcatgtgtaataaaaaagtaaaaataaatctaaaaaaaggggtatttaaatagttcgccaaacctatcagtgacaaataattaaatacttaaattcctcctttagttggaccaatttatcggtaaataaataagtaataaaaaaagaaatcttatcttagcttccaaaatcattgcgcctcgactcgagtttctctcccccgccgccttccgctcgtcgcgcatctggcgagcagagcaggggagggggcgccgccgccgccgccgtccttgtgcatcctcatcccggtgagcatccgcatcctctctctctcattctcattcatctctctctccctcccagtctcacccacacttttgtctcgaatttgcttgctcgcgttaaccctagcttctcttctagatctggaagaagcttttttctcttaatttcatcagagctttaatctccttttaatataagtaacagtttgttttttgcccccaaaggttttgggggtggttctgtcccaggttggatccgcgccccctggctgtcaccgtaatctttcagggttttcgcgagga

SEQ ID NO: 25905 - DNA, 1501 bp, Oryza sativa
ggagagcgcggcacggcggagggcgacgaacgagagcgtcgtcgttcgtccgccgccggcgccggcgacgtcgacgacgaaggcggcagcggcggaggccgtggtgtcggggtggggcaagcgggagagcacgaaggacgccgcgtcgccggcggcggcggcggccgagtactcggattccaagatttcctccatggtattggtatctcgatctttgggtgtaacgatcgatggagaattggattggagatgaagcgaaggtggaagagggtgtgaggatttttaaagttttggcgcgctagctagcttagctagcttcgtggagtccgcttgtttggtttctccgatggcgggaaggacgaagtcatggacggctgcatgacatgacgacgacgatgacatatactcgattatatacccctcttctcttcggttttctcatctcgttgagcagtagacatactaattcaataagatatataatcgccattctttttaagaacgatttgctaggtttttttttaatttttgttcctttcgagaaacaggtcaccagctggagatctttgtcagaaaaagtacaacaagatgatactggagtatgatatacgaggatgatattttgatgatactcgttgataattaaacaatgatacttgattatactctttgatattattcatgaagatacggagtatttgctaatactcgttcttgcacattgatacttgatgatactcgttgatatttgcttatactattaatacacgtttatacgtaatggtagctagtgatgtatcgttgagtttcaagatagcaccaaaatagtgttataataatatatttctcgatttatgttataacatgaatattagtgaaggacctaatatcaaataattagaaggggtgaggttacgaatccaggtcatttaggctatcaccttgtggagctagccggaagacccctgagtgtttctcttaatgtatgttataacatcttggcatcacatgtactatctatctatcttagtaatatcgtcgaggtatcacgtacatatatatctcctacctttctctatacgttgagtggaagggggttacaatttggtggattattattacgacttgtttggtatgaaaccatgccaaaatattggcaatgccaaatcttgagtaaattttggtattactaaatttttgttattgtctatttggcttcaccttattgatttagcaaaatttgactctaattcaaatagttacgtgttaactattcaaagttaccaaataatttatttttgacctttaagttatcaaagaattagtaaggcaagaaggagcgccaaaccaaaatgacccttaatcttcaagcccatgacaaccccgaagaaaacctttgatactgggccgatttgaaaggcccaaagcagcgcaaagcccaagagagagggcaccaaatccgttggggaagtggataagagagcagcagccgcagttcctt

SEQ ID NO: 25906 - DNA, 1501 bp, Oryza sativa
atccaataatcctcacggtcgcatggcccccttcatccaagtcttgctcttaagacatctaagagcaagttctacataattgaatatcttgactgcaatgggggttacatatttgaaactgtttatgtcattttgaaagtatcaaaatatttcagtagttttcatttgatatcgatatctattgctacgtacaacctgttttttgctacttactacagttgcatatatatcgcagcttgcttgtacggtttcaatatgtaatactcctccctccgtttcacgatgtaagtcattctagcatttcccacatttatattgatgttaataaatctatatgaatgtaagaaatgctaaaatgacttacattgtaaaacggaggaagtaatatctatctcagatctaaaatatagatgtaataccctgcaacaaaatatagatatgataattaatattatgatttttggaaagcacttaatttcctatttagtcattatttgagttagaaatctatgtattaagtcatctatgaggtcctcgaaaaaaaagtcatctataaagcccgcagcaacacagcggggtatctgctagttgggtctggtgtgaatgccacgttttgaacgtgatgctaaatggattggtgttgcaaggctgacttggcagggggctgacttagcagggttgtggggggcgttggggacttgcggtgtattgacctctattttggtcagagcacaagggacgtggtctatgtgacttttttttgtaccgtatgtgcaatcgtaaggacgcaggaaaaagaaaagtctagaggtagctaagtcattttgctcgtgcagattatggtttatcacgggaacgctttgcaagctcttaaatttaaattgtctgacaattatagtatagtaaatgcaataactaaattattttgatcatttttttatacatattcagtttctaaatatacttattttgtattcagtttctagacttattttgtcaatatacttttcgtagatttgtataagcatagtgcttaatttttattattctattaaaagtcaattaattttactatgtggaaaattttgtatttgggttgagatttgagaaggtgaagaaaaaaacaaatccaaattaggggtgcaaattcaatgagcagcatatagatcaaatgcaagattataatgtaggcaaattttgctacaggatatcgcaacttcgtggtattagctgtgggacaccgcacaaagtagcttttggggaaagacagtctcaaaatgtggtcatttgccaatgcacaccgcagacattaaaatattaatttctcgttcaataggagagataaacggtgtaaaaggtcaaaaatgctcctaggcccacttgtcatattgttttcccacacctaactcccggccatatccttcgatcaccgccagcgaccaccccgacaccgacgtcggcaacggcgcgaccgcaccaccattactacttgttctccagc

SEQ ID NO: 25907 - DNA, 1501 bp, Oryza sativa
tagttatccattccagatccattacattcaatgggtacctgcgattattatcgtttattacaaaccgtgaaggaaaaaacaatgaagatttcataatttacaattacattagaataaaaacaatgaggaatgaccattttatcctatgataaaattgagatttttgtacacacccacgtcacaatacttagatattcatggctaacgaaaatataaaaaaatttctatttttcgtcaatgcgaaaaaatatttggctaatgtgaaacactaacgacgatggcatagatggaataaaacattaattcaaatttagcataacatccgagaacagatctacgaatgactgatggatccatacaaatgactagtgcattttacatgtattaccacatggcaattcaattcaacgagaaaatgtgaatcggggtgagaaataatgaatatttaccttgtaggcttcaatcttcaactaaaacccaagaaaaatcgagcaaaaccgcttccacctcctctagccgatcgatgggcaccctaagataaatttgagataaatcaagctgtcaatggacatttccgtggccttaaaatagtttgactagcattaatttgactaacgaccatgacatagatggaagaaaacattaacgcaaatttagaatttcatccaacaatagatttaatgagattaatcgagtggcaagggagggaatacatgtactgctgttggaataaaggtgctggttcaaaacccaaaaccggcaccttaatttctcttgtcaaccggcacctatgtgtggggcccaccaacggctaatacatgtactgacaagcattgttggaacataggtgccggttctagacccaaaattggcacctttgtcttaaaatcggcacctatgtgtggggcccagcgacgtctaatttgggagggagaagattaaaggtgacggtttgacggttttttactatgaaccgacacctttctctgacacagattttaggtgtcagttttatttaaaaaccagcacctattgtacataaaggtgccattttttgaaaatttggcacgtgggagcaggtgcataggcacgaaaggtattataggtgccagctttacctactccggcacctatagtgccgacaccgtaaataatacgattgactaatgtaagatataccggagaatgtaagtctcccgtaactttttttatacaaccttccttaccgagctctagctggtaaccttccagattgcttaataatgttgtggtcagagtaaagccatagacgcaaaacctgtatctggtctagacaagagaaagtacaagtctataatctctctaatactgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctca

SEQ ID NO: 25908 - DNA, 671 bp, Oryza sativa
catgtggcagagggacggatcgatcagagatcgagcgagtcagtcaaatactagtttaatatgtggagctgcatatcatatcatgtggcgctaacggcctggagattgatttcgcggtctctcggggaattttgcttgcgagtaacacatattgcgttcccggcctgtacgcacggcgcggctgcagcacgtactccggcctaatgctaaggcgcccacgactgcaattcagtgcaaatgcaacataggacggtcacccctccgtaaatctttaagtgatttcgtgtttgcggagaaaagcgataacagtacctattaacctttatagcccttttataggatcgaacataaataaccaagcctaacaaatttggggtgggtgatgatagattacatcaatggaagtcaaataatcgaatcttgatagatcaaaacacataccaacctaaaaaaaaccaatggaacacacgtctagcggtctatccgacctactagcgtcggtctgaccataggtcacttggtggtctgaccgtcagcctaaaaaaacagtacgacaaacgcttatgtgaaaactcaatttctcttaaaccaacagttggattgacaatgatgatccaagtcagacttcattagccgtgtctcgctctagtgtggggctttaagctttttgt

SEQ ID NO: 25909 - DNA, 344 bp, Oryza sativa
tactaagtgtgacaatgaactaagcactaggctaacttggtcaaagtgcctaaccacgagtttggcaaattgtggtattcaactaaagaacccttatatgtaccatgatagcgaagttagtatagctcaattggttaaattccccgtgctggaatgtacccatttgagtttttttttttttacaaactgcatcagacaatgcaaaataatgcaagttaaattctaatatagtaggaaaaatatcaagagctgtagtcaaaaccgctcggtcgctccgccccaggggcgacgcgggcggcgaaacccgccgccgccccacccttcccctcctccccccgcctagc

SEQ ID NO: 25910 - DNA, 558 bp, Oryza sativa
aaaaaaaaagagcagcctctggttgcccatgcttgctgctgcctgccatatctctgtggagcttggactattctccatgtctcctgtaatgggagctcacgtcgtcgcctgtacaaaaggtgttaattaggggataagttaagagtatctcatactgttctcaactcaactgctgactaattacaccttcggatgcaacttggaacgtactgttgcattaattattgtctgcttgcaaatttctcagagatgttgaatttgatgaagtgtacgtgcgtcgcatttgcagtccaacatcacacctttgacttgatgtgattcaagcaacaagtgaagtgctaggctaaacacaagcacagttccccgaaatcatgccatttattcttgacacatggacatcctggaaattgttcaaagtttctagactgctaggaatgcgaataacttgtactgaacttttgaaacatttttgtcagcccaatcaggattttttttagtttatttcctgaaactctgcattggaacgaataaataaatggtgtctcaagaaaataaagc

SEQ ID NO: 25911 - DNA, 1501 bp, Oryza sativa
gcagtagaccttgttcgtgagtggttgcggcttctgttgtgtttggtcgcctttgttcgctagtgcatctggattccatgatcatgatcatgatgtccatgcagattgatgtggtgactgactgactgaatgaatgaacagctgcagctatagctgagggtgtgtttagttaacgctaaaattagaagtttggttaaaattggaatgatacgacggaaaagttggaagtttgtgtatgtaggaaagttttgatgtaatagaaaagttgaaagtttgaagaaaaaatttggaagtgaataaacgagtgagctctccttttccttttgacccactctgctagctgcccttcttcccctagtggccattttcccccatactagccgactttgctactacttgatagtcttatcactgagaggaatggacgcacattattatatgctagattgttaaatcgagaggggattactgttgcaagtgagacagtacctagcacataatatgaaggtatatattcattcttcttgggtcgagttgttagcaatgctgaattatcaatgtttgccaactgctagcaattaggaagaatggctagtttgtggctatgattgatcgatcatcaagctaaagataatgctatgcaagtcgagacagctcgatgagctcacacaaaggataatcttccaaactgaccactctgtccgtggtcttgtttggatcctccgagctattaaatagtcctctgaaattttgctatttaggattattaaacgtagattaccgacaaaaccgattccatagcccctaggctattttgcgaagcgaatctaatgatgtaaattaatccatattagcagctgattactgtagtattaatgtacccaatcatggattaatatacctcgttagattcgtctcgcaaaatagcctagtggttatggaatgagttttgtcagtaatttacgtttaatactcttaaataacgaaattccggagggctatttaatagccctccggatccaaacagggcccgtgtcacctaaacaaaaatggctttaatttccagaacctgccccgtagcaaacgaacccatactactaatctatcatatcatcttgtgaattatttatctctcgctgacaataaccgatgaaccatcaaattcaagcttagtaacagtagcgcttcctgtcatccacagattaatcaaggtaaaacaaaaacccctaccatcatcgttgtcgtccactaattactaaattgccgactgctaaaacaaaatgaataattaattaattaattaattagtaaagaggaagagaaagagaaggccattggtgcagacgtagtagtggagcaggagctataaaaagaagcaggaagccactcgctctcctcacagccacagctcgccatcgtcgtcgtcgtcgtcgtcgtctccggctccggcaagagagctagtagtgagtagtagaaagaagaagaggcaaattaatagtaa
